United States Patent 11,725,251 (METHYLATION MARKERS AND TARGETED METHYLATION PROBE PANEL) - sequence listing, part 9

SEQ ID NO: 91848 - DNA, 169 bp, Homo sapiens
  misc_feature 1..169: note = chr4:169753974-169754143
  misc_feature 1..169: note = hyper
  source 1..169: mol_type = genomic DNA
ttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaaggga

SEQ ID NO: 91849 - DNA, 153 bp, Homo sapiens; identical to SEQ ID NO: 40364
  misc_feature 1..153: note = chr4:170484641-170484794
  misc_feature 1..153: note = hypo
  source 1..153: mol_type = genomic DNA

SEQ ID NO: 91850 - DNA, 35 bp, Homo sapiens
  misc_feature 1..35: note = chr4:170537901-170537936
  misc_feature 1..35: note = hypo
  source 1..35: mol_type = genomic DNA
ggattacaggcatgagccaccgctcctggcaagat

SEQ ID NO: 91851 - DNA, 26 bp, Homo sapiens
  misc_feature 1..26: note = chr4:170865261-170865287
  misc_feature 1..26: note = hypo
  source 1..26: mol_type = genomic DNA
ggtttcgtctgcggcttgtcctgcta

SEQ ID NO: 91852 - DNA, 30 bp, Homo sapiens
  misc_feature 1..30: note = chr4:170899334-170899364
  misc_feature 1..30: note = hypo
  source 1..30: mol_type = genomic DNA
caaaatgcacaggctcgagattttggagtc

SEQ ID NO: 91853 - DNA, 30 bp, Homo sapiens
  misc_feature 1..30: note = chr4:170912774-170912804
  misc_feature 1..30: note = hypo
  source 1..30: mol_type = genomic DNA
ctcttttttggactgcgggtgaactgacac

SEQ ID NO: 91854 - DNA, 93 bp, Homo sapiens
  misc_feature 1..93: note = chr4:170916682-170916775
  misc_feature 1..93: note = hypo
  source 1..93: mol_type = genomic DNA
gaatctccatccacacggcacttgtccagacaggaacatctcgaaaacgttcttgctgctgcacattaccattcgcatcggtctataaatacc

SEQ ID NO: 91855 - DNA, 30 bp, Homo sapiens; identical to SEQ ID NO: 40365
  misc_feature 1..30: note = chr4:170919945-170919975
  misc_feature 1..30: note = hypo
  source 1..30: mol_type = genomic DNA

SEQ ID NO: 91856 - DNA, 592 bp, Homo sapiens
  misc_feature 1..592: note = chr4:170947275-170947867
  misc_feature 1..592: note = hyper
  source 1..592: mol_type = genomic DNA
aaacacccgaaagttcggcggccccggcgccgactcggccgccgacccggtgcggggctggctcccacccgtgcccctccgccccggcccgccgggggcccccgctaacctgacaccgccgcgccactcaggtggccgccgtgcacccctcgccatggccagcccgacagcggccgctgcgccgcactctgcgccggacgcccggtagcgcctactgcgggcgagccgcctccgccggcgcctcacagcgttgcgagctgcgccgccggctgccgggagcgcggagcttcccacctacaggagcctgggccggccggggccgagcatgcccagtgcggctcgccgggcggcgcggaggcgcgggtgtagccgccgggttttcgcggcagccgcgggcgggggcagcggggcgggcggtgcggcgcgagccagtcggtgctgcggagcggccccgcggaggagccaccggaggctgtagttgccggggagtcccgcattcagtccgctcagcctctgggccgggcctcggcggcccccagagccccacacccgcaggcccagggcctccgcggcagcgcgggactctcactcc

SEQ ID NO: 91857 - DNA, 318 bp, Homo sapiens
  misc_feature 1..318: note = chr4:170948515-170948833
  misc_feature 1..318: note = hyper
  source 1..318: mol_type = genomic DNA
cccggtgggttgctgcgaaaacccggaaaggtggactttccacattgacgctcccggcggctccggcagccagactgggcatgttccgccgccgggtcaggcattgctgtgccaagagaggagctttagcaactctcagtctctctgctcctctctgttcctggcaaactggcaaagtagtgcctctgaccccacgccccgaggtcggacctgcagaagtgggtcaggacccgactgagcatgctccgggcagtgccaggctgccgcacgcggctgcatctggttgcccaaggttgatgtagccgcggtctctcgtca

SEQ ID NO: 91858 - DNA, 62 bp, Homo sapiens
  misc_feature 1..62: note = chr4:171544709-171544771
  misc_feature 1..62: note = hypo
  source 1..62: mol_type = genomic DNA
gacactgacaggaggcggagctcaggcggtaatgctcacttacctgccgctcacctcctgct

SEQ ID NO: 91859 - DNA, 30 bp, Homo sapiens
  misc_feature 1..30: note = chr4:1719182-1719212
  misc_feature 1..30: note = hypo
  source 1..30: mol_type = genomic DNA
gcccaggcagacacccgtgggcacccaccc

SEQ ID NO: 91860 - DNA, 15 bp, Homo sapiens
  misc_feature 1..15: note = chr4:171964525-171964540
  misc_feature 1..15: note = hypo
  source 1..15: mol_type = genomic DNA
cgggcctcagctgcc

SEQ ID NO: 91861 - DNA, 24 bp, Homo sapiens
  misc_feature 1..24: note = chr4:172498649-172498673
  misc_feature 1..24: note = hypo
  source 1..24: mol_type = genomic DNA
tttttttttttgagacggagtctc

SEQ ID NO: 91862 - DNA, 80 bp, Homo sapiens
  misc_feature 1..80: note = chr4:172596057-172596137
  misc_feature 1..80: note = hypo
  source 1..80: mol_type = genomic DNA
tgtaacatacgcccacttgggctctgggagtcacaggttcccaaccctggatgctgccgtggggccgaagcccagcaccc

SEQ ID NO: 91863 - DNA, 32 bp, Homo sapiens
  misc_feature 1..32: note = chr4:172596627-172596659
  misc_feature 1..32: note = hypo
  source 1..32: mol_type = genomic DNA
tactgaagctagggccgggcgcggtggctcac

SEQ ID NO: 91864 - DNA, 552 bp, Homo sapiens; identical to SEQ ID NO: 29269
  misc_feature 1..552: note = chr4:172733596-172734148
  misc_feature 1..552: note = hyper
  source 1..552: mol_type = genomic DNA

SEQ ID NO: 91865 - DNA, 88 bp, Homo sapiens; identical to SEQ ID NO: 403
  misc_feature 1..88: note = chr4:172734188-172734276
  misc_feature 1..88: note = hyper
  source 1..88: mol_type = genomic DNA

SEQ ID NO: 91866 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 91867 - DNA, 269 bp, Homo sapiens
  misc_feature 1..269: note = chr4:172734591-172734860
  misc_feature 1..269: note = hyper
  source 1..269: mol_type = genomic DNA
ggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagag

SEQ ID NO: 91868 - DNA, 217 bp, Homo sapiens
  misc_feature 1..217: note = chr4:172735016-172735233
  misc_feature 1..217: note = hyper
  source 1..217: mol_type = genomic DNA
cgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttc

SEQ ID NO: 91869 - DNA, 24 bp, Homo sapiens
  misc_feature 1..24: note = chr4:172903767-172903791
  misc_feature 1..24: note = hypo
  source 1..24: mol_type = genomic DNA
tcttccagacgagcttgttggagg

SEQ ID NO: 91870 - DNA, 30 bp, Homo sapiens; identical to SEQ ID NO: 28831
  misc_feature 1..30: note = chr4:17326218-17326248
  misc_feature 1..30: note = hyper
  source 1..30: mol_type = genomic DNA

SEQ ID NO: 91871 - DNA, 17 bp, Homo sapiens
  misc_feature 1..17: note = chr4:174307595-174307612
  misc_feature 1..17: note = hypo
  source 1..17: mol_type = genomic DNA
gccgtgtttatatacac

SEQ ID NO: 91872 - DNA, 55 bp, Homo sapiens
  misc_feature 1..55: note = chr4:174429633-174429688
  misc_feature 1..55: note = hyper
  source 1..55: mol_type = genomic DNA
aacttttccaccttccggacctctgcagtccgtcgcaggacgcccaaaccacagg

SEQ ID NO: 91873 - DNA, 321 bp, Homo sapiens; identical to SEQ ID NO: 29276
  misc_feature 1..321: note = chr4:174430233-174430554
  misc_feature 1..321: note = hyper
  source 1..321: mol_type = genomic DNA

SEQ ID NO: 91874 - DNA, 357 bp, Homo sapiens; identical to SEQ ID NO: 29277
  misc_feature 1..357: note = chr4:174430793-174431150
  misc_feature 1..357: note = hyper
  source 1..357: mol_type = genomic DNA

SEQ ID NO: 91875 - DNA, 610 bp, Homo sapiens
  misc_feature 1..610: note = chr4:174437937-174438547
  misc_feature 1..610: note = hyper
  source 1..610: mol_type = genomic DNA
cgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaaccttttacaaggcatgtgggtacaagaaaaaaaatcaaaataaaccactttcatccagcatgggcagtgaaaagaaaagctgccttccagagggggcgagcgggagttttgaaat

SEQ ID NO: 91876 - DNA, 551 bp, Homo sapiens
  misc_feature 1..551: note = chr4:174439797-174440348
  misc_feature 1..551: note = hyper
  source 1..551: mol_type = genomic DNA
gctgcatctgggacccgccttcaccgtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctattagcagccaggtagccctgcgggtcgaagatgctcagaggaggagtaaatgcagagaaaaaatagaggaaggaataaaaaaaaaaacaaaacaaaaacacgtaacatacacgcactcaaaaccaa

SEQ ID NO: 91877 - DNA, 125 bp, Homo sapiens
  misc_feature 1..125: note = chr4:174440635-174440760
  misc_feature 1..125: note = hyper
  source 1..125: mol_type = genomic DNA
cccgccccctccccacgcacacagccacggcccctcgcgtcttcgcggcacgttaattaaatgcggaaaacagacagaggctgatgtcattgctctcacaagatcataaacgtaaaagagtcatc

SEQ ID NO: 91878 - DNA, 30 bp, Homo sapiens; identical to SEQ ID NO: 29281
  misc_feature 1..30: note = chr4:174443212-174443242
  misc_feature 1..30: note = hyper
  source 1..30: mol_type = genomic DNA

SEQ ID NO: 91879 - DNA, 522 bp, Homo sapiens; identical to SEQ ID NO: 29282
  misc_feature 1..522: note = chr4:174443551-174444073
  misc_feature 1..522: note = hyper
  source 1..522: mol_type = genomic DNA

SEQ ID NO: 91880 - skipped

SEQ ID NO: 91881 - DNA, 35 bp, Homo sapiens
  misc_feature 1..35: note = chr4:174448318-174448353
  misc_feature 1..35: note = hyper
  source 1..35: mol_type = genomic DNA
aaggagtcctcagagcggagcgcggacggcttttc

SEQ ID NO: 91882 - DNA, 203 bp, Homo sapiens
  misc_feature 1..203: note = chr4:174448460-174448663
  misc_feature 1..203: note = hyper
  source 1..203: mol_type = genomic DNA
cggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtccc

SEQ ID NO: 91883 - DNA, 38 bp, Homo sapiens; identical to SEQ ID NO: 29284
  misc_feature 1..38: note = chr4:174449624-174449662
  misc_feature 1..38: note = hyper
  source 1..38: mol_type = genomic DNA

SEQ ID NO: 91884 - DNA, 509 bp, Homo sapiens
  misc_feature 1..509: note = chr4:174449899-174450408
  misc_feature 1..509: note = hyper
  source 1..509: mol_type = genomic DNA
tcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccacc

SEQ ID NO: 91885 - DNA, 318 bp, Homo sapiens; identical to SEQ ID NO: 29286
  misc_feature 1..318: note = chr4:174450409-174450727
  misc_feature 1..318: note = hyper
  source 1..318: mol_type = genomic DNA

SEQ ID NO: 91886 - DNA, 1431 bp, Homo sapiens
  misc_feature 1..1431: note = chr4:174450751-174452182
  misc_feature 1..1431: note = hyper
  source 1..1431: mol_type = genomic DNA
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatct

SEQ ID NO: 91887 - DNA, 312 bp, Homo sapiens
  misc_feature 1..312: note = chr4:174452460-174452772
  misc_feature 1..312: note = hyper
  source 1..312: mol_type = genomic DNA
cggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccag

SEQ ID NO: 91888 - DNA, 253 bp, Homo sapiens
  misc_feature 1..253: note = chr4:174459122-174459375
  misc_feature 1..253: note = hyper
  source 1..253: mol_type = genomic DNA
atgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggc

SEQ ID NO: 91889 - DNA, 124 bp, Homo sapiens; identical to SEQ ID NO: 29291
  misc_feature 1..124: note = chr4:174459527-174459651
  misc_feature 1..124: note = hyper
  source 1..124: mol_type = genomic DNA

SEQ ID NO: 91890 - DNA, 365 bp, Homo sapiens
  misc_feature 1..365: note = chr4:174459856-174460221
  misc_feature 1..365: note = hyper
  source 1..365: mol_type = genomic DNA
tttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtg

SEQ ID NO: 91891 - DNA, 466 bp, Homo sapiens
  misc_feature 1..466: note = chr4:175132735-175133201
  misc_feature 1..466: note = hyper
  source 1..466: mol_type = genomic DNA
gaggctgaagagtagcgttctgggtccccagctcagtaggcaccacctctcagggaagtgaccaccactacgctctcagctccgcaagtcgctggacagtcaatagcgctcacacggtgtctaccggatctggcacggtcaagacacaggaacagccgtactttcctgcgggtaagaggcttttcttttgtgcatcacgtgcagaagaagccactccgaagtgcaaacacctttctaaagttttcagtgcttcctaaaatgcagacatcgacgccttgctgagttatccgatcctttgatgatcaaataaaattaaggccagctccctgctgtttgatctgtggctcagtttctctaagggctgccgcgggttccgcaaagactcactccagaatccccagctccctcgcgtcagcgaatgtcccgctggtccaggcagccttttcctgcgcggttcttcagttcc

SEQ ID NO: 91892 - DNA, 1293 bp, Homo sapiens
  misc_feature 1..1293: note = chr4:175134868-175136161
  misc_feature 1..1293: note = hyper
  source 1..1293: mol_type = genomic DNA
cctctgggtccttaccgaaagggaaggtcccaaaggaccaccagcgcgctctcggaggctccaggactagacattggactcccacagcgcaacaccatagggactccggtgttcggttcccgtggccctctccttggctcccggtcaccgtcctcacaccccctggccccagttactgacggaagccatgtgcagctgccataatgtgtataaaagaatctctccctggcgttggtttcttctcttcttggaatgcttttggcagatcctccgcgttttccgggtctcttgggagtctgaacatgcattttcctttatttcagacaggattccgagtgttaactagattgtgccctccccactacctatcctgcccatcttccttctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgggtggtttcgcccccctcatcccctcggtcgctggcgcagattgatcctggagctagttacgggtgttaaactggtacgcgggtggggcaattcattaggcaagaaatggattagttgtttattatctataaacattccaaccacagcaaccaatcataaaaccgcggaagggcctgtaaagtaaagcagcagcgaagcctccatgtgggcagctcaggcttagcgattgttcccgggtgataaagggtcgattagggaagtagagctaggaaggtgggggcgggggagcgggcgataattaagcgagtcgtcaggaaattgctttctagatggggatcatgatgcctctaacttgaacggggcaggagaaatattggggtgatttggaagacggtgataagggaaagcacaaaataaggattggagggccgcagtgaggtcattagtgaagctgatgccggagataaaagctg

SEQ ID NO: 91893 - DNA, 83 bp, Homo sapiens
  misc_feature 1..83: note = chr4:175137696-175137779
  misc_feature 1..83: note = hyper
  source 1..83: mol_type = genomic DNA
gattgcctgaccactcgtctctctccagcgtttctctaagtccgagcccccatctctcccagtcctcccggctcagcgaggaa

SEQ ID NO: 91894 - DNA, 1458 bp, Homo sapiens
  misc_feature 1..1458: note = chr4:175138499-175139957
  misc_feature 1..1458: note = hyper
  source 1..1458: mol_type = genomic DNA
acctagtttgctagacgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagccccagggccaggcaagcggccaagctgcgctctcgataaaggagccagaatggttccatctggttacaaacatatctttttattaaaaagcaatcagatcctgaagcgcttcccttgcggtttaccgctctccgcaggctgcttctccgaagccagcggtggtagcgcccactcggttgagcccacgcctccgccaggcagcgcctccgccaggcagacctcctgcgggacattttgtggccaggggggttcctgcccagggacctctaatagggtcggtggaagctaatttgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgccattcctctccagctcccgagccccactcccacccttgccgttgaaactgtgaaaaagccgccaaagtttgggcacccagcctggcagtcggaagacagtgagataaagaatgcgatagtaagtccttaagtgcttcctagagataaggtcccggaatcctggaaaaattcagtctggcctccctacttcagcaagtcgcctcctgcttctgtcagccccctccccacacacacctggagggagaggcggtggccacaggggtagctggggcagaccctccgctcctccactcccggtggccaggggtcctaaggccacgcggctggctttcttctctgggaatcaggagatgataatgagaaaatccctcaaccattggcgcgacgaaactcaaaaatg

SEQ ID NO: 91895 - DNA, 30 bp, Homo sapiens
  misc_feature 1..30: note = chr4:1752186-1752216
  misc_feature 1..30: note = hypo
  source 1..30: mol_type = genomic DNA
ctgtatgggcagagccggggctgctctgag

SEQ ID NO: 91896 - DNA, 30 bp, Homo sapiens
  misc_feature 1..30: note = chr4:1752494-1752524
  misc_feature 1..30: note = hypo
  source 1..30: mol_type = genomic DNA
ggtagaccctcaccccgacccccctgtgcc

SEQ ID NO: 91897 - DNA, 30 bp, Homo sapiens
  misc_feature 1..30: note = chr4:1753599-1753629
  misc_feature 1..30: note = hypo
  source 1..30: mol_type = genomic DNA
ctccaggttaaggtgcgcctgccaagcagg

SEQ ID NO: 91898 - DNA, 604 bp, Homo sapiens
  misc_feature 1..604: note = chr4:175443197-175443801
  misc_feature 1..604: note = hyper
  source 1..604: mol_type = genomic DNA
attccaatccaccagcgctacctatagacaagaggagaggaatcgcgggcctgcgcagctcacgaaatagacggacaaacaataaacacacaagaggctcccctcctggacctgaaatttggcaattaggtttgggttccctcccagccacttctgaggtgtgctcacagcctcagcttcagcaaattttggaagtggcaaagtgggcacgccgggcgcggcctccctgtctccgccagtgcacctcgggcggcggggcgagtctcggagtgtgtgggcagagaaatttccgcggctgggcgccgggcttaccttggcgcccttaagcagcagcgcctctgcaaaggctctgcctatgccctgagccgcgccggtcaccagcgccactttgccgttcacgtgcatggtgcagccactgctggggcgggcggtgggcgagctccgcgtctccgcgcggccgcggcttttatgcccccctgcgcgcgcgcgcgtgcagcccggcggggcgctcccctgccagtgggcggggaggaaactgtcaagccagcgcccgccggggaacccacgactgtgtcacctgccccctgagcgttctggagcgcca

SEQ ID NO: 91899 - DNA, 884 bp, Homo sapiens
  misc_feature 1..884: note = chr4:175749823-175750707
  misc_feature 1..884: note = hyper
  source 1..884: mol_type = genomic DNA
aacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacactttaggtcttctcggatgtgacactgt

SEQ ID NO: 91900 - DNA, 22 bp, Homo sapiens
  misc_feature 1..22: note = chr4:175836862-175836884
  misc_feature 1..22: note = hypo
  source 1..22: mol_type = genomic DNA
ccgcgcccggccccattgttta

SEQ ID NO: 91901 - DNA, 87 bp, Homo sapiens
  misc_feature 1..87: note = chr4:175940800-175940887
  misc_feature 1..87: note = hypo
  source 1..87: mol_type = genomic DNA
agtacgcgtgtgcctcgcgccagtccacgctaggagagcactgggaccgagacccggcaccacctcccggtccgccctccagaactt

SEQ ID NO: 91902 - DNA, 30 bp, Homo sapiens
  misc_feature 1..30: note = chr4:17638206-17638236
  misc_feature 1..30: note = hypo
  source 1..30: mol_type = genomic DNA
tgagctgaaggtcctcgggcctggacgctc

SEQ ID NO: 91903 - DNA, 45 bp, Homo sapiens
  misc_feature 1..45: note = chr4:176394073-176394118
  misc_feature 1..45: note = hypo
  source 1..45: mol_type = genomic DNA
ggaacctgaaaatttcgtctttgcaggtggcggcttccctacagg

SEQ ID NO: 91904 - DNA, 15 bp, Homo sapiens
  misc_feature 1..15: note = chr4:176922653-176922668
  misc_feature 1..15: note = hyper
  source 1..15: mol_type = genomic DNA
gttcttcctcccctc

SEQ ID NO: 91905 - DNA, 50 bp, Homo sapiens; identical to SEQ ID NO: 29302
  misc_feature 1..50: note = chr4:176922729-176922779
  misc_feature 1..50: note = hyper
  source 1..50: mol_type = genomic DNA

SEQ ID NO: 91906 - DNA, 301 bp, Homo sapiens; identical to SEQ ID NO: 29303
  misc_feature 1..301: note = chr4:176922780-176923081
  misc_feature 1..301: note = hyper
  source 1..301: mol_type = genomic DNA

SEQ ID NO: 91907 - DNA, 607 bp, Homo sapiens
  misc_feature 1..607: note = chr4:176923082-176923689
  misc_feature 1..607: note = hyper
  source 1..607: mol_type = genomic DNA
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctccctctttccacctgcctcctctgcgagaagcccgttttcctcccctt

SEQ ID NO: 91908 - DNA, 319 bp, Homo sapiens
  misc_feature 1..319: note = chr4:176986855-176987174
  misc_feature 1..319: note = hyper
  source 1..319: mol_type = genomic DNA
cgccttcaacacactttctctgttgccaggtaaccacttctccctcagcctagtctccaagggtcacgagccacttccgcctccccctctcgggcgctccaatcagcgacctgtgtagctgtcacgtgggcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgc

SEQ ID NO: 91909 - skipped

SEQ ID NO: 91910 - DNA, 107 bp, Homo sapiens; identical to SEQ ID NO: 2497
  misc_feature 1..107: note = chr4:176987206-176987313
  misc_feature 1..107: note = hyper
  source 1..107: mol_type = genomic DNA

SEQ ID NO: 91911 - DNA, 42 bp, Homo sapiens; identical to SEQ ID NO: 29308
  misc_feature 1..42: note = chr4:176987314-176987356
  misc_feature 1..42: note = hyper
  source 1..42: mol_type = genomic DNA

SEQ ID NO: 91912 - DNA, 1177 bp, Homo sapiens
  misc_feature 1..1177: note = chr4:177713228-177714405
  misc_feature 1..1177: note = hyper
  source 1..1177: mol_type = genomic DNA
acacacactttcccccgcgcaggttctcgggtccgccgcagaccctaacgcaaactctcgggttctccgcaaaccctaacgcagacctaccgtggcctcgcccgcgtcgggctccgcgtccgagaggtcgagtccggactcgaaggcggcggcggcggcgggcgcctcgcgaggacccgggagcagcgcagcggcgagcagagaacacgccacagagaagaagcccagcaagtgcatggtggaaggaccgggggtgggggaccggtccgctggcgggggcaggggtgggggcgcgggcgcccctgcgaggccgcgggcccctcctggtccctctcccccgggctcctcccggcgaccccccctgggcgagccggaggcggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggcccccctctggatctctccctccccgcccctgtcccctgcggggagcgggcggccggaggggcaagttcagtcccggggctggcggttggcgggaccggctttagaggtgatgcgaccaccctggaccacgtgcagcggggagaaactgggcaccgtggggtggaggga

SEQ ID NO: 91913 - DNA, 460 bp, Homo sapiens
  misc_feature 1..460: note = chr4:17782834-17783294
  misc_feature 1..460: note = hyper
  source 1..460: mol_type = genomic DNA
agtccattctccagccggcgccaccgtcggctttggagccctggcaagtgccgggcgggttaattttgctgttgagagcagaagccatcgctaaaacgcgcccagcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 91914 - DNA, 27 bp, Homo sapiens
  misc_feature 1..27: note = chr4:17783295-17783322
  misc_feature 1..27: note = hyper
  source 1..27: mol_type = genomic DNA
gtgggcgggcactgcgctcttggacac

SEQ ID NO: 91915 - DNA, 158 bp, Homo sapiens; identical to SEQ ID NO: 2390
  misc_feature 1..158: note = chr4:17783323-17783481
  misc_feature 1..158: note = hyper
  source 1..158: mol_type = genomic DNA

SEQ ID NO: 91916 - skipped

SEQ ID NO: 91917 - DNA, 182 bp, Homo sapiens
  misc_feature 1..182: note = chr4:177973020-177973202
  misc_feature 1..182: note = hypo
  source 1..182: mol_type = genomic DNA
aaacagatttgctttcgttgtctgcatagcttctgctagcatcatgatccgtttaagagaatgccttattctccatttactattcctcataagattattctgattcagaatttcacaaaaatatttgcttcccatacccacaaccttgcacttgaaagacttaggggcgctagtcctaagag

SEQ ID NO: 91918 - DNA, 20 bp, Homo sapiens
  misc_feature 1..20: note = chr4:178109673-178109693
  misc_feature 1..20: note = hypo
  source 1..20: mol_type = genomic DNA
tttttttttttgagacggag

SEQ ID NO: 91919 - DNA, 30 bp, Homo sapiens
  misc_feature 1..30: note = chr4:17818237-17818267
  misc_feature 1..30: note = hypo
  source 1..30: mol_type = genomic DNA
actgcaaatagcaatcgtgtaatagataaa

SEQ ID NO: 91920 - DNA, 25 bp, Homo sapiens
  misc_feature 1..25: note = chr4:178599692-178599717
  misc_feature 1..25: note = hypo
  source 1..25: mol_type = genomic DNA
tgcgcccagccgagtccatttggga

SEQ ID NO: 91921 - DNA, 30 bp, Homo sapiens
  misc_feature 1..30: note = chr4:1788923-1788953
  misc_feature 1..30: note = hypo
  source 1..30: mol_type = genomic DNA
tgtgcccctgctgagcgtgccgggtggggg

SEQ ID NO: 91922 - DNA, 75 bp, Homo sapiens
  misc_feature 1..75: note = chr4:1791269-1791344
  misc_feature 1..75: note = hypo
  source 1..75: mol_type = genomic DNA
tgcccacctccctgtcgggaaaggcggcagctgcctgcccggagtgctgtggggaacaggcggtgtggatctgag

SEQ ID NO: 91923 - DNA, 73 bp, Homo sapiens
  misc_feature 1..73: note = chr4:179443386-179443459
  misc_feature 1..73: note = hypo
  source 1..73: mol_type = genomic DNA
gaactgtaagtatgacgcggtagccgctcccactgcataactaagttctattatacagcgcaggagactttaa

SEQ ID NO: 91924 - DNA, 109 bp, Homo sapiens
  misc_feature 1..109: note = chr4:1796489-1796598
  misc_feature 1..109: note = hyper
  source 1..109: mol_type = genomic DNA
cctcgtgggccgggccgagagctccggtgccgccgccgcgtacacccgcagccggctccggacgggcgaggggggcgcgcacagctcagcccggcggccgcgcggaggg

SEQ ID NO: 91925 - DNA, 649 bp, Homo sapiens
  misc_feature 1..649: note = chr4:1803127-1803776
  misc_feature 1..649: note = hypo
  source 1..649: mol_type = genomic DNA
caagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggt

SEQ ID NO: 91926 - DNA, 155 bp, Homo sapiens
  misc_feature 1..155: note = chr4:1804729-1804884
  misc_feature 1..155: note = hypo
  source 1..155: mol_type = genomic DNA
caccaatttcataggcgtggccgagaaggccttttggctgagcgttcacgggccccgagcaggtaacgactctgtcccatgccggccggcacaagagctccagctccaaggccctggccgcgcgccctgcacgccccgcacgcccagccctgctc

SEQ ID NO: 91927 - DNA, 546 bp, Homo sapiens
  misc_feature 1..546: note = chr4:1805091-1805637
  misc_feature 1..546: note = hypo
  source 1..546: mol_type = genomic DNA
ctgcctgctcgcttccgcagcctgtgtgtccctgtgtccatcctccacctgcacccgcccggctctgcgctaacccgcatgctgcctgcccgcctgccgctcacctgggacagaggactcgccggtggaggggcctggcttcgggctcagtaccggtgtaccaggcggagggccctcagccgcgtggcggtgaccaagttggcggtggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccag

SEQ ID NO: 91928 - DNA, 106 bp, Homo sapiens
  misc_feature 1..106: note = chr4:1805886-1805992
  misc_feature 1..106: note = hypo
  source 1..106: mol_type = genomic DNA
ctctagactcactggcgttactgactgcgagaccctccagacaaggcgcgtgctgaggttctgagcccccttccgctcccagtggtgcctgcggctctgggccagg

SEQ ID NO: 91929 - DNA, 436 bp, Homo sapiens
  misc_feature 1..436: note = chr4:1807256-1807692
  misc_feature 1..436: note = hypo
  source 1..436: mol_type = genomic DNA
ctgacacaggccccccgctccgtgcacagacgatgccactgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 91930 - DNA, 30 bp, Homo sapiens; identical to SEQ ID NO: 40370
  misc_feature 1..30: note = chr4:180818589-180818619
  misc_feature 1..30: note = hypo
  source 1..30: mol_type = genomic DNA

SEQ ID NO: 91931 - DNA, 426 bp, Homo sapiens
  misc_feature 1..426: note = chr4:180979223-180979649
  misc_feature 1..426: note = hyper
  source 1..426: mol_type = genomic DNA
acagcggtcaattgccgttttagagctcattttggggcgaatggtagcagcagagccactgccgccctggctcttgtaggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctcgcccggccggcggaagagggag

SEQ ID NO: 91932 - DNA, 406 bp, Homo sapiens
  misc_feature 1..406: note = chr4:180980004-180980410
  misc_feature 1..406: note = hyper
  source 1..406: mol_type = genomic DNA
gaggagggatggagccgggaggaggaaataaataaataaaacaatcacctccgcgccaataagagcgagggagagagcaagacgcgaccagagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcag

SEQ ID NO: 91933 - DNA, 40 bp, Homo sapiens
  misc_feature 1..40: note = chr4:180980984-180981024
  misc_feature 1..40: note = hyper
  source 1..40: mol_type = genomic DNA
aaagtggggctgcctcgtcggagagcgcaactctggagct

SEQ ID NO: 91934 - DNA, 58 bp, Homo sapiens
  misc_feature 1..58: note = chr4:1811789-1811847
  misc_feature 1..58: note = hyper
  source 1..58: mol_type = genomic DNA
gcagagcatggggctcgaagcgcgggccgggagcgccccctagcgctggctgggcagt

SEQ ID NO: 91935 - DNA, 24 bp, Homo sapiens
  misc_feature 1..24: note = chr4:181546386-181546410
  misc_feature 1..24: note = hypo
  source 1..24: mol_type = genomic DNA
cttttttttttgagacggagtctc

SEQ ID NO: 91936 - DNA, 155 bp, Homo sapiens
  misc_feature 1..155: note = chr4:182558152-182558307
  misc_feature 1..155: note = hypo
  source 1..155: mol_type = genomic DNA
cacacactgcacattcggtttcctctttctaaaaaggctttcccgctagatacccatatgccttgctctctgccgccttcaggtctccaagtgaaggccaccttcccatgaagaccttctctgaccacactacaagattgcgaagccccttcttc

SEQ ID NO: 91937 - DNA, 30 bp, Homo sapiens
  misc_feature 1..30: note = chr4:1827297-1827327
  misc_feature 1..30: note = hypo
  source 1..30: mol_type = genomic DNA
agctgacccctcaggcggtcttccgtgacg

SEQ ID NO: 91938 - DNA, 30 bp, Homo sapiens
  misc_feature 1..30: note = chr4:182982724-182982754
  misc_feature 1..30: note = hypo
  source 1..30: mol_type = genomic DNA
cctcatatatatttacgtggtaattggcat

SEQ ID NO: 91939 - DNA, 114 bp, Homo sapiens
  misc_feature 1..114: note = chr4:183062432-183062546
  misc_feature 1..114: note = hyper
  source 1..114: mol_type = genomic DNA
cagtttttattgctgcggagggcacgacgtgagctgcccgccatccccgccctctcttgacaacagctcagtgaggtaaaaagcatgatggtcacgtagcgagctgcctctctg

SEQ ID NO: 91940 - DNA, 307 bp, Homo sapiens; identical to SEQ ID NO: 29314
  misc_feature 1..307: note = chr4:183063666-183063973
  misc_feature 1..307: note = hyper
  source 1..307: mol_type = genomic DNA

SEQ ID NO: 91941 - DNA, 1523 bp, Homo sapiens
  misc_feature 1..1523: note = chr4:183063994-183065517
  misc_feature 1..1523: note = hyper
  source 1..1523: mol_type = genomic DNA
cgccccgtcccggacccgaaaggagcctgaaggatcccgccgaccacccagccagagagcggttcggctcaggtcgcccattcggagctacaaaactctggaacctccagcagtttcggaagctccgggggagggctttcctgcagacagggggcgggagctagggagccgggagccagcgctgcggtgggaacttcagtgagtagaaagtggccagtgtcttgggaggagcagcaaactttttttttccctcccacagcaaacaaaatcgaggcagggacagtgtccggccgctaatctgaggggagaatggagaggaaagaagagtagtaaaagtggggagtggagccttcggaggactcccgggtccgcccctggccaggtgatgcggggcggaggcctaggtgcttgaacctggggggcagacaattgttctgctgcagtgcccaccaggggctggtaaggaagtctgagtgtttactgcctcccttccctgtccaaaggtcatttgcgcttttcggtctcggacgaaagaacactgtggaaaggaaggcgcgggtcattttcagaggctctgcaaaggacgggccgcctaccgggggtggaaatccttaattacacccttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacctggcccttctcgccttcctcctccc

SEQ ID NO: 91942 - DNA, 360 bp, Homo sapiens
  misc_feature 1..360: note = chr4:183065946-183066306
  misc_feature 1..360: note = hyper
  source 1..360: mol_type = genomic DNA
atggggtcctagtgccgggccgcggcgccgggagctggcgggcgcgagctgggacggcgcgtggccccgggaggcggcggacgcggggacatcttctcagcgcgcggattctctccacggtccggcctccccgtccccgccccgccctcgcgccagccacctccggccgccggctcaggtgggaacttcgccggcgcctctcgcccggggagccaggcgccgcgcccccgtactggggagccccggggtccctgaggaaggcagtccggaggctgggcgcccagtgggggcggggaggggagcccgccaggtcctcttcggcccccgatgtgtggcgaggccccgcgtcttctgcggggg

SEQ ID NO: 91943 - DNA, 32 bp, Homo sapiens
  misc_feature 1..32: note = chr4:183115488-183115520
  misc_feature 1..32: note = hypo
  source 1..32: mol_type = genomic DNA
atgtgtactgatgcacgcgtgttgccaaacct

SEQ ID NO: 91944 - DNA, 24 bp, Homo sapiens
  misc_feature 1..24: note = chr4:183256665-183256689
  misc_feature 1..24: note = hypo
  source 1..24: mol_type = genomic DNA
aaaaaaagacgaagcatttgccat

SEQ ID NO: 91945 - DNA, 297 bp, Homo sapiens; identical to SEQ ID NO: 29316
  misc_feature 1..297: note = chr4:183369261-183369558
  misc_feature 1..297: note = hyper
  source 1..297: mol_type = genomic DNA

SEQ ID NO: 91946 - DNA, 687 bp, Homo sapiens
  misc_feature 1..687: note = chr4:183369579-183370266
  misc_feature 1..687: note = hyper
  source 1..687: mol_type = genomic DNA
cgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcct

SEQ ID NO: 91947 - DNA, 158 bp, Homo sapiens
  misc_feature 1..158: note = chr4:183370559-183370717
  misc_feature 1..158: note = hyper
  source 1..158: mol_type = genomic DNA
tggtgcaggtagccgcggggagaatggagtcttttgttcccggtatttttaattagatggattttttttttatgagtagtgtactgtcctaatccgtgaggcaaagctgcccttttgcctgcattcggtgacttttacgaattcgttgggagctagtc

SEQ ID NO: 91948 - DNA, 22 bp, Homo sapiens
  misc_feature 1..22: note = chr4:183447416-183447438
  misc_feature 1..22: note = hypo
  source 1..22: mol_type = genomic DNA
gccaccgcgcccagctacattt

SEQ ID NO: 91949 - DNA, 16 bp, Homo sapiens
  misc_feature 1..16: note = chr4:183690642-183690658
  misc_feature 1..16: note = hypo
  source 1..16: mol_type = genomic DNA
agagcagtcctaggcc

SEQ ID NO: 91950 - DNA, 30 bp, Homo sapiens
  misc_feature 1..30: note = chr4:183696298-183696328
  misc_feature 1..30: note = hypo
  source 1..30: mol_type = genomic DNA
agctcagggtacgtacgtgttgtggagcag

SEQ ID NO: 91951 - DNA, 212 bp, Homo sapiens
  misc_feature 1..212: note = chr4:183727706-183727918
  misc_feature 1..212: note = hyper
  source 1..212: mol_type = genomic DNA
agggaaagtcctgcacgccaaaagggcagttcccgggccagaaaccgaggtgaaaccgaagagaaggcgccgccgctcgccgctcgccactctccaccccaaccgcggcggggccggctctctgaccctctcttccccacctctgctctgccctccgagtttcacacttaaagcggagacttctgcttcagcaccgccgcaccgaggcctgg

SEQ ID NO: 91952 - DNA, 30 bp, Homo sapiens; identical to SEQ ID NO: 40371
  misc_feature 1..30: note = chr4:183959079-183959109
  misc_feature 1..30: note = hypo
  source 1..30: mol_type = genomic DNA

SEQ ID NO: 91953 - DNA, 30 bp, Homo sapiens
  misc_feature 1..30: note = chr4:183994250-183994280
  misc_feature 1..30: note = hypo
  source 1..30: mol_type = genomic DNA
tgcacaaacagaactcgagaaagaagaaga

SEQ ID NO: 91954 - DNA, 691 bp, Homo sapiens
  misc_feature 1..691: note = chr4:184019209-184019900
  misc_feature 1..691: note = hyper
  source 1..691: mol_type = genomic DNA
ccagggcctgggaggcgccccctctgactgaggggctggggaccctgaagcttggcgtccaggccccgccagcgctgcacccggcattgtcccgcctggggcaggcgtccggtccctcggcagtgcgggccagcacgtacgtagtagctgctgaataaataaatgcctatgcaacagggaacgtcccggcccaccccggccgggccagggcctaggaagggcgggcgtccggcgccgccgtgggtccctccggcgtggccgcccacacctcctggccacggcggggctgcggtggggggacatcctggggcgggcggctggacggaagggactagagtcggggcgcgtccacggccaaccgccccgaaccaagcaggggaggccagggaccaggagcttccggggccccgcggctggagcgcccggacgcgaaggggcggcgggtgacggggcgcggtgcgggcggctacagggccggacgggagttcctccgctttccgccgcgcggctcgcggtctcagccgaggtcatcgagggccaggagccctggcggaggccccgccgtcccggacccaccgacgcactcccagggcttggcgctttcccaccaccccggaccgcccttggggtgccggaggggctcggggcgcggcgtggggagcctttgtgccctctccgcttgttgaggttt

SEQ ID NO: 91955 - DNA, 1152 bp, Homo sapiens
  misc_feature 1..1152: note = chr4:184020126-184021278
  misc_feature 1..1152: note = hyper
  source 1..1152: mol_type = genomic DNA
ccccgcggggcagtgcgtccgagctggtgcggcgacgccggcagcggcggggttaagctcaggaatgcggcgcgaggaatgcgcatgcagatgaggcgggcgggcgcatgctaatcgcatgcaaatgaggggcccgccgctgccgcggcagcgccgcagcttcccggatccgagcccagacggcggcggctccggcagcctgggcgccgcgaccctcggcggccagagggggacggggcggaggaggaggaagaggcggaggcagcggcggcgagggggaggagggttcgctcgccggctccgacgcagacatggtggactgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggtgggcgccggccgcgggggcgcgggcccgttcggacacggcggctgttgtcccggagacccggccgcgcggggggctggggcggcgccggcccgcggtgccccgaggggtcccgggagggatgtggggctggctgctccggcggggccgaggagccgcccgtacccgggctcctccgcccaccggcttcccgacgcccctccggggacccggccccgaggcaaggctggagtcgctgccccgggccgacgccgcgcgccaggctaacggacccgaggggccacctgagccctgttaggaacttccctaggcttcgaggtgcccacgtggaggctgcaggacaccttcggcctctgggcggcgggggtgggctagggcctcactgccagttggggaacgagccctccgggccacctgtggcatccctcaggccgtccttggcgcgggagcctgggctgcgagctcttggcgggggcgcccagactggccggaggtcccgagct

SEQ ID NO: 91956 - DNA, 42 bp, Homo sapiens
  misc_feature 1..42: note = chr4:184205414-184205456
  misc_feature 1..42: note = hypo
  source 1..42: mol_type = genomic DNA
gacaatatggcagttcgccccaaagagcgcagcagcctgagc

SEQ ID NO: 91957 - DNA, 30 bp, Homo sapiens
  misc_feature 1..30: note = chr4:184278109-184278139
  misc_feature 1..30: note = hypo
  source 1..30: mol_type = genomic DNA
aaggagctgacaagacgtccatgaagcaag

SEQ ID NO: 91958 - DNA, 120 bp, Homo sapiens
  misc_feature 1..120: note = chr4:184375288-184375408
  misc_feature 1..120: note = hypo
  source 1..120: mol_type = genomic DNA
agactggtactggaggcttgcaggttggggaccccctgctctatggtgtagcatgaatttcacctgtgtcaatatagcagagatgagagtgatgacaattttcatccaatgatcctgctg

SEQ ID NO: 91959 - DNA, 18 bp, Homo sapiens
  misc_feature 1..18: note = chr4:184375708-184375726
  misc_feature 1..18: note = hypo
  source 1..18: mol_type = genomic DNA
ggccgatcctgcttcttt

SEQ ID NO: 91960 - DNA, 30 bp, Homo sapiens
  misc_feature 1..30: note = chr4:184532559-184532589
  misc_feature 1..30: note = hypo
  source 1..30: mol_type = genomic DNA
acacacacacacacacgcacacacacacac

SEQ ID NO: 91961 - DNA, 36 bp, Homo sapiens
  misc_feature 1..36: note = chr4:184667629-184667665
  misc_feature 1..36: note = hypo
  source 1..36: mol_type = genomic DNA
gaccaggcagggggccgtgcccgctggggaggcttg

SEQ ID NO: 91962 - DNA, 636 bp, Homo sapiens
  misc_feature 1..636: note = chr4:184718199-184718835
  misc_feature 1..636: note = hyper
  source 1..636: mol_type = genomic DNA
tcattaaccagtcagcgaatccacttgttccagcgagaggtgggaggtgggggcaggggtggagcgtggggaggagcgacactcgccgctccggaatccgtgccttccaagtgtcgccgttgcgtcccccgcaacccccgctttctgatctccctcgaggcccaacacccaaaggctcacccctaggccatccgcgctccccgaccacctccctcataggactccttgggattcctcaggccgcgtccagccgagggggttcccgggcgcggtgcgcactgcccgccccctcactgcctcctcccgcgtctccgcccccgcggggccgctgggcgcccggggaggcgagggtgccgaggccggaaaatgagcgctgcccgaagggtggcccggagctgcaggtaacgcggtccagagctcaggccggagcgggccccgcacaccgtcccttccccgcagcgacccgcgggctgcgcccagggactgcgccgggcgcccgggctgcagggacgcgggcgcgggggaggcgcggccagccctgccctgggggacggtcgcgctccccgctggtcttgcagccacgtcccggcggctgttcctgggagcggcgggaggcggcctcggtgagccaggtcg

SEQ ID NO: 91963 - DNA, 213 bp, Homo sapiens
  misc_feature 1..213: note = chr4:184719200-184719413
  misc_feature 1..213: note = hyper
  source 1..213: mol_type = genomic DNA
ctgcctgggtgagtgcgaccgccgcgcgcccgtcccgtcccttcccaccggatcgcgtccgtgccgtgcggtcgcgggtgccccgccctgccccagcccgccgcgggcaccgccgaggctcccctgggtgcccgcgtccctgccgggggaggagccgggggccctctgcgagcgtgggattggggaacttcctggcaccgaaaggagggagcc

SEQ ID NO: 91964 - DNA, 419 bp, Homo sapiens
  misc_feature 1..419: note = chr4:184826238-184826657
  misc_feature 1..419: note = hyper
  source 1..419: mol_type = genomic DNA
tttgaaaacccaaatcgaggagataaccgtttttgaatgaacggcagtgcaaagcgtggtcggggttagcagcaacgtggctgggcgcctttaactcggcgtgacctccgggtcccaggcccgcgtcccgggcccagcgcccaggcccgggcggcgcattggcccctcctcccctcgcgcgccgcgcgcattgttgtcctttagcgattggttgttggaccagaaacagctgtgcagagccgtgccatctaaagagctgtggacctgaatgcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctcc

SEQ ID NO: 91965 - DNA, 213 bp, Homo sapiens
  misc_feature 1..213: note = chr4:184827078-184827291
  misc_feature 1..213: note = hyper
  source 1..213: mol_type = genomic DNA
gcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatg

SEQ ID NO: 91966 - DNA, 102 bp, Homo sapiens
  misc_feature 1..102: note = chr4:184827557-184827659
  misc_feature 1..102: note = hyper
  source 1..102: mol_type = genomic DNA
tcgggccattgtctgcgctcccattgccttcacgctgcaagtctcggcgcccccaccccgcccgccccctccccgcctcctcccggccggggagcctcctaa

SEQ ID NO: 91967 - DNA, 208 bp, Homo sapiens
  misc_feature 1..208: note = chr4:184921881-184922089
  misc_feature 1..208: note = hypo
  source 1..208: mol_type = genomic DNA
ggtgttatccttcctcgactctcagcacccaggtgttgttctgttctcttgtgtgcctgccacgcagcattgcgaacttcgttcgatctacttgtctgtcttctccacttaaatagaaactgagggcagagatgtttggggagaggcgcgcactctgtctctgcagctcccgttcccccagcagacacgtaaacgcgttcaatgtgtg

SEQ ID NO: 91968 - DNA, 339 bp, Homo sapiens
  misc_feature 1..339: note = chr4:185089642-185089981
  misc_feature 1..339: note = hyper
  source 1..339: mol_type = genomic DNA
gctggaagctttgcacgggggtgaaagttacaggcagacactgcccgcggggctccggacagcaaggagcgagccctctgagcctggccacgctggcccgccactgccctctgctggcggctgcggtcttcaccaccgcccgcagccgtccccgtagtccgccgagaggcgccaggctgggccagccttgaattctgggtttgcttctcccggtttgaaggccacccccaggattcgcaggaatctgacagctgcttgtgactgtgctgaagatgccgagaatgtaggcagagcccgggcagggccggcgggcaggcggccacgcgctgcagcaaacgc

SEQ ID NO: 91969 - DNA, 30 bp, Homo sapiens
  misc_feature 1..30: note = chr4:185592328-185592358
  misc_feature 1..30: note = hypo
  source 1..30: mol_type = genomic DNA
gtgcagtaaatgtatcgaattgcttttgtt

SEQ ID NO: 91970 - DNA, 30 bp, Homo sapiens; identical to SEQ ID NO: 40375
  misc_feature 1..30: note = chr4:185833058-185833088
  misc_feature 1..30: note = hypo
  source 1..30: mol_type = genomic DNA

SEQ ID NO: 91971 - DNA, 30 bp, Homo sapiens; identical to SEQ ID NO: 40376
  misc_feature 1..30: note = chr4:185913935-185913965
  misc_feature 1..30: note = hypo
  source 1..30: mol_type = genomic DNA

SEQ ID NO: 91972 - DNA, 30 bp, Homo sapiens
  misc_feature 1..30: note = chr4:185931321-185931351
  misc_feature 1..30: note = hypo
  source 1..30: mol_type = genomic DNA
tggccagcatgagcacgacatgttcaaaag

SEQ ID NO: 91973 - DNA, 711 bp, Homo sapiens
  misc_feature 1..711: note = chr4:185937273-185937984
  misc_feature 1..711: note = hyper
  source 1..711: mol_type = genomic DNA
ttccctatcctgaagcggagggcgttccaggtttcgcaggtagtgctgcagccgcgcaaggaccgggcgaggctgcgcccctgagcccaagtctccactcaccggccttcccttgccccctcacctgcacgcgggtacttttagccctgggcaagccttgagccaagcgccgagaccaaacccgggaaattaaacagtgtgcatggaatgaaatgtggtccgtggaaggtgcctgcagctggcggttaacaccggcagtaagaggatcaacgcccgggccgctggcttaaaaatgggagtgggagtgcgaagtgtgcgcgctcctttttacccattcacgttagttaatttggatgataagggttcgcgtttaatctctttgtgtgcgagtgaatatcctgaaatcgacaacccctgagagggcactcgcggctggcagagcaacctgggagggtgcggatcgtgtccaatctggcgtgaagcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctcccaggtcccaccagctagaagagcgccgcctacccacccctgccaaggtctaacgaccccaagggggg

SEQ ID NO: 91974 - DNA, 717 bp, Homo sapiens
  misc_feature 1..717: note = chr4:185938230-185938947
  misc_feature 1..717: note = hyper
  source 1..717: mol_type = genomic DNA
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggcgcattactcagagccctctaagcgcgattgtttctccctttctaatgacatttaccggatcaaaacatgctgttaattcgatcagaaggcttcaccctccctgacaaagccacaataatttctcctgaagtttgttaaattgaccaaaattaggcaaatgaataggggtctgtaggcgccccctctcgcaggtgacgttgc

SEQ ID NO: 91975 - DNA, 66 bp, Homo sapiens
  misc_feature 1..66: note = chr4:185939377-185939443
  misc_feature 1..66: note = hyper
  source 1..66: mol_type = genomic DNA
gacgtgtcaccaagtcgtgtgagaaaagcctgggaacaaacggggcgcctccgtctccaagagctc

SEQ ID NO: 91976 - DNA, 2800 bp, Homo sapiens
  misc_feature 1..2800: note = chr4:185939673-185942473
  misc_feature 1..2800: note = hyper
  source 1..2800: mol_type = genomic DNA
ctgcaggcgcttgctcgcccgccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtggtttgggaagggggtggggtagagagaggagggtgctcaaccaggtagaagtcctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcggcttgcacccagctgctagagccgcgcctttgacgacttcccgggcaaagccatcctaaacatacaaccctctcttcgcagagaacccccgtttctcataaagtgatagaaaagcggaggagggacaggatcaaccgctgcttgaacgagctgggcaagacagtgcccatggccttggcgaagcaggtaacgttggcgacccggagccgggtgccaggcgttgggaggcctctgcggccactctgcggagacgcccgagcccgcggacacagaggacctcacttgcgggcccctcccaggcggggggcctgagcgcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaaggtgggcacaggttagggaatgggacgcctgggccaggcgcctgcgccacccagagaccctggggctgggaggggagtgactgagtgttcccgagagctctactagagctccactctccaggagggcaggggtcctgcgaaggcgcctctccctgctcggcgacagcaaggcggcgagggagaactggttcccagggaggctggttccacctccttctcccgggtggggtgggtggggtcaggctctcagggaaagagggcgtttgcgcgtgcctcgccagtctctaagactgcgcagaggagagggcgggcctcaaatgggaactttggccagaaaatgtggtgggaggtgccctgcacccgctttgggctcgcgtggggaaggggcactcagggtgtgtccgtcctacgggctttctcgttcctccagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggttcaggcagatattctaggcatcgcttaagggcgggattcgcggcttcctgcacccgccccatcttgagcattagcctcagagaaacaggggaggcgaagaacactgcccttggctctcaggaaaatgcaaattgaaggacctgccccaaactgacttaggcggaccgttgccagctgcgacccgggcgcccgtcctacccggagccaagtgcc

SEQ ID NO: 91977 - DNA, 443 bp, Homo sapiens; identical to SEQ ID NO: 7656
  misc_feature 1..443: note = chr4:185942491-185942934
  misc_feature 1..443: note = hyper
  source 1..443: mol_type = genomic DNA

SEQ ID NO: 91978 - DNA, 30 bp, Homo sapiens
  misc_feature 1..30: note = chr4:185964663-185964693
  misc_feature 1..30: note = hypo
  source 1..30: mol_type = genomic DNA
gtgtgtggttgcccacgctggcaccacacc

SEQ ID NO: 91979 - DNA, 277 bp, Homo sapiens
  misc_feature 1..277: note = chr4:186048714-186048991
  misc_feature 1..277: note = hyper
  source 1..277: mol_type = genomic DNA
gggctcggtgcagtccggagcccagaccaggcagttgctgagttatgtccgggcgagatcggtgtccttcagggtgggaggctcagaaacccagcgcgcgagcctctgggcagtggtaagggcgggttgggagtcgggttcggcgagtccaaaggaggctcccgggctgcagaggccccggcaggctgtctccgccccacgagccccttctcctgcggtctcctggactgcggcgacgaagcgtcggggctggggctccagtcgcctggggatgcgc

SEQ ID NO: 91980 - DNA, 572 bp, Homo sapiens
  misc_feature 1..572: note = chr4:186049493-186050065
  misc_feature 1..572: note = hyper
  source 1..572: mol_type = genomic DNA
ccaggcgtgagccccgcgccctccccttgcggagattcggcctggaaagctccgcggctctggccggcaccggtttccttcccgcctccccgcactcccacccccgctcctagttcagagcgctggtggcgttacccacagccgcggaatcccctttactgttcccggaggagctgcgaggtggaactggccgcgcggtgggggctttccccggccccgggacgagcactcagcgtcccctccccgcgacgctccctcggaatcccggggaagagcgcagcagaggcggggaggaggcgcgagcggaggggaccgacttccaccgcacctgggtgtcgccagccccgcctggccctcggcgccgggaccccgacgcaccccgcgcatagcgactggtggcctggtgggggactgcgcctgcgaggccttcttcgcgcagagatatcggggttctctgaaccccagaaatgggcctggcaggggaaggaagctgcaagaaaggagttaatctgcaggatgctcaattctttctatgacaaatcgcttcactccccgctcggcaggtcagagct

SEQ ID NO: 91981 - DNA, 99 bp, Homo sapiens
  misc_feature 1..99: note = chr4:186347807-186347906
  misc_feature 1..99: note = hypo
  source 1..99: mol_type = genomic DNA
ccagcaagcttgccccgaaggggattgcagaatatctgttaaataagtgaatgaataattttgtaaatgttgctcaataagagttaagtagtggcgggc

SEQ ID NO: 91982 - DNA, 161 bp, Homo sapiens; identical to SEQ ID NO: 40377
  misc_feature 1..161: note = chr4:186348467-186348628
  misc_feature 1..161: note = hypo
  source 1..161: mol_type = genomic DNA

SEQ ID NO: 91983 - DNA, 66 bp, Homo sapiens; identical to SEQ ID NO: 28699
  misc_feature 1..66: note = chr4:1864167-1864233
  misc_feature 1..66: note = hyper
  source 1..66: mol_type = genomic DNA

SEQ ID NO: 91984 - DNA, 264 bp, Homo sapiens
  misc_feature 1..264: note = chr4:1864268-1864532
  misc_feature 1..264: note = hyper
  source 1..264: mol_type = genomic DNA
cgcggcacccaggcctcgctgtcttccctttcccttcgagggacctcgcgctgcaaaatccgaagagcccggctggggcggggtcgcggggtgcgcgggaaccggggcctgggacggggcggggcctagccagggcctccacggaagcgaggccaggactggggagtggggggtgggggggtcgtggctgagtgggtgccctgagggcggtcaaggaccccgcgggcctcttctcctgcctggacactgcgcttgcctggctat

SEQ ID NO: 91985 - DNA, 214 bp, Homo sapiens; identical to SEQ ID NO: 29342
  misc_feature 1..214: note = chr4:186456012-186456226
  misc_feature 1..214: note = hyper
  source 1..214: mol_type = genomic DNA

SEQ ID NO: 91986 - DNA, 198 bp, Homo sapiens
  misc_feature 1..198: note = chr4:186456727-186456925
  misc_feature 1..198: note = hyper
  source 1..198: mol_type = genomic DNA
cgccccctcccaccccggagagctccaactttggaagcgagagccgcgccagccccgcgggagtgcgcagcccggccggctggggcagcctcccgggccgcggcgggcgcgggggcttcgggttacagcgtccgtcgctctcttgaagtcacacctgtctccctgtttatcttctgcttggagcgcagcagtgcactt

SEQ ID NO: 91987 - DNA, 218 bp, Homo sapiens
  misc_feature 1..218: note = chr4:187026668-187026886
  misc_feature 1..218: note = hyper
  source 1..218: mol_type = genomic DNA
cctggccccggagagcgagagctcggcgcctgcgtggcccccggggctggccccagaaccctgttccttacgctgcctgacatcggcgaggagggggcctcggacggcgactccggggatggcgaagcgtgagtagcagcgtggtccgggcgcgtgtaccttttgccgggacccccgacccctccgcctgccgcactcaccttcgcaggtgcacttca

SEQ ID NO: 91988 - DNA, 30 bp, Homo sapiens
  misc_feature 1..30: note = chr4:187182190-187182220
  misc_feature 1..30: note = hypo
  source 1..30: mol_type = genomic DNA
tggcggcagtgtacacgtggcatgcaagca

SEQ ID NO: 91989 - DNA, 184 bp, Homo sapiens
  misc_feature 1..184: note = chr4:187459279-187459463
  misc_feature 1..184: note = hypo
  source 1..184: mol_type = genomic DNA
tgcttttctgtttatcgcgattatgtctctacttctccccatctcccacagccccagctatcacctcggtgaggacactgcctgtcttagatatcttctccctccaccttgaacagtacctggccgagggttaatcgatgcacagtgggtttatattgtgtcaacttcgcgaagctgaaaagac

SEQ ID NO: 91990 - DNA, 30 bp, Homo sapiens
  misc_feature 1..30: note = chr4:187647639-187647669
  misc_feature 1..30: note = hyper
  source 1..30: mol_type = genomic DNA
taaccagagtgccaacgtccgtgccgccgg

SEQ ID NO: 91991 - DNA, 57 bp, Homo sapiens
  misc_feature 1..57: note = chr4:187648062-187648119
  misc_feature 1..57: note = hyper
  source 1..57: mol_type = genomic DNA
ctcctccttcggctgcgtctcccgggcgccggcgagcgcgggcgttcctcgcactca

SEQ ID NO: 91992 - DNA, 16 bp, Homo sapiens
  misc_feature 1..16: note = chr4:188916865-188916881
  misc_feature 1..16: note = hyper
  source 1..16: mol_type = genomic DNA
gcgtcagtccggaggg

SEQ ID NO: 91993 - DNA, 18 bp, Homo sapiens
  misc_feature 1..18: note = chr4:189257706-189257724
  misc_feature 1..18: note = hypo
  source 1..18: mol_type = genomic DNA
gcccggccccccaactcc

SEQ ID NO: 91994 - DNA, 160 bp, Homo sapiens
  misc_feature 1..160: note = chr4:190474936-190475096
  misc_feature 1..160: note = hypo
  source 1..160: mol_type = genomic DNA
gaaagtgaagaaatgcgaggccagctccagccgcagcgcacctgtccacgagtctggccgcagcgcacctgtccccgagtccggccgcagcgcacctgtccacaagtgtccacctctaaggcagtgttcttcaacacgcaccacgcgcatcctcagctgg

SEQ ID NO: 91995 - DNA, 30 bp, Homo sapiens
  misc_feature 1..30: note = chr4:190529509-190529539
  misc_feature 1..30: note = hypo
  source 1..30: mol_type = genomic DNA
ggattcgggagtgagcgcatacttcattct

SEQ ID NO: 91996 - DNA, 30 bp, Homo sapiens
  misc_feature 1..30: note = chr4:190536670-190536700
  misc_feature 1..30: note = hypo
  source 1..30: mol_type = genomic DNA
ggcctgcctagcctacgcccacccgcaact

SEQ ID NO: 91997 - DNA, 30 bp, Homo sapiens
  misc_feature 1..30: note = chr4:190662219-190662249
  misc_feature 1..30: note = hypo
  source 1..30: mol_type = genomic DNA
accccggcacccccacgctgcactccacac

SEQ ID NO: 91998 - DNA, 30 bp, Homo sapiens
  misc_feature 1..30: note = chr4:190763878-190763908
  misc_feature 1..30: note = hypo
  source 1..30: mol_type = genomic DNA
gaacacaccttgtcacgacattgagattca

SEQ ID NO: 91999 - DNA, 30 bp, Homo sapiens
  misc_feature 1..30: note = chr4:1958502-1958532
  misc_feature 1..30: note = hypo
  source 1..30: mol_type = genomic DNA
tgtgtgcatgtggctcgttcagggagaagc

SEQ ID NO: 92000 - DNA, 291 bp, Homo sapiens
  misc_feature 1..291: note = chr4:1960087-1960378
  misc_feature 1..291: note = hypo
  source 1..291: mol_type = genomic DNA
ggagtcagtcacatacggccagggctcagtgactgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgct

SEQ ID NO: 92001 - DNA, 30 bp, Homo sapiens
  misc_feature 1..30: note = chr4:1960796-1960826
  misc_feature 1..30: note = hypo
  source 1..30: mol_type = genomic DNA
gtcagagagatgggtcgggaagctgctcag

SEQ ID NO: 92002 - DNA, 80 bp, Homo sapiens
  misc_feature 1..80: note = chr4:1961324-1961404
  misc_feature 1..80: note = hypo
  source 1..80: mol_type = genomic DNA
tgtttgagtgccacccgcaggtgtgtcccgcgggcgagttctgccagaaccagtgcttcaccaagcgccagtacccagag

SEQ ID NO: 92003 - DNA, 187 bp, Homo sapiens
  misc_feature 1..187: note = chr4:1976939-1977126
  misc_feature 1..187: note = hypo
  source 1..187: mol_type = genomic DNA
tgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctccaattgcagtggattcctcggggatagaccaaa

SEQ ID NO: 92004 - DNA, 100 bp, Homo sapiens
  misc_feature 1..100: note = chr4:1977425-1977525
  misc_feature 1..100: note = hypo
  source 1..100: mol_type = genomic DNA
cccaggcctgtctcccgttcctggtggcggccacagtccttgctgctccttggcttgtagcagcaccgcccaaccattctccctgcgaacatgactgttg

SEQ ID NO: 92005 - DNA, 620 bp, Homo sapiens; identical to SEQ ID NO: 40207
  misc_feature 1..620: note = chr4:1993715-1994335
  misc_feature 1..620: note = hypo
  source 1..620: mol_type = genomic DNA

SEQ ID NO: 92006 - DNA, 85 bp, Homo sapiens
  misc_feature 1..85: note = chr4:1994745-1994830
  misc_feature 1..85: note = hypo
  source 1..85: mol_type = genomic DNA
cgtggctgcaggaagcgctgcgcacacgctgcctctggcagccgcacagcccggctgtttccagccagtgcggcctctccacagc

SEQ ID NO: 92007 - DNA, 98 bp, Homo sapiens
  misc_feature 1..98: note = chr4:1999785-1999883
  misc_feature 1..98: note = hypo
  source 1..98: mol_type = genomic DNA
ggcaaggaaaacaaacgagcagaaaacgacaacagcatcaacaacaacaacaacaaccacaacaaaagcccccatccaagggtcagcagcctcaaaga

SEQ ID NO: 92008 - DNA, 30 bp, Homo sapiens; identical to SEQ ID NO: 40209
  misc_feature 1..30: note = chr4:2009272-2009302
  misc_feature 1..30: note = hypo
  source 1..30: mol_type = genomic DNA

SEQ ID NO: 92009 - DNA, 466 bp, Homo sapiens
  misc_feature 1..466: note = chr4:20253509-20253975
  misc_feature 1..466: note = hyper
  source 1..466: mol_type = genomic DNA
gcgccggctcaacttcggacttggtgttatttatttgggaagcgcccggacggcggagcttggcggcggcggtggtggtggctgccgcagactgtggttaaaaaaaagaaggcggcggcggcggcggcggcggaggcggaggcagctgcgaggcatgggagcgccgaagcgcccaggcgcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcgccctccctctccc

SEQ ID NO: 92010 - DNA, 84 bp, Homo sapiens; identical to SEQ ID NO: 28836
  misc_feature 1..84: note = chr4:20254239-20254323
  misc_feature 1..84: note = hyper
  source 1..84: mol_type = genomic DNA

SEQ ID NO: 92011 - DNA, 81 bp, Homo sapiens
  misc_feature 1..81: note = chr4:20254693-20254774
  misc_feature 1..81: note = hyper
  source 1..81: mol_type = genomic DNA
ccagacatccttcagcgaagtgcatgtgtgtttgtaaaccatcgttggctgtcgggagaccgcgaggaccggtccaggctg

SEQ ID NO: 92012 - DNA, 94 bp, Homo sapiens
  misc_feature 1..94: note = chr4:20255026-20255120
  misc_feature 1..94: note = hyper
  source 1..94: mol_type = genomic DNA
cgtgggatcagaggaccgccctccccacaacaaccggcccctgcatcttagcagccgttggaagccccagctcttttaccgccaagttcatcct

SEQ ID NO: 92013 - DNA, 41 bp, Homo sapiens
  misc_feature 1..41: note = chr4:20255327-20255368
  misc_feature 1..41: note = hyper
  source 1..41: mol_type = genomic DNA
ctgggttgctagccccgccgggcactgggcctcagacactg

SEQ ID NO: 92014 - DNA, 762 bp, Homo sapiens; identical to SEQ ID NO: 28840
  misc_feature 1..762: note = chr4:20255524-20256286
  misc_feature 1..762: note = hyper
  source 1..762: mol_type = genomic DNA

SEQ ID NO: 92015 - DNA, 195 bp, Homo sapiens
  misc_feature 1..195: note = chr4:20256382-20256577
  misc_feature 1..195: note = hyper
  source 1..195: mol_type = genomic DNA
cgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacc

SEQ ID NO: 92016 - DNA, 89 bp, Homo sapiens
  misc_feature 1..89: note = chr4:20256841-20256930
  misc_feature 1..89: note = hyper
  source 1..89: mol_type = genomic DNA
gctctgacccgcacgtctccacccgcgcagcccattgcacttcaagtcgcccttcttatccaacccatttctctcgcccttagttttaa

SEQ ID NO: 92017 - DNA, 30 bp, Homo sapiens
  misc_feature 1..30: note = chr4:2038336-2038366
  misc_feature 1..30: note = hypo
  source 1..30: mol_type = genomic DNA
acaacatgttcagggcggccctcgaggaca

SEQ ID NO: 92018 - skipped

SEQ ID NO: 92019 - DNA, 91 bp, Homo sapiens; identical to SEQ ID NO: 28702
  misc_feature 1..91: note = chr4:2042168-2042259
  misc_feature 1..91: note = hyper
  source 1..91: mol_type = genomic DNA

SEQ ID NO: 92020 - DNA, 76 bp, Homo sapiens
  misc_feature 1..76: note = chr4:2042655-2042731
  misc_feature 1..76: note = hyper
  source 1..76: mol_type = genomic DNA
gcagtcccagcttgtgccgggaagaccaccggccagaaccccgggggttgggggtagaggtcggctaggctgggga

SEQ ID NO: 92021 - DNA, 105 bp, Homo sapiens
  misc_feature 1..105: note = chr4:2043082-2043187
  misc_feature 1..105: note = hyper
  source 1..105: mol_type = genomic DNA
tcacgggactgaaatcggcacagagaggccgaggacctgtggtcggggctccgcgcaagcggttctccggtctccgaggacaccgagaggcggagaggaggaccc

SEQ ID NO: 92022 - DNA, 30 bp, Homo sapiens
  misc_feature 1..30: note = chr4:2043417-2043447
  misc_feature 1..30: note = hyper
  source 1..30: mol_type = genomic DNA
cagctccctcaggatcgctcctgacctgct

SEQ ID NO: 92023 - DNA, 182 bp, Homo sapiens
  misc_feature 1..182: note = chr4:2048726-2048908
  misc_feature 1..182: note = hyper
  source 1..182: mol_type = genomic DNA
cctcggcccgccccccgccccgtctcacccgcagctccgttccaccccgccctgctccctcccaccgtggccagacccgcgccgtcctggggttcccctgggctgctcggcggctccccgcgcccctgttcttcctccccacggactcgggctcggggcgttcgcggcgggataggagcgcc

SEQ ID NO: 92024 - DNA, 171 bp, Homo sapiens
  misc_feature 1..171: note = chr4:2059984-2060155
  misc_feature 1..171: note = hyper
  source 1..171: mol_type = genomic DNA
gtggaccagttcagccgcccctccccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccc

SEQ ID NO: 92025 - DNA, 369 bp, Homo sapiens
  misc_feature 1..369: note = chr4:2060173-2060542
  misc_feature 1..369: note = hyper
  source 1..369: mol_type = genomic DNA
cggggaagctctgctccggcagccctcggggtggtgctgggaggtcgcgcagaactgaagggggctaggttcgagaagcgccgaggatggggtctgcgaccgcctccccgcacctgagcttctccgccccagcctgcggcgtctgcaggtcctacaaggcgcagagcccccgctgcacctgcaccgaggccacggggcgcatgcgcggccgcggggggcgggggccgggccgggaggggtcctgcgggccccgcatccccgtgcccactgcggggctcggacaggggggcgccgcgccaggccgcagaccccgcccttccgcgtccccactccggctgcccgtgcggctccggacgaggcttcccgggg

SEQ ID NO: 92026 - DNA, 672 bp, Homo sapiens
  misc_feature 1..672: note = chr4:2061476-2062148
  misc_feature 1..672: note = hyper
  source 1..672: mol_type = genomic DNA
tccgcgagttccgtgcggccgagcaggaggcggcgcgccgcatcttctacgacggcatcatggagcgcatccctaacacggccttccgcggcctgcggcagcacccgcgcgcgcagctgctctacgccctgctggcgggtcagtgcgccgggcccccggctgccgcagtccctcgggccggcgcggagctcccccgccccggcgtccacgcggaccccgcgcccggctcccggggaccagcctgggaagccccccgctttctgccgcgccgggccccgcgcagggctggctatgggcgtggggatgggcgcagggccccgagcgggccggagccggggagggtccggggtccgcacctgcgtccccgccgcgcagccccccacccccaccgcctcccctgtcccctcccgggcatcctgggtgggggcgggtgccagggcaggtagcgcccgccgcggctgggccccggcgagtgcctaaatataatctgcgggcgggggaggccgcctcccgctcggtgctaatttatgaggggaagacagccggcgccgcggggggtgcgcgcgcctggcacagccggggcggtcgcagagggcggccccttcagcgtctttgggtgcccttcccctcagagcttcctgccggggtgagggggttcgctcccattttaca

SEQ ID NO: 92027 - DNA, 712 bp, Homo sapiens
  misc_feature 1..712: note = chr4:2065587-2066299
  misc_feature 1..712: note = hypo
  source 1..712: mol_type = genomic DNA
gtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccg

SEQ ID NO: 92028 - DNA, 91 bp, Homo sapiens
  misc_feature 1..91: note = chr4:2129361-2129452
  misc_feature 1..91: note = hypo
  source 1..91: mol_type = genomic DNA
ctgcccaacaaaacccgagcccatctgcctctggaattctctgtgagtgtaagccactcaggcaggatctttcacccgcagctcaagaagc

SEQ ID NO: 92029 - DNA, 209 bp, Homo sapiens
  misc_feature 1..209: note = chr4:21305986-21306195
  misc_feature 1..209: note = hyper
  source 1..209: mol_type = genomic DNA
cgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggag

SEQ ID NO: 92030 - DNA, 278 bp, Homo sapiens
  misc_feature 1..278: note = chr4:21949877-21950155
  misc_feature 1..278: note = hyper
  source 1..278: mol_type = genomic DNA
atgcataaacaacctcggaaattttcagagaaggcaaaagtacgcacaggatcgcaggggaccctgccaccggcgagtttcaaacacacttcaaacatcttttcttccccgacctggatcttgcatgcacccccctctcctttgcaccccattcctgccgctcccacctccccttcccagtcccgccaggtgactgtgtctcatgcagcgaaggcaacaagcgtccccagccgaggaagggaaggggcagccgtcttggctcgcgagggaaggagggc

SEQ ID NO: 92031 - DNA, 140 bp, Homo sapiens; identical to SEQ ID NO: 28844
  misc_feature 1..140: note = chr4:21950156-21950296
  misc_feature 1..140: note = hyper
  source 1..140: mol_type = genomic DNA

SEQ ID NO: 92032 - DNA, 157 bp, Homo sapiens
  misc_feature 1..157: note = chr4:21950721-21950878
  misc_feature 1..157: note = hyper
  source 1..157: mol_type = genomic DNA
cgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggct

SEQ ID NO: 92033 - DNA, 30 bp, Homo sapiens
  misc_feature 1..30: note = chr4:2251665-2251695
  misc_feature 1..30: note = hypo
  source 1..30: mol_type = genomic DNA
tggcctgcctggccccgagagcccagccct

SEQ ID NO: 92034 - DNA, 30 bp, Homo sapiens
  misc_feature 1..30: note = chr4:22516841-22516871
  misc_feature 1..30: note = hyper
  source 1..30: mol_type = genomic DNA
ttacttgcatcctcacgtggcaccgcgcag

SEQ ID NO: 92035 - DNA, 30 bp, Homo sapiens
  misc_feature 1..30: note = chr4:22622408-22622438
  misc_feature 1..30: note = hypo
  source 1..30: mol_type = genomic DNA
aataagtaatagacacgataggtaagtaaa

SEQ ID NO: 92036 - DNA, 141 bp, Homo sapiens; identical to SEQ ID NO: 40213
  misc_feature 1..141: note = chr4:2278785-2278926
  misc_feature 1..141: note = hypo
  source 1..141: mol_type = genomic DNA

SEQ ID NO: 92037 - DNA, 332 bp, Homo sapiens
  misc_feature 1..332: note = chr4:2288990-2289322
  misc_feature 1..332: note = hypo
  source 1..332: mol_type = genomic DNA
agagcatctctcacccgctgggcgaccctgggcaggttatgtggtccagagctttgctgcctgagccacagacacggacagtaagatagccactgacgggtcagacaagtgagatcctctcagcggcgtgggtgcagtgcagatgcagcaagggcctcgggcctcacgtgcagcagccgtaggatgggctgaacgaatcctggcttaagcccctgaagggcctctgagtttgcagtcactgtttcaacatccagggaaagtgctttgcgaggaggcgttgatttgctgtattccttccacaaatcttcctttctctgcggtgactgacgtgg

SEQ ID NO: 92038 - DNA, 30 bp, Homo sapiens
  misc_feature 1..30: note = chr4:2290228-2290258
  misc_feature 1..30: note = hypo
  source 1..30: mol_type = genomic DNA
gaggggacctgggcacgtggctgctgctcc

SEQ ID NO: 92039 - DNA, 333 bp, Homo sapiens; identical to SEQ ID NO: 40214
  misc_feature 1..333: note = chr4:2305585-2305918
  misc_feature 1..333: note = hypo
  source 1..333: mol_type = genomic DNA

SEQ ID NO: 92040 - DNA, 107 bp, Homo sapiens; identical to SEQ ID NO: 28710
  misc_feature 1..107: note = chr4:2418673-2418780
  misc_feature 1..107: note = hyper
  source 1..107: mol_type = genomic DNA

SEQ ID NO: 92041 - DNA, 44 bp, Homo sapiens
  misc_feature 1..44: note = chr4:2418988-2419032
  misc_feature 1..44: note = hyper
  source 1..44: mol_type = genomic DNA
ccagggtgccaccctcggacgcccagatgcgccctggaccctgc

SEQ ID NO: 92042 - DNA, 146 bp, Homo sapiens
  misc_feature 1..146: note = chr4:24471691-24471837
  misc_feature 1..146: note = hyper
  source 1..146: mol_type = genomic DNA
tgagtttcacggccccggggtgcaggtcggaggcacgcgcctggaaacttgtcctaacgcctctgactccaggactggggggcgcggcgctgccgaggatgcccgaatgccggccgggcttgtaccgggtgcgtggttcaagcctt

SEQ ID NO: 92043 - DNA, 209 bp, Homo sapiens
  misc_feature 1..209: note = chr4:24472371-24472580
  misc_feature 1..209: note = hyper
  source 1..209: mol_type = genomic DNA
ctcgccgccgcctcccgctgctgctgccgcggcggcgggagcctctccaaggctccgggcggcccttatgtattattcactcggatggccgcagcgctttctggagagcccacgccggagaggtcttcacctggcagctagtagtttggcgatttgtttcttggaaacttggggtgatgcggaggcggcggcggcgaacatttttcggt

SEQ ID NO: 92044 - DNA, 407 bp, Homo sapiens
  misc_feature 1..407: note = chr4:24473331-24473738
  misc_feature 1..407: note = hyper
  source 1..407: mol_type = genomic DNA
agggcacgatgcagccggactgcattgcacagtcatcaaagttaagtgtgtttgtggggtgcttctgtgccccaggggaggcgcggggtcaggaggagcggaggctccactctgcaccccaccccccccacctccgcgggtcaggggacgcctctacttgagattgcagccattttagggaaagaggcggctcgggccccgaggggagtggaggggggacagcacgtcgcggggggcttgcggctctgcagcccctcggcgcaactggaaggcgggtaggcgccgggcgcacaggggcgcggcgcccgcggcgacttggggaaggttgcgctcgagttccctggttctgcctggagttgttcggggtaacgcgccggctcctgcctctttctcgggttcccgctggg

SEQ ID NO: 92045 - DNA, 30 bp, Homo sapiens; identical to SEQ ID NO: 40275
  misc_feature 1..30: note = chr4:24535112-24535142
  misc_feature 1..30: note = hypo
  source 1..30: mol_type = genomic DNA

SEQ ID NO: 92046 - DNA, 148 bp, Homo sapiens
  misc_feature 1..148: note = chr4:2459751-2459899
  misc_feature 1..148: note = hypo
  source 1..148: mol_type = genomic DNA
gcctccctgattccacgttcccaaagagccaggaggcaccgccgccctcttctgcactcccggcctgaggcgcccagccgtctccctgtgccatggtctgacgctgtggctgcgcggggagggccggtgtggacgcctcttttctctc

SEQ ID NO: 92047 - DNA, 30 bp, Homo sapiens
  misc_feature 1..30: note = chr4:2460473-2460503
  misc_feature 1..30: note = hypo
  source 1..30: mol_type = genomic DNA
gcagagagacggctccgggaggacaggtcc

SEQ ID NO: 92048 - DNA, 138 bp, Homo sapiens
  misc_feature 1..138: note = chr4:24801867-24802005
  misc_feature 1..138: note = hyper
  source 1..138: mol_type = genomic DNA
cgcggcccccacccggcggcggccagggacccccgaggcccccctctgcctttgagcttctcctctgctccaacagacaccctccactctgaggtctcaccttcgcctttgctgaagtctccccgcagccctctccac

SEQ ID NO: 92049 - DNA, 398 bp, Homo sapiens
  misc_feature 1..398: note = chr4:24914406-24914804
  misc_feature 1..398: note = hyper
  source 1..398: mol_type = genomic DNA
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgccagcgctgttgactccacgtcagcctccgccggagggaaagggaggaggggcgcggccgccggggccgcagacacagcccgggccgcagccgagccccgccgggcccgccccgcgccctcagccccgcgacctcgggctccgcgcctcctgcccggcctctaggcaag

SEQ ID NO: 92050 - DNA, 50 bp, Homo sapiens
  misc_feature 1..50: note = chr4:24967393-24967443
  misc_feature 1..50: note = hypo
  source 1..50: mol_type = genomic DNA
ctccctgaaaagctgcgctctagtcaggagtaggccgaagcggccttctg

SEQ ID NO: 92051 - DNA, 89 bp, Homo sapiens
  misc_feature 1..89: note = chr4:25013961-25014050
  misc_feature 1..89: note = hypo
  source 1..89: mol_type = genomic DNA
atgttgtcatagctccggaaattcatttcaatgtggtcccactccagcaccatgcagttctccatgctgggctgcgcgatggccacgta

SEQ ID NO: 92052 - DNA, 59 bp, Homo sapiens
  misc_feature 1..59: note = chr4:25032044-25032103
  misc_feature 1..59: note = hyper
  source 1..59: mol_type = genomic DNA
cagaggcaactccctcgcggcggcggacgcagggtggggcgggacgggatgggggctgg

SEQ ID NO: 92053 - DNA, 38 bp, Homo sapiens
  misc_feature 1..38: note = chr4:25090356-25090394
  misc_feature 1..38: note = hyper
  source 1..38: mol_type = genomic DNA
tccccgctcaggaaccgcagatgcgcccaaatgttcca

SEQ ID NO: 92054 - DNA, 69 bp, Homo sapiens
  misc_feature 1..69: note = chr4:25098014-25098083
  misc_feature 1..69: note = hypo
  source 1..69: mol_type = genomic DNA
tgccactgcctccaacggcctgccctggccaactcccccaggggcgatgttgcccgtcccaggcaagag

SEQ ID NO: 92055 - DNA, 30 bp, Homo sapiens
  misc_feature 1..30: note = chr4:2514698-2514728
  misc_feature 1..30: note = hypo
  source 1..30: mol_type = genomic DNA
tcaggaggccagggacgggactcttgtagg

SEQ ID NO: 92056 - DNA, 21 bp, Homo sapiens
  misc_feature 1..21: note = chr4:2526051-2526072
  misc_feature 1..21: note = hypo
  source 1..21: mol_type = genomic DNA
agacttcgtctcaaaaaaaaa

SEQ ID NO: 92057 - DNA, 35 bp, Homo sapiens; identical to SEQ ID NO: 14672
  misc_feature 1..35: note = chr4:2527902-2527937
  misc_feature 1..35: note = hypo
  source 1..35: mol_type = genomic DNA

SEQ ID NO: 92058 - DNA, 35 bp, Homo sapiens
  misc_feature 1..35: note = chr4:25377692-25377727
  misc_feature 1..35: note = hypo
  source 1..35: mol_type = genomic DNA
tttatattttagagacggagtctggctctgttgcc

SEQ ID NO: 92059 - DNA, 92 bp, Homo sapiens
  misc_feature 1..92: note = chr4:2540246-2540338
  misc_feature 1..92: note = hypo
  source 1..92: mol_type = genomic DNA
tagggtcttgggctgtagtcctggacttcagtctcccgagattgccctcatccagtatcctggagatcaaaacaggccgcagttcttgggat

SEQ ID NO: 92060 - DNA, 128 bp, Homo sapiens
  misc_feature 1..128: note = chr4:25656679-25656807
  misc_feature 1..128: note = hyper
  source 1..128: mol_type = genomic DNA
ctgcccagcagtgcccggcacagaactggggagctgttgggataagcatgggggtggactctccctgggacagatcctatctcacagcagtttggagaactgttgtatacacacgcaggtgacacgag

SEQ ID NO: 92061 - DNA, 235 bp, Homo sapiens; identical to SEQ ID NO: 28849
  misc_feature 1..235: note = chr4:25657130-25657365
  misc_feature 1..235: note = hyper
  source 1..235: mol_type = genomic DNA

SEQ ID NO: 92062 - DNA, 48 bp, Homo sapiens; identical to SEQ ID NO: 28850
  misc_feature 1..48: note = chr4:25657366-25657414
  misc_feature 1..48: note = hyper
  source 1..48: mol_type = genomic DNA

SEQ ID NO: 92063 - DNA, 78 bp, Homo sapiens
  misc_feature 1..78: note = chr4:25657415-25657493
  misc_feature 1..78: note = hyper
  source 1..78: mol_type = genomic DNA
gccagcctctttgcgcaacaccttcgccatatatacccggggcgctgcgctccacctggccgccgcctccagcccagc

SEQ ID NO: 92064 - DNA, 161 bp, Homo sapiens
  misc_feature 1..161: note = chr4:26030405-26030566
  misc_feature 1..161: note = hyper
  source 1..161: mol_type = genomic DNA
gcctgggtgattttacgtgcggatgcagaggaggggcagcgtcggggcggcggagtccgacctcgggggattcaccctgagggttacaggcaaggccgctccaggcacgcagcacctgccgggcgccacccaggagggggcagcagcgccattcgcaaagc

SEQ ID NO: 92065 - DNA, 31 bp, Homo sapiens
  misc_feature 1..31: note = chr4:26030635-26030666
  misc_feature 1..31: note = hyper
  source 1..31: mol_type = genomic DNA
cgtcccaggggacctccgccaggccagggga

SEQ ID NO: 92066 - DNA, 30 bp, Homo sapiens
  misc_feature 1..30: note = chr4:2626134-2626164
  misc_feature 1..30: note = hypo
  source 1..30: mol_type = genomic DNA
tgctgggattataggcgtgagccactgccc

SEQ ID NO: 92067 - DNA, 30 bp, Homo sapiens
  misc_feature 1..30: note = chr4:26296591-26296621
  misc_feature 1..30: note = hypo
  source 1..30: mol_type = genomic DNA
gaatcagggataaaccgtgaacccctggag

SEQ ID NO: 92068 - DNA, 60 bp, Homo sapiens
  misc_feature 1..60: note = chr4:2688393-2688453
  misc_feature 1..60: note = hypo
  source 1..60: mol_type = genomic DNA
caaacaactcatggtcgtgtcttgaggagtccaggaggcacttaacgtagcttcagagcc

SEQ ID NO: 92069 - DNA, 52 bp, Homo sapiens
  misc_feature 1..52: note = chr4:27086432-27086484
  misc_feature 1..52: note = hyper
  source 1..52: mol_type = genomic DNA
aaattgcaaagtaaacggcaagatgttgccgcgatagcgagcaggaaaatct

SEQ ID NO: 92070 - DNA, 90 bp, Homo sapiens
  misc_feature 1..90: note = chr4:27086750-27086840
  misc_feature 1..90: note = hyper
  source 1..90: mol_type = genomic DNA
ggtcacttaaaggaacggcgctgactcagcgacagcagcgtggaggttgaatgtggggattagcactgagcaaaacgaatacaaaccttt

SEQ ID NO: 92071 - DNA, 30 bp, Homo sapiens
  misc_feature 1..30: note = chr4:2746348-2746378
  misc_feature 1..30: note = hypo
  source 1..30: mol_type = genomic DNA
cctgtcccatgatttcggccaccaccggcc

SEQ ID NO: 92072 - DNA, 30 bp, Homo sapiens
  misc_feature 1..30: note = chr4:2763047-2763077
  misc_feature 1..30: note = hypo
  source 1..30: mol_type = genomic DNA
agctgctgaggcctgcgtggtccactggcc

SEQ ID NO: 92073 - DNA, 449 bp, Homo sapiens; identical to SEQ ID NO: 28711
  misc_feature 1..449: note = chr4:2765778-2766227
  misc_feature 1..449: note = hyper
  source 1..449: mol_type = genomic DNA

SEQ ID NO: 92074 - DNA, 30 bp, Homo sapiens
  misc_feature 1..30: note = chr4:2915308-2915338
  misc_feature 1..30: note = hypo
  source 1..30: mol_type = genomic DNA
cccatctgtccctctcggagctctgtgtca

SEQ ID NO: 92075 - DNA, 114 bp, Homo sapiens; identical to SEQ ID NO: 40217
  misc_feature 1..114: note = chr4:2926282-2926396
  misc_feature 1..114: note = hypo
  source 1..114: mol_type = genomic DNA

SEQ ID NO: 92076 - DNA, 52 bp, Homo sapiens
  misc_feature 1..52: note = chr4:2930363-2930415
  misc_feature 1..52: note = hypo
  source 1..52: mol_type = genomic DNA
ctagaggtcccctcacgtgaccagccccgtgtagccccgggctgacccagtg

SEQ ID NO: 92077 - DNA, 247 bp, Homo sapiens
  misc_feature 1..247: note = chr4:2932839-2933086
  misc_feature 1..247: note = hypo
  source 1..247: mol_type = genomic DNA
cagtgtacccatgaccgtgcccttctgccctggtgagcctgtgggaagaggcacagtcaggcaccactgcccttctcccgctcaggtggcttcggccgagggaagggggctcaccatagccagcgaccacggaggacaggcagggcaccacaacggcggcggctggtgggagacatcgaggaggtgcccgtcagcccaggggagggtgcatcacccagcccctgctgcccatcggatcccctgccag

SEQ ID NO: 92078 - DNA, 48 bp, Homo sapiens
  misc_feature 1..48: note = chr4:2978950-2978998
  misc_feature 1..48: note = hypo
  source 1..48: mol_type = genomic DNA
gcaaaataccttcctcggtatgatgagtaacagcgcatactactgctg

SEQ ID NO: 92079 - DNA, 45 bp, Homo sapiens; identical to SEQ ID NO: 40220
  misc_feature 1..45: note = chr4:2987431-2987476
  misc_feature 1..45: note = hypo
  source 1..45: mol_type = genomic DNA

SEQ ID NO: 92080 - DNA, 30 bp, Homo sapiens
  misc_feature 1..30: note = chr4:30718156-30718186
  misc_feature 1..30: note = hyper
  source 1..30: mol_type = genomic DNA
acaggtttaagcaagcgaggttagtaggta

SEQ ID NO: 92081 - DNA, 30 bp, Homo sapiens
  misc_feature 1..30: note = chr4:30718953-30718983
  misc_feature 1..30: note = hyper
  source 1..30: mol_type = genomic DNA
cccgtacccctaccccgcccatttcctttg

SEQ ID NO: 92082 - DNA, 250 bp, Homo sapiens; identical to SEQ ID NO: 28855
  misc_feature 1..250: note = chr4:30719374-30719624
  misc_feature 1..250: note = hyper
  source 1..250: mol_type = genomic DNA

SEQ ID NO: 92083 - DNA, 184 bp, Homo sapiens
  misc_feature 1..184: note = chr4:30719850-30720034
  misc_feature 1..184: note = hyper
  source 1..184: mol_type = genomic DNA
tccctgccctggcctcggaggaggagccaccacccctggggtgatgctactttcacagactggaaaatactcgccagctccctgacacacacttagacacacttccatccaacgggcatctacgatcccctgtagggagagcttggaaatctctgccgcctctccctcctcattcctgttcctg

SEQ ID NO: 92084 - DNA, 367 bp, Homo sapiens; identical to SEQ ID NO: 28857
  misc_feature 1..367: note = chr4:30720054-30720421
  misc_feature 1..367: note = hyper
  source 1..367: mol_type = genomic DNA

SEQ ID NO: 92085 - DNA, 303 bp, Homo sapiens
  misc_feature 1..303: note = chr4:30720644-30720947
  misc_feature 1..303: note = hyper
  source 1..303: mol_type = genomic DNA
ccaggcgcgcacacacggtctacccccgcaagcaagcacgacgacaggaatgtcaagcatttaaacaaagacagacatccttcaccctccacccaccgccgcccctgccccccgcaaccatccaaagtctgagctcccaaaaaaggatctttctccagctctctggagtttgatgttctctcttcactactgcagcccgtcatggtttttcagaacagagtggctttctgggcgctcgtaggttccccaggaccccgataaccatgtcctaaccaagatcctaaatcgcgaaccggagacact

SEQ ID NO: 92086 - DNA, 223 bp, Homo sapiens
  misc_feature 1..223: note = chr4:30721247-30721470
  misc_feature 1..223: note = hyper
  source 1..223: mol_type = genomic DNA
cgggccctcctccctcgctctctcctagtgtgtagtttcggcggctcggctgctactgccgccgccgctgcagcagcagcgtcagggacaagcctgatccgtgagcgagcgagcacccagcagcaaccaccactttgggcaacttgcgggtttcctgctcgcgggtagcgaacgggagattcccactagcggttcagtgtctccgagccgctgcagcccgagg

SEQ ID NO: 92087 - DNA, 30 bp, Homo sapiens
  misc_feature 1..30: note = chr4:30721945-30721975
  misc_feature 1..30: note = hyper
  source 1..30: mol_type = genomic DNA
gggatcgagagagagcggggagagagaggc

SEQ ID NO: 92088 - DNA, 172 bp, Homo sapiens
  misc_feature 1..172: note = chr4:30722839-30723011
  misc_feature 1..172: note = hyper
  source 1..172: mol_type = genomic DNA
aaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggt

SEQ ID NO: 92089 - DNA, 322 bp, Homo sapiens
  misc_feature 1..322: note = chr4:30724216-30724538
  misc_feature 1..322: note = hyper
  source 1..322: mol_type = genomic DNA
gcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacc

SEQ ID NO: 92090 - DNA, 30 bp, Homo sapiens
  misc_feature 1..30: note = chr4:3177345-3177375
  misc_feature 1..30: note = hypo
  source 1..30: mol_type = genomic DNA
gcacaagcatttgcacgcttcccctcttga

SEQ ID NO: 92091 - DNA, 54 bp, Homo sapiens
  misc_feature 1..54: note = chr4:3252743-3252797
  misc_feature 1..54: note = hypo
  source 1..54: mol_type = genomic DNA
ggcaggccccaaagccgggacctagggtgctgagcatgacggatgttgggtttg

SEQ ID NO: 92092 - DNA, 187 bp, Homo sapiens
  misc_feature 1..187: note = chr4:3285790-3285977
  misc_feature 1..187: note = hypo
  source 1..187: mol_type = genomic DNA
cttgagccccaggggcggcatgagcaatctgctgggctggctgaagcccagctcaccctggccaatgggaagcgccagcaggatgccctggaggggagggctgaagggcgggtgtgggggtgaatctgtgtgtgctggctgctcagctgctccctaaactaccccaccgccccgctgggcgacatta

SEQ ID NO: 92093 - DNA, 134 bp, Homo sapiens
  misc_feature 1..134: note = chr4:3286580-3286714
  misc_feature 1..134: note = hypo
  source 1..134: mol_type = genomic DNA
gccaatgaccttccacggtgtgggtgggcctcatctgagcagttgaagggcttgagaggaaaaaggctcccaaggaggagggaaggctgccagcacggtgctctggacttgaggggcggcggcagctcctcccc

SEQ ID NO: 92094 - DNA, 167 bp, Homo sapiens
  misc_feature 1..167: note = chr4:3292632-3292799
  misc_feature 1..167: note = hypo
  source 1..167: mol_type = genomic DNA
ttgacaccttctctccgtctcaggcaatttctccccacttctgggggccctggctttcacggggatggactagggtgcttcctcccacagaaacagcttcttgggccacccccctgctgggcatgagttctctcacaggctcggtgacccctcgtatgagctgctcg

SEQ ID NO: 92095 - DNA, 32 bp, Homo sapiens
  misc_feature 1..32: note = chr4:3301969-3302001
  misc_feature 1..32: note = hypo
  source 1..32: mol_type = genomic DNA
tggagacagcagtgccgcgggctctgctgagc

SEQ ID NO: 92096 - DNA, 616 bp, Homo sapiens; identical to SEQ ID NO: 28663
  misc_feature 1..616: note = chr4:330715-331331
  misc_feature 1..616: note = hyper
  source 1..616: mol_type = genomic DNA

SEQ ID NO: 92097 - DNA, 57 bp, Homo sapiens
  misc_feature 1..57: note = chr4:3310494-3310551
  misc_feature 1..57: note = hypo
  source 1..57: mol_type = genomic DNA
tttagctctgggaagcggctggcgccgttcagggctgggagccgctctgtcaggatt

SEQ ID NO: 92098 - DNA, 144 bp, Homo sapiens
  misc_feature 1..144: note = chr4:3313229-3313373
  misc_feature 1..144: note = hypo
  source 1..144: mol_type = genomic DNA
gaaggagtgacagtgcgggttgagcatcccttatccagatgctccagaatcggaaaccctctgacaccgatgtggcacctcaggcatagctgagctagtgacacctttgctttctcatgggtcagtgtacacaaaccttgtttc

SEQ ID NO: 92099 - DNA, 203 bp, Homo sapiens
  misc_feature 1..203: note = chr4:3313433-3313636
  misc_feature 1..203: note = hypo
  source 1..203: mol_type = genomic DNA
atatgaaacataaatgaatttcctgttcagacctgggtcctatccaaacatatctcattacgtatatacagatgttccgaatcagaaaaaatccacagcccttctggtcccaaaaatctcttctaagggacactcagcctgtgtgacgtggtcggtgactcctgatgggaggtggcagtgctgtgcggcgagtggggaccttc

SEQ ID NO: 92100 - DNA, 736 bp, Homo sapiens
  misc_feature 1..736: note = chr4:331562-332298
  misc_feature 1..736: note = hyper
  source 1..736: mol_type = genomic DNA
cagccagagaggaggcggtggcttccgggatgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggtgagtgtgcggggcagggcgtcccaaggctgaggaggtctcatcggagctggcgggaaatggcggcgggaccgagtctgcgaacggagtccccgctgccgccgctcagccctggggcctcagtaccctccggtgagggacctgggctcctgtcggtccccgcacagcggctctggcccagcctgcagccctccttgtgcagctctgcgcccgcagccccgcaccttccccaggctgtggggtgaggagtagcttatctggaagccgcccgcgcggcgtgcgcgatgccggcgtgggaggagctgtgggagaagctgtggtctggggatcccgtccctgctttaccctgttcggaatgagatcgaggccccatcaaaacagagttcatgtgagcaaatggggactcattaatgggacagcgccggccgtggctcgtggtttgggggctgccagcgggtcttgaaggaaaagcttttgtgaggtgtgtgaggaagcgaagcaaatcacccgcccgctccaactt

SEQ ID NO: 92101 - DNA, 30 bp, Homo sapiens
  misc_feature 1..30: note = chr4:3417466-3417496
  misc_feature 1..30: note = hypo
  source 1..30: mol_type = genomic DNA
tgggctagcatcgcccgggtctttgggaca

SEQ ID NO: 92102 - DNA, 44 bp, Homo sapiens
  misc_feature 1..44: note = chr4:3418235-3418279
  misc_feature 1..44: note = hypo
  source 1..44: mol_type = genomic DNA
ctgtgcatgtcgctgcggcacgtgggtcacgttcacagaagcat

SEQ ID NO: 92103 - DNA, 30 bp, Homo sapiens
  misc_feature 1..30: note = chr4:3425872-3425902
  misc_feature 1..30: note = hypo
  source 1..30: mol_type = genomic DNA
gcgtggggtggtgaccgcaggtgctgggca

SEQ ID NO: 92104 - DNA, 33 bp, Homo sapiens
  misc_feature 1..33: note = chr4:3441235-3441268
  misc_feature 1..33: note = hypo
  source 1..33: mol_type = genomic DNA
atcttgtaactggctcggcgcccgggcgggatg

SEQ ID NO: 92105 - DNA, 336 bp, Homo sapiens
  misc_feature 1..336: note = chr4:3445886-3446222
  misc_feature 1..336: note = hypo
  source 1..336: mol_type = genomic DNA
aggtgagctgggcctcggaggtccgcaggggtccaggggccggagcaagtccccggaggatgggagaacaggtggctcccgagtgcagggcaggggccctgcacggggacagcaggtggcagggtgtgagggcttactgtgcacccctcagagaaatgctttgatgagacccgctacgagtacctggaggggggcgaccgctgggcccgcgtgcgccagggccacgtggaacagtgcgagtgcttcgggggccggacctggtgcgaaggcacccgacatacaggtgcgccacggggtgtgagccgtgccactgacccctgacgggtgtccctgtcc

SEQ ID NO: 92106 - DNA, 727 bp, Homo sapiens
  misc_feature 1..727: note = chr4:3446443-3447170
  misc_feature 1..727: note = hypo
  source 1..727: mol_type = genomic DNA
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcaggaatccggacaatgacgagaggccctggtgctacgtggtgaaggacagcgcgctctcctgggagtactgccgcctggaggcctgcggtgcgcggctggcggggggtgctgccttgggccccaccgaggtcacagcagttttccccgtgatcctcctagcccctccgcacacctggctac

SEQ ID NO: 92107 - DNA, 235 bp, Homo sapiens
  misc_feature 1..235: note = chr4:3447780-3448015
  misc_feature 1..235: note = hypo
  source 1..235: mol_type = genomic DNA
gagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctc

SEQ ID NO: 92108 - DNA, 30 bp, Homo sapiens; identical to SEQ ID NO: 40229
  misc_feature 1..30: note = chr4:3449723-3449753
  misc_feature 1..30: note = hypo
  source 1..30: mol_type = genomic DNA

SEQ ID NO: 92109 - DNA, 30 bp, Homo sapiens
  misc_feature 1..30: note = chr4:3465854-3465884
  misc_feature 1..30: note = hypo
  source 1..30: mol_type = genomic DNA
ccaggccgcctgcagcgctgggcctgtagg

SEQ ID NO: 92110 - DNA, 195 bp, Homo sapiens
  misc_feature 1..195: note = chr4:3467304-3467499
  misc_feature 1..195: note = hypo
  source 1..195: mol_type = genomic DNA
cctttctcctccttgcgtttttctcaatcgtgagcacgtctttctgttatgacaaggtttagcgaatgaaagggaaacccttttatcaaagggctgctcagccacagcgcctggcatggccagtggacgtcgggccgtctgcctcggtgtgggactgcagggtgccctgcagtgggaccacgttcctcaatgtct

SEQ ID NO: 92111 - DNA, 326 bp, Homo sapiens
  misc_feature 1..326: note = chr4:3475077-3475403
  misc_feature 1..326: note = hypo
  source 1..326: mol_type = genomic DNA
aagggtgcgggcaggcggtgttggctggcgtccctgacggccacgctccttgcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgagggtgagtgacgggggccggggccgggcgggggctccccgtt

SEQ ID NO: 92112 - DNA, 58 bp, Homo sapiens
  misc_feature 1..58: note = chr4:3479511-3479569
  misc_feature 1..58: note = hypo
  source 1..58: mol_type = genomic DNA
atggatgggcagggccgctgcctatgccagctgtgagctggtgcggggggtggggtgg

SEQ ID NO: 92113 - DNA, 53 bp, Homo sapiens
  misc_feature 1..53: note = chr4:3534408-3534461
  misc_feature 1..53: note = hyper
  source 1..53: mol_type = genomic DNA
gcctcacccagagcccggagcctggagcccgcacgactcgaggcctctttccc

SEQ ID NO: 92114 - DNA, 17 bp, Homo sapiens
  misc_feature 1..17: note = chr4:3565396-3565413
  misc_feature 1..17: note = hypo
  source 1..17: mol_type = genomic DNA
caagactgtgacacacg

SEQ ID NO: 92115 - DNA, 155 bp, Homo sapiens
  misc_feature 1..155: note = chr4:35962570-35962725
  misc_feature 1..155: note = hypo
  source 1..155: mol_type = genomic DNA
tttttatttttatcttttaattccatttactccatgaacttttcgaagtctccttttacattttttctccatgtcttttcatggccgaatagctaatttctttttagttttaagtaatattcgtttacatgaatgcatcacgctttatttattca

SEQ ID NO: 92116 - DNA, 133 bp, Homo sapiens
  misc_feature 1..133: note = chr4:3603530-3603663
  misc_feature 1..133: note = hypo
  source 1..133: mol_type = genomic DNA
cagcgctggcccaggcgccttggcaggggaccggctgcacctgcttctctcttctctctccccctcccacttccccatcaggaactgggtcctgctggctcagggtagactgccatggcgacaaccacctctg

SEQ ID NO: 92117 - DNA, 142 bp, Homo sapiens
  misc_feature 1..142: note = chr4:3609066-3609208
  misc_feature 1..142: note = hypo
  source 1..142: mol_type = genomic DNA
caagcacatcttccacggccctcaccccacgcagctgccctgcccctcaggctcttcctcagcctgctggaagctggtgcctcagggcctttgcacttgctgcctggaacaggattccctgtgtccacgtggctccctcccc

SEQ ID NO: 92118 - DNA, 30 bp, Homo sapiens
  misc_feature 1..30: note = chr4:3616292-3616322
  misc_feature 1..30: note = hypo
  source 1..30: mol_type = genomic DNA
ccagcccccagtccacgaaggagaagcaac

SEQ ID NO: 92119 - DNA, 30 bp, Homo sapiens
  misc_feature 1..30: note = chr4:36206328-36206358
  misc_feature 1..30: note = hypo
  source 1..30: mol_type = genomic DNA
caggccgggcacggtcgtttatgcctgtaa

SEQ ID NO: 92120 - DNA, 18 bp, Homo sapiens
  misc_feature 1..18: note = chr4:36311031-36311049
  misc_feature 1..18: note = hypo
  source 1..18: mol_type = genomic DNA
gatcgcaggttgcagtga

SEQ ID NO: 92121 - DNA, 30 bp, Homo sapiens
  misc_feature 1..30: note = chr4:36345308-36345338
  misc_feature 1..30: note = hypo
  source 1..30: mol_type = genomic DNA
ttcaccgacaaacttcgcctcctggctcga

SEQ ID NO: 92122 - DNA, 207 bp, Homo sapiens
  misc_feature 1..207: note = chr4:36418721-36418928
  misc_feature 1..207: note = hypo
  source 1..207: mol_type = genomic DNA
aggaaaaattaagcacgcagatattgaaaagtgaatggagtagaatttattaagcaaaaaggtaagctctcagagaaaagacgggtcctaaaagcaggttgttggttgcccccttcacagttgaacacaagggcttttatatatccgctgatggggctgggttccctaggtgtataaagcgccaattcctggcggctccaccctgtt

SEQ ID NO: 92123 - DNA, 30 bp, Homo sapiens
  misc_feature 1..30: note = chr4:3652102-3652132
  misc_feature 1..30: note = hypo
  source 1..30: mol_type = genomic DNA
cgaaagcagggacagcgtctctcattcaca

SEQ ID NO: 92124 - DNA, 30 bp, Homo sapiens
  misc_feature 1..30: note = chr4:3654274-3654304
  misc_feature 1..30: note = hypo
  source 1..30: mol_type = genomic DNA
gtgcaccggtaaaggcgagcagctggtggg

SEQ ID NO: 92125 - DNA, 61 bp, Homo sapiens
  misc_feature 1..61: note = chr4:3664470-3664531
  misc_feature 1..61: note = hypo
  source 1..61: mol_type = genomic DNA
cggtcccacctgctccggcgccccgtggctgctgtcttcttcctttcgaaacaccctggag

SEQ ID NO: 92126 - DNA, 77 bp, Homo sapiens
  misc_feature 1..77: note = chr4:3690825-3690902
  misc_feature 1..77: note = hypo
  source 1..77: mol_type = genomic DNA
gccgtggcctgagagcgtccccagaggctcacgcggtggaagctggatcccacggccggccgcggtgctgaggggtg

SEQ ID NO: 92127 - DNA, 184 bp, Homo sapiens
  misc_feature 1..184: note = chr4:3702485-3702669
  misc_feature 1..184: note = hypo
  source 1..184: mol_type = genomic DNA
tttggaatctaagagcgttccagcccttagtaatcctcagctgcgtgggacttggcccttcctgatgcgatggcctggggcaattgttctgtttgtggggtttgctgccagcctcacctctgtaccctccctggaaccctcccaccccaccttcagtgagcggtggaagcggcaaggcccccgt

SEQ ID NO: 92128 - DNA, 45 bp, Homo sapiens; identical to SEQ ID NO: 2391
  misc_feature 1..45: note = chr4:37245537-37245582
  misc_feature 1..45: note = hyper
  source 1..45: mol_type = genomic DNA

SEQ ID NO: 92129 - DNA, 525 bp, Homo sapiens; identical to SEQ ID NO: 2392
  misc_feature 1..525: note = chr4:37245836-37246361
  misc_feature 1..525: note = hyper
  source 1..525: mol_type = genomic DNA

SEQ ID NO: 92130 - DNA, 211 bp, Homo sapiens; identical to SEQ ID NO: 2393
  misc_feature 1..211: note = chr4:37246489-37246700
  misc_feature 1..211: note = hyper
  source 1..211: mol_type = genomic DNA

SEQ ID NO: 92131 - DNA, 223 bp, Homo sapiens; identical to SEQ ID NO: 28865
  misc_feature 1..223: note = chr4:37247015-37247238
  misc_feature 1..223: note = hyper
  source 1..223: mol_type = genomic DNA

SEQ ID NO: 92132 - DNA, 148 bp, Homo sapiens
  misc_feature 1..148: note = chr4:37247293-37247441
  misc_feature 1..148: note = hyper
  source 1..148: mol_type = genomic DNA
cgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcaggatgggctca

SEQ ID NO: 92133 - DNA, 55 bp, Homo sapiens
  misc_feature 1..55: note = chr4:37455430-37455485
  misc_feature 1..55: note = hyper
  source 1..55: mol_type = genomic DNA
gccgcatcctcggggcgtgcaggtaaagggttacgcgtgtcgggaaggctcaccc

SEQ ID NO: 92134 - DNA, 912 bp, Homo sapiens
  misc_feature 1..912: note = chr4:3767295-3768207
  misc_feature 1..912: note = hyper
  source 1..912: mol_type = genomic DNA
gcgcgcgcgcgtgtgcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcggagcgcccgggccgccgccgcctgtcgcctgcgccccggctgggctccgggaccgcggggccgctcaggcacgcccgctcgggcgccgcgtcgccgtgggctcgacgccggggcgctccccgtgagccgggccgagggcggggccgcgcgaggaccccgggacctgcccccctccccccgcagccgcgtcgccgctcgctccgggcgcctcctgctctgcacttacacgctcggcagctgcggggagcccggcagccacgctctccggcgcgccgcccgcggagccaccacggccgagggccggctgctgggcgcc

SEQ ID NO: 92135 - DNA, 132 bp, Homo sapiens
  misc_feature 1..132: note = chr4:3768818-3768950
  misc_feature 1..132: note = hyper
  source 1..132: mol_type = genomic DNA
gcgcacaccacgccgcgtcaaggccaccatcgtggccgtgtggctcatctcggccgtcatctccttcccgccgctggtctcgctctaccgccagcccgacggcgccgcctacccgcagtgcggcctcaacga

SEQ ID NO: 92136 - DNA, 196 bp, Homo sapiens; identical to SEQ ID NO: 28715
  misc_feature 1..196: note = chr4:3768994-3769190
  misc_feature 1..196: note = hyper
  source 1..196: mol_type = genomic DNA

SEQ ID NO: 92137 - DNA, 63 bp, Homo sapiens; identical to SEQ ID NO: 28716
  misc_feature 1..63: note = chr4:3769559-3769622
  misc_feature 1..63: note = hyper
  source 1..63: mol_type = genomic DNA

SEQ ID NO: 92138 - DNA, 30 bp, Homo sapiens; identical to SEQ ID NO: 40234
  misc_feature 1..30: note = chr4:3782694-3782724
  misc_feature 1..30: note = hypo
  source 1..30: mol_type = genomic DNA

SEQ ID NO: 92139 - DNA, 270 bp, Homo sapiens
  misc_feature 1..270: note = chr4:3783050-3783320
  misc_feature 1..270: note = hypo
  source 1..270: mol_type = genomic DNA
cgaaacacctccgcccgcaagaaactcctcccctcacatgaaactcctcccctcacacgaaactccctcctcacatgaaactcctccccacacacgaaactcctcctcccacatgaaactcttccgccacatgaaactcctcccctcacatgaaactcctccccaccacacgaaactcctcctcccacacaaaactcctccccacgtcttcctcccacacgaaactcctccccacaccaaactcctcctcccgcacgaaactcctcccct

SEQ ID NO: 92140 - DNA, 30 bp, Homo sapiens
  misc_feature 1..30: note = chr4:3783791-3783821
  misc_feature 1..30: note = hypo
  source 1..30: mol_type = genomic DNA
tgcagtgaagccactcggccccaggggcct

SEQ ID NO: 92141 - DNA, 77 bp, Homo sapiens
  misc_feature 1..77: note = chr4:37892223-37892300
  misc_feature 1..77: note = hyper
  source 1..77: mol_type = genomic DNA
caaggacagggtgtgcgactgtacatcccgccacgagggcctgcatcacgcgcggggccccgcgcccccggctcccc

SEQ ID NO: 92142 - DNA, 53 bp, Homo sapiens
  misc_feature 1..53: note = chr4:379992-380045
  misc_feature 1..53: note = hyper
  source 1..53: mol_type = genomic DNA
cctcagggaggcctccgtgattcggcctcagcctccgtcgctctgtgacctgt

SEQ ID NO: 92143 - DNA, 207 bp, Homo sapiens
  misc_feature 1..207: note = chr4:380356-380563
  misc_feature 1..207: note = hyper
  source 1..207: mol_type = genomic DNA
agctcatctggaagacgccgacgcggcgtgcgcagtgggcgcgtgggaggagctgtggtctgggggtcccgtccctacttgacctgttcggaatgatgtcaaggccccatcaaaacatagagttcatgtgagcaaacggggactcattaatgggacagcgccgaccatggctcgtggtttgggggctgctggcgggtcttaaaggaa

SEQ ID NO: 92144 - DNA, 30 bp, Homo sapiens
  misc_feature 1..30: note = chr4:3864547-3864577
  misc_feature 1..30: note = hyper
  source 1..30: mol_type = genomic DNA
agggggaaacatcttcgcgtttcatttcct

SEQ ID NO: 92145 - DNA, 30 bp, Homo sapiens
  misc_feature 1..30: note = chr4:38650068-38650098
  misc_feature 1..30: note = hypo
  source 1..30: mol_type = genomic DNA
aggcacagtggctcacgcctgtaatcccag

SEQ ID NO: 92146 - DNA, 771 bp, Homo sapiens
  misc_feature 1..771: note = chr4:3873077-3873848
  misc_feature 1..771: note = hyper
  source 1..771: mol_type = genomic DNA
cagtagactggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccatccaggccgtcgcggcgcggctcgaacactcacagaggaagcacctactgtgcgccaaccctgcgcccggcagcgtgcgggagacagaggggaacccagtacttccctgccgtgggggctctcggtgggctcgaggtcatgtcctg

SEQ ID NO: 92147 - DNA, 32 bp, Homo sapiens
  misc_feature 1..32: note = chr4:38732941-38732973
  misc_feature 1..32: note = hyper
  source 1..32: mol_type = genomic DNA
agggaggcccaggcacgcggagcttctagttc

SEQ ID NO: 92148 - DNA, 154 bp, Homo sapiens; identical to SEQ ID NO: 28718
  misc_feature 1..154: note = chr4:3882096-3882250
  misc_feature 1..154: note = hyper
  source 1..154: mol_type = genomic DNA

SEQ ID NO: 92149 - DNA, 116 bp, Homo sapiens; identical to SEQ ID NO: 28867
  misc_feature 1..116: note = chr4:39047287-39047403
  misc_feature 1..116: note = hyper
  source 1..116: mol_type = genomic DNA

SEQ ID NO: 92150 - DNA, 147 bp, Homo sapiens
  misc_feature 1..147: note = chr4:3925878-3926025
  misc_feature 1..147: note = hypo
  source 1..147: mol_type = genomic DNA
ttgtccataaaatgccgattggacacttattgtagaatgccgagggcactgtagattcagatagtccccatcacaggcataggtggtgtggttttacaggagtttggttaggtaacctggaaaatattcagtcgggttacaagaggc

SEQ ID NO: 92151 - DNA, 234 bp, Homo sapiens
  misc_feature 1..234: note = chr4:39448261-39448495
  misc_feature 1..234: note = hypo
  source 1..234: mol_type = genomic DNA
tcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctgg

SEQ ID NO: 92152 - DNA, 30 bp, Homo sapiens
  misc_feature 1..30: note = chr4:39697732-39697762
  misc_feature 1..30: note = hyper
  source 1..30: mol_type = genomic DNA
gtgcccccactgattcgcctccattggcta

SEQ ID NO: 92153 - DNA, 26 bp, Homo sapiens
  misc_feature 1..26: note = chr4:39790045-39790071
  misc_feature 1..26: note = hypo
  source 1..26: mol_type = genomic DNA
tttgtattcttaggccgggcttggtg

SEQ ID NO: 92154 - DNA, 145 bp, Homo sapiens
  misc_feature 1..145: note = chr4:39816644-39816789
  misc_feature 1..145: note = hypo
  source 1..145: mol_type = genomic DNA
tccccaaatacaaaacgggggctcaggtactggctgggcaagaaaagacgagaaagttttcctgtcgatgtggcctcttggaggctgaactgtgtggcaatgtaactagaaactggagactttatttatttatttattttttctt

SEQ ID NO: 92155 - DNA, 24 bp, Homo sapiens
  misc_feature 1..24: note = chr4:39817089-39817113
  misc_feature 1..24: note = hypo
  source 1..24: mol_type = genomic DNA
cgcccagcccgaaactggagactt

SEQ ID NO: 92156 - DNA, 30 bp, Homo sapiens
  misc_feature 1..30: note = chr4:39860480-39860510
  misc_feature 1..30: note = hypo
  source 1..30: mol_type = genomic DNA
gtgatccactgtgcccggctgaaaacacag

SEQ ID NO: 92157 - DNA, 30 bp, Homo sapiens; identical to SEQ ID NO: 40281
  misc_feature 1..30: note = chr4:40479216-40479246
  misc_feature 1..30: note = hypo
  source 1..30: mol_type = genomic DNA

SEQ ID NO: 92158 - DNA, 100 bp, Homo sapiens; identical to SEQ ID NO: 40282
  misc_feature 1..100: note = chr4:40533094-40533194
  misc_feature 1..100: note = hypo
  source 1..100: mol_type = genomic DNA

SEQ ID NO: 92159 - DNA, 30 bp, Homo sapiens
  misc_feature 1..30: note = chr4:40543284-40543314
  misc_feature 1..30: note = hypo
  source 1..30: mol_type = genomic DNA
aaaaaaaaaaaaaatcgcatcaaatttact

SEQ ID NO: 92160 - DNA, 206 bp, Homo sapiens
  misc_feature 1..206: note = chr4:40910280-40910486
  misc_feature 1..206: note = hypo
  source 1..206: mol_type = genomic DNA
actgtgagaaaagaacgtttctgtagttgaagccacctcgtctgtggtattttgttatggcagccccagccaacaaacacacggtggtgtatacacttcaggtaaccatgagcatatggcagagctggcagtgaagcctgagtttgtgtcctgacacattcctgtcaccgcgccttgctgcctcctaggtgcggcaacaatgctgg

SEQ ID NO: 92161 - DNA, 73 bp, Homo sapiens; identical to SEQ ID NO: 360
  misc_feature 1..73: note = chr4:41258716-41258789
  misc_feature 1..73: note = hyper
  source 1..73: mol_type = genomic DNA

SEQ ID NO: 92162 - DNA, 765 bp, Homo sapiens; identical to SEQ ID NO: 28869
  misc_feature 1..765: note = chr4:41259085-41259850
  misc_feature 1..765: note = hyper
  source 1..765: mol_type = genomic DNA

SEQ ID NO: 92163 - DNA, 81 bp, Homo sapiens; identical to SEQ ID NO: 40284
  misc_feature 1..81: note = chr4:41314285-41314366
  misc_feature 1..81: note = hypo
  source 1..81: mol_type = genomic DNA

SEQ ID NO: 92164 - DNA, 459 bp, Homo sapiens
  misc_feature 1..459: note = chr4:41362304-41362763
  misc_feature 1..459: note = hyper
  source 1..459: mol_type = genomic DNA
ggactgcaggtgctgcgcggccagtgcccgcgcgtcctactgctccggtgccgcagcgcccgctcccccgggcccgggtgcgccccactgggcgcgcgtctcccatatgatgccagacccatccgcccgcccctcagcagccggcggggcgcagggacgtgcggggcggccagcggattccctctatcgggccgggtgtgaacgggagggagacacgcagcgctcgctccgggttatttttagtccgtagctgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggc

SEQ ID NO: 92165 - DNA, 387 bp, Homo sapiens
  misc_feature 1..387: note = chr4:41362780-41363167
  misc_feature 1..387: note = hyper
  source 1..387: mol_type = genomic DNA
cggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggtaggtgcgggtggctggcgggcggccttgcactggcgccctgagccacggacccgcgcacgctccgaccgcaggtccagccttgcctccccccaaccgcccccactttcttttgccagctgctccaggtcacccccccgggcctcggcgagccgcgaaaccttagcgctttggcattggaatcccgggcgagggtgggcgtgaaaggggacac

SEQ ID NO: 92166 - DNA, 429 bp, Homo sapiens
  misc_feature 1..429: note = chr4:4144902-4145331
  misc_feature 1..429: note = hyper
  source 1..429: mol_type = genomic DNA
gctccggggctggggcgcgtgctaggggcccgcggggtttcagctgtattttcgaacccctgtgcttggccgaggggttcccaaggctccactccgccttggagggggctgcggaagcccggaggtgacacgggctctgggaggggcgtccccaacgtgggggaggggtgacaggggcctttgaagacagcgcgggactaggagggggtgcccccgacctaagtcgtggtaaactgaggccggcgaggagggaggctgagtccggggaccaggcggcccctcgctgctcctcgggccagtcgcccccctgcgcctgttcgtacgggcagggccggcggccgagtccagcgggctcggggccaggccggggtcccgcgggcggcgcctcctcctccgcggcgtccccatactcgccctccgcgtcgctct

SEQ ID NO: 92167 - DNA, 67 bp, Homo sapiens
  misc_feature 1..67: note = chr4:4145386-4145453
  misc_feature 1..67: note = hyper
  source 1..67: mol_type = genomic DNA
cgggatgtggggctagcgcggggccatgccccgccgcagcttctgctccatccgcaggtaggagacc

SEQ ID NO: 92168 - DNA, 415 bp, Homo sapiens
  misc_feature 1..415: note = chr4:41746821-41747236
  misc_feature 1..415: note = hyper
  source 1..415: mol_type = genomic DNA
ggaagaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 92169 - DNA, 324 bp, Homo sapiens; identical to SEQ ID NO: 28873
  misc_feature 1..324: note = chr4:41747445-41747769
  misc_feature 1..324: note = hyper
  source 1..324: mol_type = genomic DNA

SEQ ID NO: 92170 - DNA, 124 bp, Homo sapiens; identical to SEQ ID NO: 7338
  misc_feature 1..124: note = chr4:41747888-41748012
  misc_feature 1..124: note = hyper
  source 1..124: mol_type = genomic DNA

SEQ ID NO: 92171 - DNA, 624 bp, Homo sapiens; identical to SEQ ID NO: 28875
  misc_feature 1..624: note = chr4:41748143-41748767
  misc_feature 1..624: note = hyper
  source 1..624: mol_type = genomic DNA

SEQ ID NO: 92172 - DNA, 691 bp, Homo sapiens
  misc_feature 1..691: note = chr4:41749079-41749770
  misc_feature 1..691: note = hyper
  source 1..691: mol_type = genomic DNA
ggcacttcctgtccccgaaattgcatcgctcatccacgtcccaaggccccccatgtctctgctcgggtgggaaacacttcgcaactgtaaataaaatgccaagagcgtgcgctctaagcctctctcgaacgcacagccacaccaaatccagtatttctgatcggccatggggccctaggtccttctcactcgaggctccaggacttcgaatttcaccagccgcccctcaccccacacctccccggaccagtgcggcggagcggggtcggtttccaggcgcgcgtacctggactcgcgcctctgtgaggtcgatcttcagggccagctcctcccgagtgtagatgtcggggtagtgagtctccgcgaagaccctttccagctctttgagctgggcactggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctcaaacttcgggcttggcggagtcctttctgg

SEQ ID NO: 92173 - DNA, 497 bp, Homo sapiens; identical to SEQ ID NO: 28877
  misc_feature 1..497: note = chr4:41750102-41750599
  misc_feature 1..497: note = hyper
  source 1..497: mol_type = genomic DNA

SEQ ID NO: 92174 - DNA, 37 bp, Homo sapiens
  misc_feature 1..37: note = chr4:41751372-41751409
  misc_feature 1..37: note = hyper
  source 1..37: mol_type = genomic DNA
gggggtttatgtgaacgataagcggatttctttaaaa

SEQ ID NO: 92175 - DNA, 181 bp, Homo sapiens; identical to SEQ ID NO: 28879
  misc_feature 1..181: note = chr4:41751719-41751900
  misc_feature 1..181: note = hyper
  source 1..181: mol_type = genomic DNA

SEQ ID NO: 92176 - DNA, 1400 bp, Homo sapiens
  misc_feature 1..1400: note = chr4:41752312-41753712
  misc_feature 1..1400: note = hyper
  source 1..1400: mol_type = genomic DNA
gctctcccctgccaccgtgttttattgcgcactaaactgccgcggacgcagtaatggattaaacggggacagcggtcccccagccttgtgcttctttgcagggtgagtttcaggctcgtttcaggtggttgcaaatcctcggggcgtgaggaagcgctaaagtcgggagtgcagggagccggacctaccgaggatcctggtgatagttttatggggagggctgatagttttattgcagttgtatgttgtacaatgcgtatttgataaagaagggcccttggtgaccagtgtgcacttttttgtgcacgggggtgaaatgaaaataaatgtatacaaggttttactgcggcgggaaacaaattgcaacgctctaaatggtttttctttatggtcaccagacaagaggagaaaagggatgcaaacatctgtcttcagtcccctaaacctaaaggccagcaaagacggatgcgaatccaagtgctattacagcggagatttgtctttatttatcccgctctcatgaatatgaatttgcatttgggccgggaggtggctgtatccctttggactccacacatggaatttcccccacgctcatccccctccccaaccacttaagggaggtgggggataggttgtcaagcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggcc

SEQ ID NO: 92177 - DNA, 90 bp, Homo sapiens; identical to SEQ ID NO: 2399
  misc_feature 1..90: note = chr4:41753713-41753803
  misc_feature 1..90: note = hyper
  source 1..90: mol_type = genomic DNA

SEQ ID NO: 92178 - DNA, 113 bp, Homo sapiens; identical to SEQ ID NO: 2400
  misc_feature 1..113: note = chr4:41753804-41753917
  misc_feature 1..113: note = hyper
  source 1..113: mol_type = genomic DNA

SEQ ID NO: 92179 - DNA, 143 bp, Homo sapiens
  misc_feature 1..143: note = chr4:41754030-41754173
  misc_feature 1..143: note = hyper
  source 1..143: mol_type = genomic DNA
cgtccctctgcccgtcttttgtggcccggggtcctgcttctgcttggagatgaaaggcgtgcggggctgggccaggccagagccccagccccagcgccctgttttgttccagttgtgctttctacacgcgagctctcccctaa

SEQ ID NO: 92180 - skipped

SEQ ID NO: 92181 - DNA, 561 bp, Homo sapiens
  misc_feature 1..561: note = chr4:41867612-41868173
  misc_feature 1..561: note = hyper
  source 1..561: mol_type = genomic DNA
cgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttcacccatcaattagatctctattagcagccaatgcaggcttcaccacaggaaatgtcacgtcccagccctagcggaccctttcgttccccacccccagctctcacctcccctgtccctggagttaaacaactcttctggcgcacacattggaactaaacaaacccttttgtgtggaatacggtttttgtgttttgttttttgtttttcttattgaacttgttttggaaccctgtaccacctgccttccccaaccccagcgcagcgagctaaccccgggacactcccaccccggccggctgaacaggttgcagcgcgacacctgcgctgtctgctgggt

SEQ ID NO: 92182 - DNA, 433 bp, Homo sapiens
  misc_feature 1..433: note = chr4:41875374-41875807
  misc_feature 1..433: note = hyper
  source 1..433: mol_type = genomic DNA
acatcgcaacaaaaccgggttcctcttgaaccaacaaaccttttttgtaaccggctgaatggctgtatctacggagccagtaggttgcggaaaggcgttcgcagggtggaggagcgggtagttggggaaccgggcgcgcctgatggggcgcaggaaggaaaaactgatcgacgcaatggcccccgccaccggccatttggggctttcaaacgccctaacgaggagtccgagcggccactgaaagcctccctgttcctgggcagggcagccagagtgccctcccctctcccttcccagcctcccggcggcgccaccattaacccggagccagacccaggcggaggccccggcgccgaggcccgcggaagcaagagacagccctgatagtcttctaaacccggtccagtttcgaggacgacgcattatagtggaa

SEQ ID NO: 92183 - DNA, 230 bp, Homo sapiens
  misc_feature 1..230: note = chr4:41881201-41881431
  misc_feature 1..230: note = hyper
  source 1..230: mol_type = genomic DNA
cgacaggaggctgcaggcacgtcctgcggctccggggcgaaggctagggaaggggatagagggaggtcgctgcggggagggggacagaggcaggcacagagtcctaaagagatttgagactcgcgctcctgcactttctatcccacgcgcccccatccgaggggacctcacccctgggaagactccaataaatgcaacccggcgccactcgattccgggataatttttaa

SEQ ID NO: 92184 - DNA, 30 bp, Homo sapiens; identical to SEQ ID NO: 28888
  misc_feature 1..30: note = chr4:41881717-41881747
  misc_feature 1..30: note = hyper
  source 1..30: mol_type = genomic DNA

SEQ ID NO: 92185 - DNA, 15 bp, Homo sapiens
  misc_feature 1..15: note = chr4:41882098-41882113
  misc_feature 1..15: note = hyper
  source 1..15: mol_type = genomic DNA
agagtatcacaagcc

SEQ ID NO: 92186 - DNA, 102 bp, Homo sapiens
  misc_feature 1..102: note = chr4:41882162-41882264
  misc_feature 1..102: note = hyper
  source 1..102: mol_type = genomic DNA
cgccctgccgcggaaacccttcccgtggcctcgaactggtccccgacgactgcggggtacgcggggcccaaagccagactctactcccgcgcagatgcggga

SEQ ID NO: 92187 - skipped

SEQ ID NO: 92188 - DNA, 1552 bp, Homo sapiens
  misc_feature 1..1552: note = chr4:41882880-41884432
  misc_feature 1..1552: note = hyper
  source 1..1552: mol_type = genomic DNA
gtcagataacaagctcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 92189 - DNA, 30 bp, Homo sapiens
  misc_feature 1..30: note = chr4:41993805-41993835
  misc_feature 1..30: note = hypo
  source 1..30: mol_type = genomic DNA
cctcctgaaagaagtcggaagttgcagtca

SEQ ID NO: 92190 - DNA, 87 bp, Homo sapiens
  misc_feature 1..87: note = chr4:41994052-41994139
  misc_feature 1..87: note = hypo
  source 1..87: mol_type = genomic DNA
gacagaatgaatcatcggctgggtgcagtggctcatgctgctaatcctcaggaagattgtaaaccttaggacgctgaggtgggtgga

SEQ ID NO: 92191 - DNA, 64 bp, Homo sapiens
  misc_feature 1..64: note = chr4:42152702-42152766
  misc_feature 1..64: note = hyper
  source 1..64: mol_type = genomic DNA
ctcaggctgtggcctcgcaaccagcccatctcgctccctgcaggcaggcagtgggctgctttgc

SEQ ID NO: 92192 - DNA, 451 bp, Homo sapiens; identical to SEQ ID NO: 365
  misc_feature 1..451: note = chr4:42152961-42153412
  misc_feature 1..451: note = hyper
  source 1..451: mol_type = genomic DNA

SEQ ID NO: 92193 - DNA, 101 bp, Homo sapiens; identical to SEQ ID NO: 366
  misc_feature 1..101: note = chr4:42153532-42153633
  misc_feature 1..101: note = hyper
  source 1..101: mol_type = genomic DNA

SEQ ID NO: 92194 - DNA, 504 bp, Homo sapiens; identical to SEQ ID NO: 367
  misc_feature 1..504: note = chr4:42153881-42154385
  misc_feature 1..504: note = hyper
  source 1..504: mol_type = genomic DNA

SEQ ID NO: 92195 - DNA, 711 bp, Homo sapiens; identical to SEQ ID NO: 28895
  misc_feature 1..711: note = chr4:42154386-42155097
  misc_feature 1..711: note = hyper
  source 1..711: mol_type = genomic DNA

SEQ ID NO: 92196 - DNA, 151 bp, Homo sapiens; identical to SEQ ID NO: 40286
  misc_feature 1..151: note = chr4:42200720-42200871
  misc_feature 1..151: note = hypo
  source 1..151: mol_type = genomic DNA

SEQ ID NO: 92197 - DNA, 30 bp, Homo sapiens
  misc_feature 1..30: note = chr4:4221107-4221137
  misc_feature 1..30: note = hypo
  source 1..30: mol_type = genomic DNA
tccttcctcctttatcgctacatatgataa

SEQ ID NO: 92198 - DNA, 183 bp, Homo sapiens
  misc_feature 1..183: note = chr4:4227985-4228168
  misc_feature 1..183: note = hyper
  source 1..183: mol_type = genomic DNA
aggaggctcctgcggcgacccaagcttcagagagagagagaggaaaggaagggcagacaggaaagctaggaaagatgcacagagagaccaaggcagaaaaggctgaagggaagacggcagcggtaggaagggcgcagagcagcctcaggatgcagccagcgggcgaggaggcggagacccgct

SEQ ID NO: 92199 - DNA, 87 bp, Homo sapiens; identical to SEQ ID NO: 7235
  misc_feature 1..87: note = chr4:4228188-4228275
  misc_feature 1..87: note = hyper
  source 1..87: mol_type = genomic DNA

SEQ ID NO: 92200 - DNA, 56 bp, Homo sapiens
  misc_feature 1..56: note = chr4:4229330-4229386
  misc_feature 1..56: note = hyper
  source 1..56: mol_type = genomic DNA
ctgtactcgtccctgcgtatttctgtattgtcttctctgtgcgggtcactctgtgt

SEQ ID NO: 92201 - DNA, 362 bp, Homo sapiens
  misc_feature 1..362: note = chr4:4229586-4229948
  misc_feature 1..362: note = hyper
  source 1..362: mol_type = genomic DNA
caaaggagcggcagccgttctggacccagaggagctggaatgagggacgccccggggtctgccctgttgctaccggcgcccaagcgtcttcactagccccttccaaagccccggtgcccgcctggcacccgcctgctcccggaaggggactgagtctgccagggagccccgctcgggtgccgctaagtggaggtctgggaagtttcagctgaagagcgttctacgggtctggcgtggctgacaggaggcgccggaccccagccccccagccgcaggttggagaggggagttgggagcgagcctggggcaagcccacatcccaccgtgcagcagcccggggctgggcccggaagacaccctct

SEQ ID NO: 92202 - DNA, 65 bp, Homo sapiens
  misc_feature 1..65: note = chr4:42316016-42316081
  misc_feature 1..65: note = hypo
  source 1..65: mol_type = genomic DNA
attcccctctgggggcggtctctggttctctctagtgaggcggcgtgccccgcccccctgtggcg

SEQ ID NO: 92203 - DNA, 29 bp, Homo sapiens
  misc_feature 1..29: note = chr4:42317313-42317342
  misc_feature 1..29: note = hypo
  source 1..29: mol_type = genomic DNA
gcccagagggagctcgtccccagatcaag

SEQ ID NO: 92204 - DNA, 2249 bp, Homo sapiens
  misc_feature 1..2249: note = chr4:42398808-42401057
  misc_feature 1..2249: note = hyper
  source 1..2249: mol_type = genomic DNA
tatttcctttgcgggcgtgaacggagaagtcgtgctctttgaggttttgcgagctggccttggctggcagaggtgaccggcaatccttcagccggcggaaaaagtgcgagtgtgtgtgtgtgtgtgcttgtgaaaatgtgccgttcctcccagaaaaagtggaaacgtaggtggaaagctcagcacatgttggcgacacctaaaaaccatgttctcggtcctgaacctttagaagcggtatcccaggaacgagtctgagtctgtgcaacagggcacagatgattcgacaaacttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggagttggcagccccgggcgctatggctcccttgaggagtggggagggaggtggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatcaagggatgagtgggtggtcgcgtttcagatcatggtcctctattcatttgcagtcccgcttcccgccacttgcggtctctgcgggtcggcccgcagggaaagtttgccagggacagtgaggagcgcggggcttgtgcctggtagccggggggaagacagctggagctcccgggagaagggtagtgcgggtaaagccagggtagacttgggttttggtggaggggccgagggtgtcccattgctcgcccttgtcacttcgggagcttcgggaagtgccgaatgcagggaatcgcgactcttgtcgcgcgctcatttgcagcccttcagggctaagaaaccccagtcactttttttttctgtcttaatgatagcgtttctaagccacggccccgttctgcagacttcctttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtcaaatttccg

SEQ ID NO: 92205 - DNA, 30 bp, Homo sapiens
  misc_feature 1..30: note = chr4:42442205-42442235
  misc_feature 1..30: note = hypo
  source 1..30: mol_type = genomic DNA
accactgctgccctccgggccccacacacc

SEQ ID NO: 92206 - DNA, 23 bp, Homo sapiens
  misc_feature 1..23: note = chr4:4251225-4251248
  misc_feature 1..23: note = hypo
  source 1..23: mol_type = genomic DNA
gaaaagagtgccagccgcgcgcg

SEQ ID NO: 92207 - DNA, 30 bp, Homo sapiens; identical to SEQ ID NO: 40236
  misc_feature 1..30: note = chr4:4251746-4251776
  misc_feature 1..30: note = hypo
  source 1..30: mol_type = genomic DNA

SEQ ID NO: 92208 - DNA, 82 bp, Homo sapiens; identical to SEQ ID NO: 14678
  misc_feature 1..82: note = chr4:4256159-4256241
  misc_feature 1..82: note = hypo
  source 1..82: mol_type = genomic DNA

SEQ ID NO: 92209 - DNA, 1045 bp, Homo sapiens; identical to SEQ ID NO: 28724
  misc_feature 1..1045: note = chr4:4387460-4388505
  misc_feature 1..1045: note = hyper
  source 1..1045: mol_type = genomic DNA

SEQ ID NO: 92210 - DNA, 505 bp, Homo sapiens; identical to SEQ ID NO: 28725
  misc_feature 1..505: note = chr4:4388506-4389011
  misc_feature 1..505: note = hyper
  source 1..505: mol_type = genomic DNA

SEQ ID NO: 92211 - DNA, 66 bp, Homo sapiens
  misc_feature 1..66: note = chr4:4389231-4389297
  misc_feature 1..66: note = hyper
  source 1..66: mol_type = genomic DNA
tcgcggacgccgggacgccggtgggtgtgggtgcccacttcccccccgccccgccccgggtcttgc

SEQ ID NO: 92212 - DNA, 30 bp, Homo sapiens
  misc_feature 1..30: note = chr4:4389764-4389794
  misc_feature 1..30: note = hyper
  source 1..30: mol_type = genomic DNA
agagggccctggccccgcagctgccctgct

SEQ ID NO: 92213 - DNA, 448 bp, Homo sapiens
  misc_feature 1..448: note = chr4:4417485-4417933
  misc_feature 1..448: note = hypo
  source 1..448: mol_type = genomic DNA
gactctgctgggtgccgaggtgggagggaagaggggaacccttggtccgtttccctgagggatgacgagcagcagatggagaggacagcgtgaaggggcgtggcggtgaggctggaggggagtttgtctggcctgcagagcctccttcctgatgcacgcgctgctggtctgaatgggctgtttgttctgtagcgtgtcaggtgcttcccgacgtcctggtgggactgagatcaagacgctgttgataaaagggctgtacttcagtggtgtcttttggctttcttttctgtccacactgtgacctggggcacatcctggcttctttacttgagccactgtgcattgacttgagtcctcagcaacacggtggtgtgactcattggccgcattttataggtgagggacctgagattgagagagaaaacactccgcacgtgaactcagctgg

SEQ ID NO: 92214 - DNA, 53 bp, Homo sapiens
  misc_feature 1..53: note = chr4:44448607-44448660
  misc_feature 1..53: note = hyper
  source 1..53: mol_type = genomic DNA
gaactccacatagcccgctccggaagcgcactgcaaaacgcaccccagatgct

SEQ ID NO: 92215 - DNA, 107 bp, Homo sapiens
  misc_feature 1..107: note = chr4:44448966-44449073
  misc_feature 1..107: note = hyper
  source 1..107: mol_type = genomic DNA
ccctttccccacacccgctctcatgcccccgccccctcgaggggctctgggggcacctttatcgcttctcccctgccctctagaaaaccacccgtaactggaggctc

SEQ ID NO: 92216 - DNA, 133 bp, Homo sapiens
  misc_feature 1..133: note = chr4:44449437-44449570
  misc_feature 1..133: note = hyper
  source 1..133: mol_type = genomic DNA
tcgtgcagggagagccgctctctataaggagttaaccagcgcctgccccggacacccccgcggggcctccagcggggctcaaactggcggcggctcagcagggggcgaggggtgctgggaaacgccggggctg

SEQ ID NO: 92217 - DNA, 91 bp, Homo sapiens; identical to SEQ ID NO: 28901
  misc_feature 1..91: note = chr4:44449652-44449743
  misc_feature 1..91: note = hyper
  source 1..91: mol_type = genomic DNA

SEQ ID NO: 92218 - DNA, 206 bp, Homo sapiens; identical to SEQ ID NO: 28902
  misc_feature 1..206: note = chr4:44449971-44450177
  misc_feature 1..206: note = hyper
  source 1..206: mol_type = genomic DNA

SEQ ID NO: 92219 - DNA, 373 bp, Homo sapiens
  misc_feature 1..373: note = chr4:44450741-44451114
  misc_feature 1..373: note = hyper
  source 1..373: mol_type = genomic DNA
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagagg

SEQ ID NO: 92220 - DNA, 52 bp, Homo sapiens
  misc_feature 1..52: note = chr4:45473410-45473462
  misc_feature 1..52: note = hypo
  source 1..52: mol_type = genomic DNA
tgtcacagcagtctgcgtcatcgggatttgggaaagccgccctcaccaagtc

SEQ ID NO: 92221 - DNA, 20 bp, Homo sapiens
  misc_feature 1..20: note = chr4:46067754-46067774
  misc_feature 1..20: note = hypo
  source 1..20: mol_type = genomic DNA
tttgagacagagtctcgctc

SEQ ID NO: 92222 - DNA, 146 bp, Homo sapiens
  misc_feature 1..146: note = chr4:4614181-4614327
  misc_feature 1..146: note = hypo
  source 1..146: mol_type = genomic DNA
taaaggtacagcctccgcagccctccagagcagctggatcaggaagcccagtgtcggtggggtctttacttaagcagacagaatagttatcctcaacacgtgacatgtgtctagcccccactgtgtctgctcgctccagccaagtg

SEQ ID NO: 92223 - DNA, 32 bp, Homo sapiens; identical to SEQ ID NO: 28904
  misc_feature 1..32: note = chr4:46391678-46391710
  misc_feature 1..32: note = hyper
  source 1..32: mol_type = genomic DNA

SEQ ID NO: 92224 - DNA, 98 bp, Homo sapiens
  misc_feature 1..98: note = chr4:46392417-46392515
  misc_feature 1..98: note = hyper
  source 1..98: mol_type = genomic DNA
gcttgctggggctcccgagaggccccaaggttcctgacagagctgctgttgggtgttggtgtaaagccgggaatgtagtgtggcggtgatgccctaga

SEQ ID NO: 92225 - DNA, 41 bp, Homo sapiens
  misc_feature 1..41: note = chr4:4675041-4675082
  misc_feature 1..41: note = hypo
  source 1..41: mol_type = genomic DNA
cgcccacctcctcctcggaccacgcccgttctcctcacgcc

SEQ ID NO: 92226 - DNA, 37 bp, Homo sapiens
  misc_feature 1..37: note = chr4:46783708-46783745
  misc_feature 1..37: note = hypo
  source 1..37: mol_type = genomic DNA
tgggaacctgggctgcgcctggcgctcaccagccagc

SEQ ID NO: 92227 - DNA, 37 bp, Homo sapiens
  misc_feature 1..37: note = chr4:46806970-46807007
  misc_feature 1..37: note = hypo
  source 1..37: mol_type = genomic DNA
gtgggctgcgggtcccgagccctgccgcatgggaggc

SEQ ID NO: 92228 - DNA, 1001 bp, Homo sapiens
  misc_feature 1..1001: note = chr4:46994820-46995821
  misc_feature 1..1001: note = hyper
  source 1..1001: mol_type = genomic DNA
ttgcgcgtttgaaatcgttcatacccccaaatccaggacgcagcctgttgtcataaccatcgagcaaactgtccaggatgcgggtgaaattttctgtgcacaatttctcctccttttggttctgtcctggggattcgtttaaactgcaagcgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 92229 - DNA, 567 bp, Homo sapiens; identical to SEQ ID NO: 2412
  misc_feature 1..567: note = chr4:46995822-46996389
  misc_feature 1..567: note = hyper
  source 1..567: mol_type = genomic DNA

SEQ ID NO: 92230 - DNA, 57 bp, Homo sapiens
  misc_feature 1..57: note = chr4:47033544-47033601
  misc_feature 1..57: note = hyper
  source 1..57: mol_type = genomic DNA
tcttttggtagtgagcgcgctctgcgcatgcgcaggtccattcgggaattactgccc

SEQ ID NO: 92231 - DNA, 742 bp, Homo sapiens
  misc_feature 1..742: note = chr4:47034011-47034753
  misc_feature 1..742: note = hyper
  source 1..742: mol_type = genomic DNA
ggacttcggaggtaacgcttcatcttttttcaacctgtaacccatccttagttctccttttctgtcaaagataaatgtcaaaaaaaaaaaaagaaaaggcatgtcattttcgtaagcgtgcactataccctgggcacacacacacacacacacacacacacacacaccccgggtccccagtctcaggtggatgaatcctcaggcggaggcgaccttctcccgggccgacacaccctctgcatagtcactgcatcacgcgtgtgcccacacctgttttcccaggcagtcccctgaaaggggtggtggggggagcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 92232 - DNA, 222 bp, Homo sapiens; identical to SEQ ID NO: 28910
  misc_feature 1..222: note = chr4:47034754-47034976
  misc_feature 1..222: note = hyper
  source 1..222: mol_type = genomic DNA

SEQ ID NO: 92233 - DNA, 37 bp, Homo sapiens
  misc_feature 1..37: note = chr4:4753216-4753253
  misc_feature 1..37: note = hypo
  source 1..37: mol_type = genomic DNA
gtgcccttctccagacgcatgccgcttcttggatttt

SEQ ID NO: 92234 - DNA, 263 bp, Homo sapiens
  misc_feature 1..263: note = chr4:47839267-47839530
  misc_feature 1..263: note = hyper
  source 1..263: mol_type = genomic DNA
tgccagcacttaggacgggcgagtgatccccaggcaccaactgggggccggggaaccaagcgcgagcccgggctgtggagggaccgacacccaggcgctcgcagctggggaagggggcttacgtctggggcaggcaagactgctgcacagtccctccagccacccggcgcccgagacgccggcgcagacaggaagctgtagatccccgaggggctggctccgacagctccacctgcagcctcccctgccgccagtgtgcagcc

SEQ ID NO: 92235 - DNA, 38 bp, Homo sapiens
  misc_feature 1..38: note = chr4:47915048-47915086
  misc_feature 1..38: note = hypo
  source 1..38: mol_type = genomic DNA
aaagtttaccaaacctgttcacacgtctccatattgta

SEQ ID NO: 92236 - DNA, 92 bp, Homo sapiens
  misc_feature 1..92: note = chr4:48378917-48379009
  misc_feature 1..92: note = hypo
  source 1..92: mol_type = genomic DNA
gcgcccggccgactttttttttttttttttttttaaggatttcccatgtcttgaccttaaactggcttaataatagtcggtattgctttaaa

SEQ ID NO: 92237 - DNA, 34 bp, Homo sapiens; identical to SEQ ID NO: 28912
  misc_feature 1..34: note = chr4:48485255-48485289
  misc_feature 1..34: note = hyper
  source 1..34: mol_type = genomic DNA

SEQ ID NO: 92238 - DNA, 897 bp, Homo sapiens
  misc_feature 1..897: note = chr4:48485589-48486486
  misc_feature 1..897: note = hyper
  source 1..897: mol_type = genomic DNA
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcaggtacggatctgtctattccttgggcatctgtctcatcccagacgcgcgtttacggccgtgggctcacgacgaaggacagaggcagtggaggggttggaattaggcgtggaggaaggaggagaaaaggagaggaagttgatgacgccccggctttagaagtcaaggccgacctgcaggttgtgctgctaggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 92239 - DNA, 439 bp, Homo sapiens
  misc_feature 1..439: note = chr4:48492180-48492619
  misc_feature 1..439: note = hyper
  source 1..439: mol_type = genomic DNA
cggtggcaggaagggcgtggagggcggtgcagcgtgcgagcccccgccgagggccatccccgcctccgctcggccgcccgggcaagtcgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 92240 - DNA, 38 bp, Homo sapiens
  misc_feature 1..38: note = chr4:4854394-4854432
  misc_feature 1..38: note = hyper
  source 1..38: mol_type = genomic DNA
gcggtgggctgcctgcgggttcccggtgaccctttccc

SEQ ID NO: 92241 - DNA, 523 bp, Homo sapiens; identical to SEQ ID NO: 28728
  misc_feature 1..523: note = chr4:4854669-4855192
  misc_feature 1..523: note = hyper
  source 1..523: mol_type = genomic DNA

SEQ ID NO: 92242 - DNA, 487 bp, Homo sapiens
  misc_feature 1..487: note = chr4:4855230-4855717
  misc_feature 1..487: note = hyper
  source 1..487: mol_type = genomic DNA
cgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggagcataagagaaaagtagtgagtacgggcccaaagacccatttcgtggattgggggagggacggggaggctgttcc

SEQ ID NO: 92243 - DNA, 173 bp, Homo sapiens
  misc_feature 1..173: note = chr4:4858694-4858867
  misc_feature 1..173: note = hyper
  source 1..173: mol_type = genomic DNA
agtctgcctattaggcgcgctgaggaatcgtgacacattgtttatccccgcaattagcgatgcggcccttttcaggccgcccgcccccgggccccccgcccccccccccccccccgcggcggagtccaggccttgctgcgctcctcaactgcgaccgccgcaagttccacact

SEQ ID NO: 92244 - DNA, 125 bp, Homo sapiens
  misc_feature 1..125: note = chr4:4859646-4859771
  misc_feature 1..125: note = hyper
  source 1..125: mol_type = genomic DNA
gaggccccggtgcaccgcgcgtccagccggcccaactcgagctagaagccccaaccactgcccagtgcctgagttgcagtcttgggtcctttagaaacctggagatgtgcgtaaaattcagatgc

SEQ ID NO: 92245 - DNA, 15 bp, Homo sapiens
  misc_feature 1..15: note = chr4:4859810-4859825
  misc_feature 1..15: note = hyper
  source 1..15: mol_type = genomic DNA
cggcctgtggacaga

SEQ ID NO: 92246 - DNA, 51 bp, Homo sapiens
  misc_feature 1..51: note = chr4:4861085-4861136
  misc_feature 1..51: note = hyper
  source 1..51: mol_type = genomic DNA
gcagaagagaaggaacgagaacaagggaaaatcccccgggaacacagaaag

SEQ ID NO: 92247 - DNA, 226 bp, Homo sapiens; identical to SEQ ID NO: 28731
  misc_feature 1..226: note = chr4:4861342-4861568
  misc_feature 1..226: note = hyper
  source 1..226: mol_type = genomic DNA

SEQ ID NO: 92248 - DNA, 1532 bp, Homo sapiens
  misc_feature 1..1532: note = chr4:4861780-4863312
  misc_feature 1..1532: note = hyper
  source 1..1532: mol_type = genomic DNA
ccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccagtgagtagccagaacccaggcgcagagggagggggccgggtgggggccgggtggggtgtgggacccgagggctcctggtggcctccggcgcctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgtggtgcggtatcttccctgcacccggagtttcactttctcgcagtaggagctggtgtcccccagcccctcttccctttcaagtacctctttgcctagaggttccgaagctcctacagaattctacctccccatgccctttgagtttgaggcagatagttggtgctttgggcggatggatgattcaggggtggggacattcaggttccagtggagggggcggggcaccaagtcaattaggggaaggcgcccccgctaatcctatgggaagctcccaaacgtctaggactgagccattaaagtggactccaggtgcccaaggcggttcgctccaaggcctcacggccccctggctgctctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggcccggcggaaagctagttgggggccaagcgcttcccggactcccggtggcctccagcagggaagaagcggggtgttaacacgagatttcgtttgactcacatcctggtggtctgaaagtccaaaggatcgttgtgttttctttgttttgttttgttttttctgtttgtttgtggttgttttttagagaggtgtgaaaaaatgcatacttaggcaaaacccgcgtggtgaaacatcttcgatttgaattcact

SEQ ID NO: 92249 - DNA, 185 bp, Homo sapiens; identical to SEQ ID NO: 28735
  misc_feature 1..185: note = chr4:4867591-4867776
  misc_feature 1..185: note = hyper
  source 1..185: mol_type = genomic DNA

SEQ ID NO: 92250 - DNA, 98 bp, Homo sapiens
  misc_feature 1..98: note = chr4:4868024-4868122
  misc_feature 1..98: note = hyper
  source 1..98: mol_type = genomic DNA
tccatcccagtccttcgaactgtgttccctggtttatcaaccgagggcggagtgggcaggggtttcctgggtctgttcctttacggaccaatttcctt

SEQ ID NO: 92251 - DNA, 256 bp, Homo sapiens
  misc_feature 1..256: note = chr4:4868537-4868793
  misc_feature 1..256: note = hyper
  source 1..256: mol_type = genomic DNA
gaggaatgataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 92252 - DNA, 172 bp, Homo sapiens; identical to SEQ ID NO: 2363
  misc_feature 1..172: note = chr4:4868828-4869000
  misc_feature 1..172: note = hyper
  source 1..172: mol_type = genomic DNA

SEQ ID NO: 92253 - DNA, 127 bp, Homo sapiens; identical to SEQ ID NO: 2364
  misc_feature 1..127: note = chr4:4869131-4869258
  misc_feature 1..127: note = hyper
  source 1..127: mol_type = genomic DNA

SEQ ID NO: 92254 - DNA, 43 bp, Homo sapiens
  misc_feature 1..43: note = chr4:4869481-4869524
  misc_feature 1..43: note = hyper
  source 1..43: mol_type = genomic DNA
cgcacacgaccaacacacgtcatccacacgacataccaacaca

SEQ ID NO: 92255 - DNA, 189 bp, Homo sapiens
  misc_feature 1..189: note = chr4:4870045-4870234
  misc_feature 1..189: note = hyper
  source 1..189: mol_type = genomic DNA
gctcagagcacaaggcgtgagagcgctgggtgctctgctgtgctgacaccagagggtaagcgcggattctggctccacgcacgtggggtcaatccccggacacagaccttttactggaaggcctggagaatcgcctgagggaacgctgggagttcccccccccacccgcccccgcgcaagaacagccag

SEQ ID NO: 92256 - DNA, 69 bp, Homo sapiens
  misc_feature 1..69: note = chr4:4871315-4871384
  misc_feature 1..69: note = hyper
  source 1..69: mol_type = genomic DNA
gagctgccccaagggcgggctggactctagtgctttgagtcgctgtttctctgacgatgctgcttttaa

SEQ ID NO: 92257 - DNA, 278 bp, Homo sapiens
  misc_feature 1..278: note = chr4:4871754-4872032
  misc_feature 1..278: note = hyper
  source 1..278: mol_type = genomic DNA
cgcgggttatcccaacgaatcctcactaccaggtgggcacgtgccattgtgacccgtgtcatagactgaagcatagagagttgaatgactcagacaagatcacacagctagtgagagtgaaacagagcttccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggag

SEQ ID NO: 92258 - DNA, 156 bp, Homo sapiens
  misc_feature 1..156: note = chr4:4872059-4872215
  misc_feature 1..156: note = hyper
  source 1..156: mol_type = genomic DNA
cggagcatagaggcaggatggtgacctgagcgctctttgctggccggctctgctctccgcagcgccattggaattccttactctccagtcccccgagggtgtgtgtgggtgaggggaggtccctgaggcggaagggatgagcggagtggaagcgga

SEQ ID NO: 92259 - DNA, 34 bp, Homo sapiens
  misc_feature 1..34: note = chr4:4872457-4872491
  misc_feature 1..34: note = hyper
  source 1..34: mol_type = genomic DNA
aaagcagccaacagccgaccggcaactgggaagc

SEQ ID NO: 92260 - DNA, 132 bp, Homo sapiens
  misc_feature 1..132: note = chr4:4872777-4872909
  misc_feature 1..132: note = hyper
  source 1..132: mol_type = genomic DNA
ttaaattaattcattcggcggggttgaacaagaccagcacactaagaaataacgaattcgggtagagctgaatgcttctaaggggaaaagtaacaagacgggggcaggaagcacagtcggagcctatttttg

SEQ ID NO: 92261 - DNA, 342 bp, Homo sapiens
  misc_feature 1..342: note = chr4:4873139-4873481
  misc_feature 1..342: note = hyper
  source 1..342: mol_type = genomic DNA
cgaggtagaaggggccgcgtgcccttgtaggagagggaagtgtcaatggccgggaccaggggtggctgcctgagacgtgcctcgtctttggtgattcccctacccccaaatcagagagggttccggaagaaacttcgcagccttgcagagtgaagcatcgccgggacccaaggatgtttctcttccctacggagctcacccggattccttggcgcccagctgcggccccggagtccccgaactcggctgtgccagcccggggcggggccagctgaacctcagttgtggggcggagtccgttgcggacaccctcaccccccgggcaaccgcagctcccaactc

SEQ ID NO: 92262 - DNA, 30 bp, Homo sapiens
  misc_feature 1..30: note = chr4:48946783-48946813
  misc_feature 1..30: note = hypo
  source 1..30: mol_type = genomic DNA
aaatgaggctggctccgggtatgttgacaa

SEQ ID NO: 92263 - DNA, 213 bp, Homo sapiens; identical to SEQ ID NO: 28916
  misc_feature 1..213: note = chr4:48987912-48988125
  misc_feature 1..213: note = hyper
  source 1..213: mol_type = genomic DNA

SEQ ID NO: 92264 - DNA, 68 bp, Homo sapiens; identical to SEQ ID NO: 28917
  misc_feature 1..68: note = chr4:48988465-48988533
  misc_feature 1..68: note = hyper
  source 1..68: mol_type = genomic DNA

SEQ ID NO: 92265 - DNA, 121 bp, Homo sapiens
  misc_feature 1..121: note = chr4:5052435-5052556
  misc_feature 1..121: note = hyper
  source 1..121: mol_type = genomic DNA
cgtcctgggaacccgcgctcgccccacacgtcttggggcgcatctgccgcaccccttacttaggcacccgcaactgtggcgcgtatctcccgatccaggctcccgccgcaggagcccaggg

SEQ ID NO: 92266 - DNA, 1260 bp, Homo sapiens
  misc_feature 1..1260: note = chr4:5052845-5054105
  misc_feature 1..1260: note = hyper
  source 1..1260: mol_type = genomic DNA
gcaaatacaggctagcggggagtcctgggactcccttcgcagccggggccgactaaccacagacctaagagcccctctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 92267 - DNA, 172 bp, Homo sapiens
  misc_feature 1..172: note = chr4:5160791-5160963
  misc_feature 1..172: note = hypo
  source 1..172: mol_type = genomic DNA
aagctttggccaacacgggctagaactcactgacaagcggcaggaggacactgcttctcagctccccatgggcagggctgcttggctggagcacggctgggacaccgtagagctgtgcttaccaagggggtgccccatggtgcagtctctctgtgtacgctgactgaggaaa

SEQ ID NO: 92268 - DNA, 174 bp, Homo sapiens
  misc_feature 1..174: note = chr4:5171284-5171458
  misc_feature 1..174: note = hypo
  source 1..174: mol_type = genomic DNA
gaaaatcaaggtgtgcgtgccaggtgccacagacatgggcattgccatggagaaaacccaaaccaaaccttgtctgctggagtctcagtatccaccgagagttcttcgtgtctctgtgcagtgatctaaaaactttgattgtttgggagaaataaaccccgtcatgttttgatt

SEQ ID NO: 92269 - DNA, 39 bp, Homo sapiens
  misc_feature 1..39: note = chr4:52708566-52708605
  misc_feature 1..39: note = hyper
  source 1..39: mol_type = genomic DNA
gaggaaagaagtgtgcgaactctgcgaaacaagtatgcg

SEQ ID NO: 92270 - DNA, 23 bp, Homo sapiens
  misc_feature 1..23: note = chr4:52892709-52892732
  misc_feature 1..23: note = hypo
  source 1..23: mol_type = genomic DNA
atcgcgcccggcctaaattgctt

SEQ ID NO: 92271 - DNA, 140 bp, Homo sapiens
  misc_feature 1..140: note = chr4:52917545-52917685
  misc_feature 1..140: note = hyper
  source 1..140: mol_type = genomic DNA
ccctggcagccaacccgtccacgtcaaggtttgtttaataatcgccagggtatctatggccgggctcaggcggctgctggggagccaggagaccgcgcgggacggcggatgaggcgcggcggctgcggcccagggcacct

SEQ ID NO: 92272 - DNA, 123 bp, Homo sapiens
  misc_feature 1..123: note = chr4:52917964-52918087
  misc_feature 1..123: note = hyper
  source 1..123: mol_type = genomic DNA
tgggtgaaaaacccccggggttcgccctcccataggttccagcacagcccttgtcggggatttcttagggctggagttggtggccactttgcaaagcctccgcggttgcgattcctaaccagg

SEQ ID NO: 92273 - DNA, 159 bp, Homo sapiens
  misc_feature 1..159: note = chr4:53617401-53617560
  misc_feature 1..159: note = hyper
  source 1..159: mol_type = genomic DNA
ggcagcagaggagctcggggcgggcaaagctcgaggggacacggggcgagcccagaccctgcctgggagccctccccgccggagaccaaagggcagaaacgcactcacagtgcaactccgagggataaactggccgacgatcgccgccaggccagaaga

SEQ ID NO: 92274 - DNA, 106 bp, Homo sapiens
  misc_feature 1..106: note = chr4:53617801-53617907
  misc_feature 1..106: note = hyper
  source 1..106: mol_type = genomic DNA
gactctgggcgagggcggggctgggaggagggccgcggggcaggcagccaatcccaggaaacttcgggacgagggcaggacgggggctggacgggcccagccattg

SEQ ID NO: 92275 - DNA, 960 bp, Homo sapiens
  misc_feature 1..960: note = chr4:53728037-53728997
  misc_feature 1..960: note = hyper
  source 1..960: mol_type = genomic DNA
cgctccaaatcagggcgggcggcactaagccggggagcaaacaccgctcccggcccgcccagagcagacgccctaggttggggctgcagcgagtgcgcgcgtgggctgtggagccggcggaggcagcggtccggaatggctctgtggaggctgcgctctcttcctggccccgcagccacagcagctgccccatgctcgcgcggcaggacctaccaggcgcccaccctgggctgcgccgcctcggaccacccgctgctcccctccgcccgctgcctcttctccccgcgcctcacggggctccgcactgactccaggcgcctccgggggcgtcgcgcgcgcggagcggcgccgggggcggggcctcgtgtagggcgccccgggattggctgtggggagagggggcggggccggccgcggagaaaacagccggcgcgccgcgcgagtgcagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacag

SEQ ID NO: 92276 - DNA, 30 bp, Homo sapiens; identical to SEQ ID NO: 40240
  misc_feature 1..30: note = chr4:5458789-5458819
  misc_feature 1..30: note = hypo
  source 1..30: mol_type = genomic DNA

SEQ ID NO: 92277 - DNA, 30 bp, Homo sapiens
  misc_feature 1..30: note = chr4:5464682-5464712
  misc_feature 1..30: note = hypo
  source 1..30: mol_type = genomic DNA
caggctctgctgagccgggagtaaaggttt

SEQ ID NO: 92278 - DNA, 30 bp, Homo sapiens
  misc_feature 1..30: note = chr4:54858212-54858242
  misc_feature 1..30: note = hypo
  source 1..30: mol_type = genomic DNA
atgacagagagtagacgaagttgatacgat

SEQ ID NO: 92279 - DNA, 40 bp, Homo sapiens
  misc_feature 1..40: note = chr4:54957438-54957478
  misc_feature 1..40: note = hyper
  source 1..40: mol_type = genomic DNA
ccaggaccagcagagcgggtctgcgcggacagaggcactg

SEQ ID NO: 92280 - DNA, 1712 bp, Homo sapiens
  misc_feature 1..1712: note = chr4:54965799-54967511
  misc_feature 1..1712: note = hyper
  source 1..1712: mol_type = genomic DNA
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagggaggcgatcagatagtgca

SEQ ID NO: 92281 - DNA, 24 bp, Homo sapiens
  misc_feature 1..24: note = chr4:54969747-54969771
  misc_feature 1..24: note = hyper
  source 1..24: mol_type = genomic DNA
gagtgttgtctttagcgcgcgcgc

SEQ ID NO: 92282 - DNA, 684 bp, Homo sapiens; identical to SEQ ID NO: 28926
  misc_feature 1..684: note = chr4:54969831-54970515
  misc_feature 1..684: note = hyper
  source 1..684: mol_type = genomic DNA

SEQ ID NO: 92283 - DNA, 164 bp, Homo sapiens; identical to SEQ ID NO: 28927
  misc_feature 1..164: note = chr4:54975768-54975932
  misc_feature 1..164: note = hyper
  source 1..164: mol_type = genomic DNA

SEQ ID NO: 92284 - DNA, 126 bp, Homo sapiens; identical to SEQ ID NO: 370
  misc_feature 1..126: note = chr4:54975990-54976116
  misc_feature 1..126: note = hyper
  source 1..126: mol_type = genomic DNA

SEQ ID NO: 92285 - DNA, 78 bp, Homo sapiens
  misc_feature 1..78: note = chr4:54976170-54976248
  misc_feature 1..78: note = hyper
  source 1..78: mol_type = genomic DNA
cgtgggaaagagacgtgggaagggcatagccggattatccactcagctccaattttctccaagcgccactcaccccac

SEQ ID NO: 92286 - DNA, 22 bp, Homo sapiens
  misc_feature 1..22: note = chr4:55012635-55012657
  misc_feature 1..22: note = hypo
  source 1..22: mol_type = genomic DNA
ttttttcagagggagcgtcgct

SEQ ID NO: 92287 - DNA, 926 bp, Homo sapiens
  misc_feature 1..926: note = chr4:55092907-55093833
  misc_feature 1..926: note = hyper
  source 1..926: mol_type = genomic DNA
aggggagaaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 92288 - DNA, 123 bp, Homo sapiens; identical to SEQ ID NO: 7383
  misc_feature 1..123: note = chr4:55093888-55094011
  misc_feature 1..123: note = hyper
  source 1..123: mol_type = genomic DNA

SEQ ID NO: 92289 - DNA, 123 bp, Homo sapiens
  misc_feature 1..123: note = chr4:55094012-55094135
  misc_feature 1..123: note = hyper
  source 1..123: mol_type = genomic DNA
ggtcgcgtagaagaactgcggcaatgggacccccagcgcagccccaggcgccctgttttcgaggctgacatcccaagatcctgtcctggttaggcacagcaccgcgcccgttggagtacttct

SEQ ID NO: 92290 - DNA, 170 bp, Homo sapiens
  misc_feature 1..170: note = chr4:55094514-55094684
  misc_feature 1..170: note = hyper
  source 1..170: mol_type = genomic DNA
cgcggcgggagggaacggagggagaatcaaaaggcatcctcccccacgacgcggaggcggtggtacgattcctcaaacgcccaagcttgagctttttttgtatgcgagatagaagccagggcaacctcgcccagataaccccgaaaacaaaggcacgaccagataagtga

SEQ ID NO: 92291 - DNA, 58 bp, Homo sapiens; identical to SEQ ID NO: 28934
  misc_feature 1..58: note = chr4:55096214-55096272
  misc_feature 1..58: note = hyper
  source 1..58: mol_type = genomic DNA

SEQ ID NO: 92292 - DNA, 103 bp, Homo sapiens; identical to SEQ ID NO: 28935
  misc_feature 1..103: note = chr4:55096538-55096641
  misc_feature 1..103: note = hyper
  source 1..103: mol_type = genomic DNA

SEQ ID NO: 92293 - DNA, 60 bp, Homo sapiens; identical to SEQ ID NO: 28936
  misc_feature 1..60: note = chr4:55097404-55097464
  misc_feature 1..60: note = hyper
  source 1..60: mol_type = genomic DNA

SEQ ID NO: 92294 - DNA, 281 bp, Homo sapiens
  misc_feature 1..281: note = chr4:55097812-55098093
  misc_feature 1..281: note = hyper
  source 1..281: mol_type = genomic DNA
cgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggc

SEQ ID NO: 92295 - DNA, 591 bp, Homo sapiens
  misc_feature 1..591: note = chr4:55098197-55098788
  misc_feature 1..591: note = hyper
  source 1..591: mol_type = genomic DNA
cgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctg

SEQ ID NO: 92296 - DNA, 436 bp, Homo sapiens
  misc_feature 1..436: note = chr4:55099028-55099464
  misc_feature 1..436: note = hyper
  source 1..436: mol_type = genomic DNA
aggcgtaagccaccgcgcccggccaggaacggttcttaaatgccgagagggcgcatgctagctctcctcagcattcccggtgagccgctacccacggccgtgcggctctcgtgcccataggaggcgctggcgagctcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctc

SEQ ID NO: 92297 - DNA, 278 bp, Homo sapiens
  misc_feature 1..278: note = chr4:55100066-55100344
  misc_feature 1..278: note = hyper
  source 1..278: mol_type = genomic DNA
ggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatga

SEQ ID NO: 92298 - DNA, 30 bp, Homo sapiens
  misc_feature 1..30: note = chr4:552737-552767
  misc_feature 1..30: note = hypo
  source 1..30: mol_type = genomic DNA
ggatttccactgcagcgctgattagaatcg

SEQ ID NO: 92299 - DNA, 214 bp, Homo sapiens
  misc_feature 1..214: note = chr4:55350697-55350911
  misc_feature 1..214: note = hypo
  source 1..214: mol_type = genomic DNA
ggaactggtgaactccgccaacggacagccagcaggtgcacaaggtattcagaactctaaaagagcacgactctcatgaaagcaagctgcagcttgcaggaggcattaggtttacactttccacccctcctaccattgcaaacaagttattagcagttttacattttcccttaggggaatcagtgttaattcaccttggcgctattctggcacc

SEQ ID NO: 92300 - DNA, 184 bp, Homo sapiens
  misc_feature 1..184: note = chr4:55393636-55393820
  misc_feature 1..184: note = hypo
  source 1..184: mol_type = genomic DNA
atgaagagaactcaacgcccccgccgccccactcctcacgcttcctgatacattagggaacaccccttaagccataattgccgctggtgtcagtaaacattttaacaggcaaaaacatggccactgcacttctaagggaatctgagtctgtaaatgaagagaattctgtcgatactcacttcca

SEQ ID NO: 92301 - DNA, 33 bp, Homo sapiens
  misc_feature 1..33: note = chr4:55406440-55406473
  misc_feature 1..33: note = hypo
  source 1..33: mol_type = genomic DNA
aaaaatacacatttccggccgggcgcggtggct

SEQ ID NO: 92302 - DNA, 36 bp, Homo sapiens
  misc_feature 1..36: note = chr4:55456469-55456505
  misc_feature 1..36: note = hypo
  source 1..36: mol_type = genomic DNA
acaaatggaactaacctacagcgtgtattgtgtcga

SEQ ID NO: 92303 - DNA, 328 bp, Homo sapiens
  misc_feature 1..328: note = chr4:55523645-55523973
  misc_feature 1..328: note = hyper
  source 1..328: mol_type = genomic DNA
cccatgccacctccacgagcagcggcgtccagcctcctcccgcccgaacgtgctcgaggggcgggcagtcgacctttattgtctggggagcacctggcaggtggcgggcccgtgccctaacgtgtgcgtggtgcccagcttcacaaagcgagcgggcagcacctccttggtccgggaacggcctcagcctggccgtccacatcccaggggtggaaaggtggagagagaaaggggctccggagtcaagagcggggagagagggcgcgcgcgccctcctcctcccggcgggcacggccccccggcattaacacgtcgaaagagcaggggc

SEQ ID NO: 92304 - DNA, 74 bp, Homo sapiens
  misc_feature 1..74: note = chr4:55524220-55524294
  misc_feature 1..74: note = hyper
  source 1..74: mol_type = genomic DNA
ctgctcctactgcttcgcgtccagacaggtgggacaccgcggctggcaccccgaccgtgcgactactcggcgaa

SEQ ID NO: 92305 - DNA, 839 bp, Homo sapiens
  misc_feature 1..839: note = chr4:55524518-55525357
  misc_feature 1..839: note = hyper
  source 1..839: mol_type = genomic DNA
cgaggctgcaggctccgtgcgagtttggggtggcttttgtgccgacgttgcgcggggggcggaggcggggggctcaggggtttgcaccgagcgccttctcttgccgtgcgaggcgcggccgcagcttccttttgttaaaagttgcgtgtgtgtgaccggcgcccgggaggacctgcctgcaggttctccgccgcgctgagggcaaagttagagagccctttctctgctctgcggctactgccttccaaccgcaggcgctctttgtgcccagagctggggaccgacccgctgccgcctctgctcgcggcgccacccgtggagaccaatcgaaggctgcggcgtttccccgcctccgggttaggcttttgcgctgggagtgcgcggcgtggggctgttgtggggccggactcccgcgagcctggaggtggtggcgacagggacaacttgggcagggcgtgtggaaagcagccgctaggttgcagactttttgctttcgtacatcccgtgctcgcccctttctgccgcggcgccgtttcattcctgccgcgcgccccggggcggctggaggctgtgtttgccgcctgctccgggaaggcaagggacagcgtgctgggactctgcgttccctgactccaaccgcctagcacgccggccagagtgcccggcctgcctggcgggttctgaaagcccctagttcccggtgtctgcgacctgtattcgcaggtcctgttttcttcggaaatttttgagattcgtgaccgcccgcctccccgcccccgggacttctatacttcagggctgcctgggggtggggtgggagatggcgtggaactttctgc

SEQ ID NO: 92306 - DNA, 227 bp, Homo sapiens
  misc_feature 1..227: note = chr4:55990946-55991173
  misc_feature 1..227: note = hyper
  source 1..227: mol_type = genomic DNA
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaagagcctgagggtgtgtcggcatctcaggacatgctccagccgaggtccctgtcgcaaaccagagtcc

SEQ ID NO: 92307 - DNA, 39 bp, Homo sapiens
  misc_feature 1..39: note = chr4:55991454-55991493
  misc_feature 1..39: note = hyper
  source 1..39: mol_type = genomic DNA
ctgcatcctgcacctcgagccgggcgaaatgcccagaac

SEQ ID NO: 92308 - DNA, 227 bp, Homo sapiens
  misc_feature 1..227: note = chr4:55991863-55992090
  misc_feature 1..227: note = hyper
  source 1..227: mol_type = genomic DNA
cctcacccgggtacccggcggcgatctccagctccccaagcccatttacatctccccatttccccacacaactggactgcgctgggccccaagtcgcccaggagagaacatcccagagcaacaactttgtttctggtgtaaataaaaagtactcggtaacgggcgctgagcaactccaagatttaatcgcttgccggtccccgaaatttggggagcatcaccaggag

SEQ ID NO: 92309 - DNA, 69 bp, Homo sapiens
  misc_feature 1..69: note = chr4:55992152-55992221
  misc_feature 1..69: note = hyper
  source 1..69: mol_type = genomic DNA
cgcgcgtctgaagtggccgagaatctgcagcagtttggagccacaagggagaagcggatactcagccaa

SEQ ID NO: 92310 - DNA, 23 bp, Homo sapiens
  misc_feature 1..23: note = chr4:56213501-56213524
  misc_feature 1..23: note = hypo
  source 1..23: mol_type = genomic DNA
agatgcatcttaggccgggcgca

SEQ ID NO: 92311 - DNA, 30 bp, Homo sapiens
  misc_feature 1..30: note = chr4:56422506-56422536
  misc_feature 1..30: note = hypo
  source 1..30: mol_type = genomic DNA
gtcacgacgcctggccgccaaatactattt

SEQ ID NO: 92312 - DNA, 121 bp, Homo sapiens
  misc_feature 1..121: note = chr4:56501604-56501725
  misc_feature 1..121: note = hyper
  source 1..121: mol_type = genomic DNA
gcacacttgcctctccgactttatgtgatgagaagttctctattccttttcctgatctagtgcctgaaaaccgataaggcacaaagcccactccttcccttctaagcggttagcgtggggc

SEQ ID NO: 92313 - DNA, 37 bp, Homo sapiens
  misc_feature 1..37: note = chr4:56502430-56502467
  misc_feature 1..37: note = hyper
  source 1..37: mol_type = genomic DNA
gccctggctgtgcctcggggcccggacacaggactga

SEQ ID NO: 92314 - DNA, 61 bp, Homo sapiens
  misc_feature 1..61: note = chr4:56503474-56503535
  misc_feature 1..61: note = hyper
  source 1..61: mol_type = genomic DNA
tgctcctcctgcccccgcaccgcccctccccgccccctctcccccgcgccataggccccag

SEQ ID NO: 92315 - DNA, 246 bp, Homo sapiens
  misc_feature 1..246: note = chr4:56659621-56659867
  misc_feature 1..246: note = hyper
  source 1..246: mol_type = genomic DNA
agtggcgagtgggcacggctctcgggagagggaaggcagcgattccaggagtcggggtcgcctcgctgcgatggcaggttcagcttcggttcactaatcgcaaccagccccaccgcgggagacggggagagccctggctgctgcaggccggcacctgggtagatgttaccttttcccgcacagggtcagtccacagacgtgcaccagcaccccggcgaccggtcacagccttcccctcgccccggg

SEQ ID NO: 92316 - DNA, 163 bp, Homo sapiens
  misc_feature 1..163: note = chr4:56659934-56660097
  misc_feature 1..163: note = hyper
  source 1..163: mol_type = genomic DNA
cgcactccccgggtatgctgcgggccctctccatccggggaggcggggtccggggaggacacatccccggcccggcctctccgagagaccctttggatttttctcttccacaccgcctcatccgaggggagccccccaccccacaccccgcagtgatctgggg

SEQ ID NO: 92317 - DNA, 358 bp, Homo sapiens
  misc_feature 1..358: note = chr4:568295-568653
  misc_feature 1..358: note = hyper
  source 1..358: mol_type = genomic DNA
gtcgccgtcctggggcgctcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaa

SEQ ID NO: 92318 - DNA, 69 bp, Homo sapiens; identical to SEQ ID NO: 2356
  misc_feature 1..69: note = chr4:569047-569116
  misc_feature 1..69: note = hyper
  source 1..69: mol_type = genomic DNA

SEQ ID NO: 92319 - DNA, 162 bp, Homo sapiens; identical to SEQ ID NO: 2357
  misc_feature 1..162: note = chr4:569274-569436
  misc_feature 1..162: note = hyper
  source 1..162: mol_type = genomic DNA

SEQ ID NO: 92320 - DNA, 30 bp, Homo sapiens
  misc_feature 1..30: note = chr4:56936174-56936204
  misc_feature 1..30: note = hypo
  source 1..30: mol_type = genomic DNA
gtggagataaggaaacggagagtcagatgt

SEQ ID NO: 92321 - DNA, 273 bp, Homo sapiens; identical to SEQ ID NO: 28670
  misc_feature 1..273: note = chr4:569460-569733
  misc_feature 1..273: note = hyper
  source 1..273: mol_type = genomic DNA

SEQ ID NO: 92322 - DNA, 194 bp, Homo sapiens
  misc_feature 1..194: note = chr4:570063-570257
  misc_feature 1..194: note = hyper
  source 1..194: mol_type = genomic DNA
gggaaccgatgcggcgcagagaccgcagggcgcgcgccccctccccagcccgcggggcccctcccaggaggctcgttcccccccaaccccccaccccgcccgcggccccgcgcgcctcgccctggcgccgcccttccccgcccccggcagcccccgccacccccgggacgcccctccgcttcctcctcccggag

SEQ ID NO: 92323 - DNA, 203 bp, Homo sapiens; identical to SEQ ID NO: 7201
  misc_feature 1..203: note = chr4:570298-570501
  misc_feature 1..203: note = hyper
  source 1..203: mol_type = genomic DNA

SEQ ID NO: 92324 - DNA, 44 bp, Homo sapiens
  misc_feature 1..44: note = chr4:57063851-57063895
  misc_feature 1..44: note = hypo
  source 1..44: mol_type = genomic DNA
tttttttttttgaaacggagtctcactctgttgccccgctggag

SEQ ID NO: 92325 - DNA, 1356 bp, Homo sapiens
  misc_feature 1..1356: note = chr4:570836-572192
  misc_feature 1..1356: note = hyper
  source 1..1356: mol_type = genomic DNA
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagaccccagaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccagaacaggaatagtgacccttcctttgcatttatggtgcataggttttcaaaggacagtgtgtaaatcagcttgtgtaataattgtggcacccacgcgcgcaagcagacttaccatgagctgacttccactgattatttcagtttccagggaaacgaggtttgcagccccctccagtgagggcggagcggcctctccattcccaatgcagcaaggctgctgcagccacgatgattaggcttt

SEQ ID NO: 92326 - DNA, 253 bp, Homo sapiens
  misc_feature 1..253: note = chr4:5709732-5709985
  misc_feature 1..253: note = hyper
  source 1..253: mol_type = genomic DNA
ccctaggtcgaagctcgtaaaatggagagcaggattcgaaccagggtcgctggtgaagtccaagccggcagctgccacaccccgaggaaggtctccagtttccctcgaagctttctggccgtgagcgggatacacctaagggccgcgaagcaccctattcagatcctgccctcccttcctcattctttgcgaaatactaagggtcctccctgccaccgccggtgtagacaaagtcaaaccactacagtcagac

SEQ ID NO: 92327 - DNA, 78 bp, Homo sapiens
  misc_feature 1..78: note = chr4:5710450-5710528
  misc_feature 1..78: note = hyper
  source 1..78: mol_type = genomic DNA
ggcggccaggcctgggtttgcttgcgcccaaaccgaatcagagcgggtcactcccctgctccccgaggttaccaggac

SEQ ID NO: 92328 - DNA, 341 bp, Homo sapiens; identical to SEQ ID NO: 28747
  misc_feature 1..341: note = chr4:5712891-5713232
  misc_feature 1..341: note = hyper
  source 1..341: mol_type = genomic DNA

SEQ ID NO: 92329 - skipped

SEQ ID NO: 92330 - DNA, 48 bp, Homo sapiens
  misc_feature 1..48: note = chr4:57180924-57180972
  misc_feature 1..48: note = hypo
  source 1..48: mol_type = genomic DNA
cagtgagcttctgaacgactttgaggagaggctcgaagaccaggaacg

SEQ ID NO: 92331 - DNA, 79 bp, Homo sapiens
  misc_feature 1..79: note = chr4:57182183-57182262
  misc_feature 1..79: note = hypo
  source 1..79: mol_type = genomic DNA
aggaaaaagcctcaccgtttggaataaaattgagaaggaccaactattccttgcgcttcaactgcgaccaacaggcaga

SEQ ID NO: 92332 - DNA, 24 bp, Homo sapiens
  misc_feature 1..24: note = chr4:57252055-57252079
  misc_feature 1..24: note = hypo
  source 1..24: mol_type = genomic DNA
gagccaccgcgcccggccgagtca

SEQ ID NO: 92333 - DNA, 101 bp, Homo sapiens
  misc_feature 1..101: note = chr4:57252411-57252512
  misc_feature 1..101: note = hypo
  source 1..101: mol_type = genomic DNA
gctttctgcagcaggcgcttaaattatgaggaatgagttcatttcgcaacatacaggtagcgcagaagggtacctacacatctatacgataattaagatgt

SEQ ID NO: 92334 - DNA, 30 bp, Homo sapiens
  misc_feature 1..30: note = chr4:57370899-57370929
  misc_feature 1..30: note = hypo
  source 1..30: mol_type = genomic DNA
ctttgaaaagcccttcgtgtgccttattta

SEQ ID NO: 92335 - DNA, 250 bp, Homo sapiens
  misc_feature 1..250: note = chr4:57371618-57371868
  misc_feature 1..250: note = hyper
  source 1..250: mol_type = genomic DNA
aggttgcttagactgcggcccacgtggaaggctcttagccaccctgcctggcccgaggtaatcgcgctagggacgctttttctgcagcaatgatataccccgccgaactgtcccacgtcctggttgggacctcttggtttcgcttggctgggctcaatccatccgtacgcctccgcccttccctctttgcgaacccctgcgggttcagcgaatcggctgcaagaagccctgcatccgcgaggtaagcggc

SEQ ID NO: 92336 - DNA, 166 bp, Homo sapiens; identical to SEQ ID NO: 28950
  misc_feature 1..166: note = chr4:57371869-57372035
  misc_feature 1..166: note = hyper
  source 1..166: mol_type = genomic DNA

SEQ ID NO: 92337 - DNA, 217 bp, Homo sapiens
  misc_feature 1..217: note = chr4:57372287-57372504
  misc_feature 1..217: note = hyper
  source 1..217: mol_type = genomic DNA
ggaccccgctcgagccgctggtaagagacccagtgcccaggaccccttgccccaaggcttttgtcggccgttcagaccccagcgctgtctctgttacgtcggaggcccccgaccgcgtgggagcgaatggatctcaactgagggctatttacctatggatgaaagagatgcgccaaactttgaacgacccatccccttttcccgggccccctgccca

SEQ ID NO: 92338 - DNA, 866 bp, Homo sapiens
  misc_feature 1..866: note = chr4:57396459-57397325
  misc_feature 1..866: note = hyper
  source 1..866: mol_type = genomic DNA
tccttgctctggacacggggaacagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtgggactagggcggggctcgggggctagaccggggcggggctgtgtagggctggggcggggctcggggcggggctcggggcggggctgggcgcggggggccccggcagcccttatcgtatcgcgcagagagcaaactgcgcctgggcaaccagtcgggagggtgagtcccgcgcgcgacagaagcttctggcgcgaatggagaaccaagagtttctaagttcatctgcgccgtccgaggtgaccgatgggcaggtctcaacagaaatatccacttgctccgaagtcttccagaagcccattgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtct

SEQ ID NO: 92339 - DNA, 15 bp, Homo sapiens
  misc_feature 1..15: note = chr4:57521381-57521396
  misc_feature 1..15: note = hyper
  source 1..15: mol_type = genomic DNA
aattttttaaaaaat

SEQ ID NO: 92340 - DNA, 159 bp, Homo sapiens; identical to SEQ ID NO: 372
  misc_feature 1..159: note = chr4:57521505-57521664
  misc_feature 1..159: note = hyper
  source 1..159: mol_type = genomic DNA

SEQ ID NO: 92341 - DNA, 683 bp, Homo sapiens; identical to SEQ ID NO: 373
  misc_feature 1..683: note = chr4:57521700-57522383
  misc_feature 1..683: note = hyper
  source 1..683: mol_type = genomic DNA

SEQ ID NO: 92342 - DNA, 396 bp, Homo sapiens; identical to SEQ ID NO: 374
  misc_feature 1..396: note = chr4:57522419-57522815
  misc_feature 1..396: note = hyper
  source 1..396: mol_type = genomic DNA

SEQ ID NO: 92343 - DNA, 249 bp, Homo sapiens
  misc_feature 1..249: note = chr4:57687638-57687887
  misc_feature 1..249: note = hyper
  source 1..249: mol_type = genomic DNA
gggaaccgccagtaacgggcgcgcgggtaccgtcgccgaggccgcccggagcagggcagggtccgccgccggtctgactcccaaacccgcttttctccggaggtccccgctcgccaggaccgctccgagcgctacctgcgaaggtaactgccaggagcagcagcgccaagcgcagcaccgacagcgccatcctcctcccgcgccggctgtcttgcccctgcggtctgttacctgcgccactcgcaggga

SEQ ID NO: 92344 - DNA, 95 bp, Homo sapiens
  misc_feature 1..95: note = chr4:57775782-57775877
  misc_feature 1..95: note = hyper
  source 1..95: mol_type = genomic DNA
tacacttgggtgaagcgggttactttttgtattttcggtttaactttattttcttagaacttcttactttttttaatttgcgagtgaacacttcg

SEQ ID NO: 92345 - DNA, 39 bp, Homo sapiens
  misc_feature 1..39: note = chr4:57777437-57777476
  misc_feature 1..39: note = hypo
  source 1..39: mol_type = genomic DNA
tccaagggccccattcgctgtgaccgctgcggctacaat

SEQ ID NO: 92346 - DNA, 30 bp, Homo sapiens
  misc_feature 1..30: note = chr4:57803508-57803538
  misc_feature 1..30: note = hypo
  source 1..30: mol_type = genomic DNA
caccacgcctcttgccgcctcctctcaaaa

SEQ ID NO: 92347 - DNA, 135 bp, Homo sapiens
  misc_feature 1..135: note = chr4:57906901-57907036
  misc_feature 1..135: note = hypo
  source 1..135: mol_type = genomic DNA
aggctgaggatttaacgttttaccatccttgtgcagtgcaagagaagcttgtcagcctaggatgtctcttaaagtctgtgccacagaccttgttccagatgaggacaggtgtcgggattccgatgacctcacagc

SEQ ID NO: 92348 - DNA, 979 bp, Homo sapiens
  misc_feature 1..979: note = chr4:57975777-57976756
  misc_feature 1..979: note = hyper
  source 1..979: mol_type = genomic DNA
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgccc

SEQ ID NO: 92349 - DNA, 350 bp, Homo sapiens
  misc_feature 1..350: note = chr4:57976757-57977107
  misc_feature 1..350: note = hyper
  source 1..350: mol_type = genomic DNA
cttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccactt

SEQ ID NO: 92350 - DNA, 30 bp, Homo sapiens
  misc_feature 1..30: note = chr4:57977334-57977364
  misc_feature 1..30: note = hyper
  source 1..30: mol_type = genomic DNA
tcgttggagctgccacggaggcacctaaag

SEQ ID NO: 92351 - DNA, 1490 bp, Homo sapiens; identical to SEQ ID NO: 28748
  misc_feature 1..1490: note = chr4:5889116-5890606
  misc_feature 1..1490: note = hyper
  source 1..1490: mol_type = genomic DNA

SEQ ID NO: 92352 - DNA, 187 bp, Homo sapiens
  misc_feature 1..187: note = chr4:5891895-5892082
  misc_feature 1..187: note = hyper
  source 1..187: mol_type = genomic DNA
aagtcctaggttccccgtaccagggcgttccctggggtcagtctggagatctgagcagaaagcccctacagcaagggacaagaccacgtgcgtatcagggggaggagcatccgcctgccactggccaaacagatcgctgctcccaagcagatttcgccggtacaaagcgccgcagccgctcagcctc

SEQ ID NO: 92353 - DNA, 120 bp, Homo sapiens; identical to SEQ ID NO: 28750
  misc_feature 1..120: note = chr4:5892109-5892229
  misc_feature 1..120: note = hyper
  source 1..120: mol_type = genomic DNA

SEQ ID NO: 92354 - DNA, 182 bp, Homo sapiens
  misc_feature 1..182: note = chr4:5892520-5892702
  misc_feature 1..182: note = hyper
  source 1..182: mol_type = genomic DNA
gttggtgacattgaccgcagttccagaggaactctccttgggacagctacgggccgtgcacaaagcgccctcgcctccctagtactccaccacgctttgaggaaggccggaagaagacggccacccccatctgacagatggagaagctgaggcccaagagagcaaagcgccttggctggaaa

SEQ ID NO: 92355 - DNA, 317 bp, Homo sapiens
  misc_feature 1..317: note = chr4:5893437-5893754
  misc_feature 1..317: note = hyper
  source 1..317: mol_type = genomic DNA
gaccctggctctcgtcggtccatccaaaggctacgccgtccatccgcccttcttcccccagtttcctggtgacccccagctcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcctta

SEQ ID NO: 92356 - DNA, 102 bp, Homo sapiens; identical to SEQ ID NO: 28753
  misc_feature 1..102: note = chr4:5893981-5894083
  misc_feature 1..102: note = hyper
  source 1..102: mol_type = genomic DNA

SEQ ID NO: 92357 - DNA, 317 bp, Homo sapiens
  misc_feature 1..317: note = chr4:5894812-5895129
  misc_feature 1..317: note = hyper
  source 1..317: mol_type = genomic DNA
cggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcacacgcgggttcatacctgc

SEQ ID NO: 92358 - DNA, 30 bp, Homo sapiens
  misc_feature 1..30: note = chr4:6019884-6019914
  misc_feature 1..30: note = hypo
  source 1..30: mol_type = genomic DNA
cggactccgatgtcacgtacttgtcctctg

SEQ ID NO: 92359 - DNA, 160 bp, Homo sapiens
  misc_feature 1..160: note = chr4:6032062-6032222
  misc_feature 1..160: note = hypo
  source 1..160: mol_type = genomic DNA
tggtaccagggtgaccgacagacccggtttgcccaggactttcctggtgtgagcctcaggaaacccctcagtcctgggcaaacccagactcttagttaccctccttggcaccgcacctgcagaattaattccctgggtggtttaccgatcattccttccc

SEQ ID NO: 92360 - DNA, 30 bp, Homo sapiens
  misc_feature 1..30: note = chr4:60685051-60685081
  misc_feature 1..30: note = hypo
  source 1..30: mol_type = genomic DNA
ttttctttttatttacgtatttatttattt

SEQ ID NO: 92361 - DNA, 16 bp, Homo sapiens
  misc_feature 1..16: note = chr4:61380678-61380694
  misc_feature 1..16: note = hypo
  source 1..16: mol_type = genomic DNA
gaagcagtctggatgc

SEQ ID NO: 92362 - DNA, 36 bp, Homo sapiens
  misc_feature 1..36: note = chr4:617245-617281
  misc_feature 1..36: note = hypo
  source 1..36: mol_type = genomic DNA
gccaaccctcactcccgctagcgccccaaatcttca

SEQ ID NO: 92363 - DNA, 169 bp, Homo sapiens
  misc_feature 1..169: note = chr4:6176884-6177053
  misc_feature 1..169: note = hypo
  source 1..169: mol_type = genomic DNA
aacacagcactgacacgcaggcaagtgacactctctgggcccgctgaggccctgaaggctcagaaaggttaaggaacctccccaaagtcacagaactcccatgtgatagaaccgggacacaagtaagtgagctccaaatggggtcccttcattccgcaataaaaagtaa

SEQ ID NO: 92364 - DNA, 372 bp, Homo sapiens
  misc_feature 1..372: note = chr4:619507-619879
  misc_feature 1..372: note = hypo
  source 1..372: mol_type = genomic DNA
tgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggc

SEQ ID NO: 92365 - DNA, 30 bp, Homo sapiens
  misc_feature 1..30: note = chr4:6195587-6195617
  misc_feature 1..30: note = hypo
  source 1..30: mol_type = genomic DNA
gcttccaacaccagccgcaaaggtgagaac

SEQ ID NO: 92366 - DNA, 465 bp, Homo sapiens; identical to SEQ ID NO: 28755
  misc_feature 1..465: note = chr4:6200828-6201293
  misc_feature 1..465: note = hyper
  source 1..465: mol_type = genomic DNA

SEQ ID NO: 92367 - DNA, 324 bp, Homo sapiens
  misc_feature 1..324: note = chr4:6201349-6201673
  misc_feature 1..324: note = hyper
  source 1..324: mol_type = genomic DNA
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctg

SEQ ID NO: 92368 - DNA, 779 bp, Homo sapiens
  misc_feature 1..779: note = chr4:6201879-6202658
  misc_feature 1..779: note = hyper
  source 1..779: mol_type = genomic DNA
cgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 92369 - DNA, 268 bp, Homo sapiens
  misc_feature 1..268: note = chr4:62065803-62066071
  misc_feature 1..268: note = hyper
  source 1..268: mol_type = genomic DNA
cgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctg

SEQ ID NO: 92370 - DNA, 1491 bp, Homo sapiens
  misc_feature 1..1491: note = chr4:62066133-62067624
  misc_feature 1..1491: note = hyper
  source 1..1491: mol_type = genomic DNA
cgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgctcgctcttggggagtcgaagaagagaaagaaccgaagagacagcggcggcggcgcagagcccggggccgcgcgatgaagctcccacatgcccgcagctgcccggcccggccggcgagctaatcatccaccccacgggctcggggttcgccggcccccgggacgcagccctcggcggccgggcgcccgctctgtctgcgcgccccctccgtgcaccggggaaggagtttgtgtggctctcgctccggctgtccgcggaggttgcgggcttgagaggggaccctcggctgggagagagcctcgggaggacgaagaggaggacggtttggcggagaagccacccctggccctcgcggctccccctacctattccatcgctcccgctccgaggcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 92371 - DNA, 329 bp, Homo sapiens
  misc_feature 1..329: note = chr4:62067873-62068202
  misc_feature 1..329: note = hyper
  source 1..329: mol_type = genomic DNA
agggcgacttttctccgtcaggctggaactggtgccgctggaggcgggagcgggctggaggacggacagggtctgggtgagaagctgggctctgggaagatggaaaatgcagggtgccgagcccggcgcgattctccctcaacgcttgcctggagcatccctggccccttttgcccaggtcgcgcccctgagtcttggagtcgcgctgcctccccgcgccctgcctgttgtgtctccttcacggcagtttggtttagacctgcgtgcccaggctttgttaggcggttttggctggagaaagctgccactttcgtgggtggcccgggctg

SEQ ID NO: 92372 - DNA, 158 bp, Homo sapiens
  misc_feature 1..158: note = chr4:62068237-62068395
  misc_feature 1..158: note = hyper
  source 1..158: mol_type = genomic DNA
cggtgttgcacgaatccgggcggccgcggcgccggggcggggtgggcagagcattggtggtcgcggttggcgggttacaggtaggagagaaggcacctcggcgcttctctgaggagaagggaaggctccaggctgcagcgcagcgtctgagctgccgc

SEQ ID NO: 92373 - DNA, 30 bp, Homo sapiens; identical to SEQ ID NO: 28967
  misc_feature 1..30: note = chr4:62068633-62068663
  misc_feature 1..30: note = hyper
  source 1..30: mol_type = genomic DNA

SEQ ID NO: 92374 - DNA, 457 bp, Homo sapiens
  misc_feature 1..457: note = chr4:6223447-6223904
  misc_feature 1..457: note = hyper
  source 1..457: mol_type = genomic DNA
tctggaaaggactcccggagagcagctgctctgaattttctaatttcgctacactggtgatgtatcatgtattcctgtgtgattcgaaaatgttaaaagtcatataataatgtagaagacgacccttcgcgagcgaggccccccacctctggccactgagggcacttacgtaactgcggggcgggcgcaggcctccactgggtgagcggcaggcgggggcggggctgcccggagcctcggccccgcccacccctctcccccgcccactgtccccgcccagccccgggctgctcggaaaggccggagtccggagcacagcaacgcgcggagcggcccggcccctctggtggtcccgcccacgcgacccgggcgcagcggcgggcgccggacagctgtcccggcgggcgaacgacatgcagcggaactgcgggaggctgcggttcggtggctggacttg

SEQ ID NO: 92375 - DNA, 241 bp, Homo sapiens
  misc_feature 1..241: note = chr4:6223950-6224191
  misc_feature 1..241: note = hyper
  source 1..241: mol_type = genomic DNA
cgtccctgggatgggatctgggcgcccggcgcagcgcggctgacaacagccgagcggttccggtgcgctggcacgtggctcgggcctgcccccccggcctggccgcctcccggcgcgttccccggtgcaggtgcctggcccgtgccccgccatctccgcccggcgccgcctgtgctgaaggagccacgccccgggctccggagcctgcctctgcaaagtccaggcccgcggcgcgcaggtc

SEQ ID NO: 92376 - DNA, 531 bp, Homo sapiens
  misc_feature 1..531: note = chr4:6247186-6247717
  misc_feature 1..531: note = hyper
  source 1..531: mol_type = genomic DNA
tgtgccctgggtgctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcgaaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 92377 - DNA, 638 bp, Homo sapiens
  misc_feature 1..638: note = chr4:628132-628770
  misc_feature 1..638: note = hypo
  source 1..638: mol_type = genomic DNA
ggcatccaggaagcccgacgtggccggagggcggcaggtgcgtgaggtgccaggcagggcggggccccccatgaggcctgtccaagtctgctggactgagcactggggggcaccagcatcctccgcacaggggtgcatggagccaggctggagccacagggacaggcccagctttcaccgcccggtggccacatcccagtgcccagcagggcccctgggcacctcacacctggagggcagcagcccccacagagcttgacgacaaccccagtggtgcgggctccaggcccacggtgcgacagcctctttagcctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgagtgtggggggcacctgggcagccgcgcgtctgcctccctgcctgcctgcccgcccgcctgttctgtgctgcgcatccacctctttacctgcctgcccgcctgcccgtgtgttctctgctgcgtgtctgcctccttacctgcctgcccg

SEQ ID NO: 92378 - DNA, 120 bp, Homo sapiens
  misc_feature 1..120: note = chr4:628830-628950
  misc_feature 1..120: note = hypo
  source 1..120: mol_type = genomic DNA
tccacctccttacctgcctgcccgcctgcccgtgtgttctctgctgcgtgtctgcctccttacctgcctgcccgcgtgttctgtgctgcgtgtctgcctccttacctgcctgcccgcgtg

SEQ ID NO: 92379 - DNA, 37 bp, Homo sapiens
  misc_feature 1..37: note = chr4:629370-629407
  misc_feature 1..37: note = hypo
  source 1..37: mol_type = genomic DNA
tgcccgcgtgttctgtgctgcgcgtctgctgggctgc

SEQ ID NO: 92380 - DNA, 901 bp, Homo sapiens
  misc_feature 1..901: note = chr4:6472218-6473119
  misc_feature 1..901: note = hyper
  source 1..901: mol_type = genomic DNA
caccgtcatccccaacgtagagatgagcaaacagaggcttgctccaggaagccagaccacagcgagcctgggagcagcggggcaacctgccaagatccgctctcggcccgagccaggccaccgaggcacgggccagcaacccggcggcttcctccaaccctctgtcgctgcaggctgcgagcagaaaccacatcccggacccacgctgatcccgactcagcctcgccgaagcaggcgacaaaggaccgctctcagctccccgggcctcccaaagccgcggccgggtcagagccccaccggcccggaggcccgggcagccctgcccctctctcgcacacacccggcggcgaagcgtgcgtgactcagcggttctcccgccgggagcgggcgcggcccccgcagcctccctccgcccaggtcccacgcccagcctctgcctcccgggccagggcgccccgagcccgcccgcgcccgcgctcgcgctgcgctccccgggcctccgcggggctccggctccgctcggcctcatttccggcagagccaggcttcgaggaggcggacccagccgcaggagcccggtctccgccgcctggcccactcggtctccctgacacaggcacccacgcgcacctgccccgcgggacccgtgcccagggcccctcccactggggcacccacccggggaatccgcgcacacttctgcggccgggccgccagcccgtgggttagcggctgacagtccccgcactcgggcagggctccagcacaggcggccccgagcccagacctcccggtccccatcctccatcggggtcactccgcgggccctgcctgcgcacggaagctgtccccactgttcccctagcgaggcagaccagggggcccccggaagttccaggcc

SEQ ID NO: 92381 - DNA, 30 bp, Homo sapiens
  misc_feature 1..30: note = chr4:6473457-6473487
  misc_feature 1..30: note = hyper
  source 1..30: mol_type = genomic DNA
gcctagaaaattctgcgggctttgggcagg

SEQ ID NO: 92382 - DNA, 170 bp, Homo sapiens
  misc_feature 1..170: note = chr4:6473794-6473964
  misc_feature 1..170: note = hyper
  source 1..170: mol_type = genomic DNA
atcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggcc

SEQ ID NO: 92383 - DNA, 522 bp, Homo sapiens
  misc_feature 1..522: note = chr4:6473965-6474487
  misc_feature 1..522: note = hyper
  source 1..522: mol_type = genomic DNA
tgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccggcggcggggcctggtgccggtgcgcctggctgcggcgacggcggcgaggggacgcgcgcggcgctgcgctgcgccgaccaagccggggccgagccgggctgcgcgggctggggccgccgccgccgccgctgtcgcaggcccctccctcgcgccgcccgctctccgcccccgcggccctgcaggtggagccggcgcccaagccgaggctgcaccgccgtgctcgggccctcgcggtgggcaccttgg

SEQ ID NO: 92384 - DNA, 33 bp, Homo sapiens
  misc_feature 1..33: note = chr4:650380-650413
  misc_feature 1..33: note = hypo
  source 1..33: mol_type = genomic DNA
ctgcgaggccgtgaccgccgccccacacacatg

SEQ ID NO: 92385 - DNA, 510 bp, Homo sapiens
  misc_feature 1..510: note = chr4:650838-651348
  misc_feature 1..510: note = hypo
  source 1..510: mol_type = genomic DNA
gccggggatgccctgcgaggggtggggcctgtgcggtgtgggggcctccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacccaggggtcacggctgtgtggcaggggcaggtcgt

SEQ ID NO: 92386 - DNA, 83 bp, Homo sapiens
  misc_feature 1..83: note = chr4:6525252-6525335
  misc_feature 1..83: note = hypo
  source 1..83: mol_type = genomic DNA
gacaacgcacacccacgaggatgtctggaatccaaatgcaaagcgagtgttggctgttgggagagacgcgggacctgcacaca

SEQ ID NO: 92387 - DNA, 30 bp, Homo sapiens
  misc_feature 1..30: note = chr4:652650-652680
  misc_feature 1..30: note = hypo
  source 1..30: mol_type = genomic DNA
ttcctctagctcacacggggtggacgcacc

SEQ ID NO: 92388 - DNA, 87 bp, Homo sapiens
  misc_feature 1..87: note = chr4:6537147-6537234
  misc_feature 1..87: note = hypo
  source 1..87: mol_type = genomic DNA
ttggtgcatgcacgccgccacacaccacatgcaacgcgagcaccgccacccacggccgccctggccgccgcccggcacagctccagc

SEQ ID NO: 92389 - DNA, 193 bp, Homo sapiens
  misc_feature 1..193: note = chr4:6540136-6540329
  misc_feature 1..193: note = hypo
  source 1..193: mol_type = genomic DNA
ccccagcgacgcaagcgtttcagagcaaaacggaaacatacaaggatgatttaacaatctgtgttgatggtgctgaacacacccaatggtgggaagggaacaaaatcaatcccctgctattttcactaggcaaaggaaaatgagatgaggtcacgtcatcttccaaacgccaataacacggcaaatgaaatta

SEQ ID NO: 92390 - DNA, 614 bp, Homo sapiens
  misc_feature 1..614: note = chr4:6564642-6565256
  misc_feature 1..614: note = hyper
  source 1..614: mol_type = genomic DNA
tcttcgggctctgggcgcgccactgtcatggactgtccctgccagccaaaaaaaaaaaaaaaaggcttctccaaaccagagcagcagccgggcctgactcagcacccaccggcgcgggcagcgggaggagcgcgtagacgctgctggatggtacccgcggccgggactgaactccgccgcattgggtcttaccccggactccgagccggaccccgcgcccgcaccttcagccgggcagcgagggggggctcgagcgcgccggttctcggccgagacgctgtggctgacaccggtggagcgatctgccctggctcgcgcggcgagcaagtgctggaggcagggttccaagccggttctgtcgggttccctcaagaccccgagagcacgcgctccggagggaccccggcacttcggaccctagcagagccagccctgccccaggaccgccccggggtcggtgcccgggctctctgagtctcgcttctggcccgcgaagacgcgccctctcctccagtcgcgggagtcccgcacccgagggccgcgtccccgggcagggtgaggtcctgcggggctgggggtgaggcggggtgggcgcgaggcggctccggagcggc

SEQ ID NO: 92391 - DNA, 46 bp, Homo sapiens
  misc_feature 1..46: note = chr4:657666-657712
  misc_feature 1..46: note = hyper
  source 1..46: mol_type = genomic DNA
ccttccgggagggggcgcctcgcggggcgggcgggtagcctgggac

SEQ ID NO: 92392 - DNA, 46 bp, Homo sapiens
  misc_feature 1..46: note = chr4:658106-658152
  misc_feature 1..46: note = hyper
  source 1..46: mol_type = genomic DNA
ggagcaggaagagcccgtcgcggcagcttgtcgagggctgtgaaac

SEQ ID NO: 92393 - DNA, 359 bp, Homo sapiens
  misc_feature 1..359: note = chr4:660870-661229
  misc_feature 1..359: note = hypo
  source 1..359: mol_type = genomic DNA
caatctgccacagtccgatgccagctgagtctctgaggacgcaaggcggacatggagggggagactcgatggggcaggggtctgaccgtggggccctgtgtgatgcccataagagccagctgcctccggccacactccctggtgatggaatccacgccccaaggaggatgccacgggttccacatgaagttgtcccggagtgggctgtgcccactccccgccccatcctacccaccccgggtcgtcagtgctggggagaaggtgggacaagggtggatatttgggcctgaagtggccacaggtcacggccccactgcaggtgccccccactgccttccccaccccgccacactccatgt

SEQ ID NO: 92394 - DNA, 30 bp, Homo sapiens; identical to SEQ ID NO: 40243
  misc_feature 1..30: note = chr4:6627192-6627222
  misc_feature 1..30: note = hypo
  source 1..30: mol_type = genomic DNA

SEQ ID NO: 92395 - DNA, 699 bp, Homo sapiens
  misc_feature 1..699: note = chr4:66533984-66534683
  misc_feature 1..699: note = hyper
  source 1..699: mol_type = genomic DNA
aacccatgcaagtcacgaggacacacacgactccaccactgctgcttcatctttccggtctagtgtcccgtgcccaggagtggaaggaatttctgcaaggttttgagcctcacgcgtcgcatccacagccccaaaccgaaacctcaccattctagccaaagtgggtaggtttttctatgttttcatggtggagctgacagatctggatctgagatactgttcccgcccctccgcgagtaatgcgcccttgggctgagacccgagctcagtccgggtgtgggagaggagcaagcgctgctggaggggacccaaaggcagaggtctcaggtccaagaggcaggcggacagaggggctgagcactgttccgggagcacgaagagcgacacaggtgttgctcccgcgccagctctactctcccagaaaaaggcagggacagtattctgggtctggagcacaggattgggggtagggagggggactgggtactcctggatcaggtgctggccagagcaggtcttttccgtctttaagacatgcccaggtgggttttagcggcaacttcctagcagcgacactccccctcacccctcctgccgcggcatcccaccttctcgccttcttccaccttggcttgagtgtgacaatgaactcccccaagaagaagggcacccaactgtgtggggcgccttctgtccttc

SEQ ID NO: 92396 - DNA, 421 bp, Homo sapiens
  misc_feature 1..421: note = chr4:66534894-66535315
  misc_feature 1..421: note = hyper
  source 1..421: mol_type = genomic DNA
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatttgagatgagactgcgatttagtctgcagcagcagcgtccagcgcgctgagacctgaactcccaggccccgcctagcccctccgccccaggtcgccacggtccccacccccatctccctaccttcgttgctggggctggccaggagggtccggagtg

SEQ ID NO: 92397 - DNA, 133 bp, Homo sapiens
  misc_feature 1..133: note = chr4:66535350-66535483
  misc_feature 1..133: note = hyper
  source 1..133: mol_type = genomic DNA
cgtcgaggtgcagagtagcagccggccagggacgctggggtgatgggggtgtcgccgccgccgcttgggggccgccggcgtcccgcaccccggggccccgagccccgcatcttctccgagcctcctccggtgc

SEQ ID NO: 92398 - DNA, 1062 bp, Homo sapiens
  misc_feature 1..1062: note = chr4:66535574-66536636
  misc_feature 1..1062: note = hyper
  source 1..1062: mol_type = genomic DNA
cgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctgaagaggggagggactgacggctgccggccggtaggagcgcggagctgcgctgcggcggcccaggagctgctgcggttcccgctgctcggggagcaggcggtgtgtgcgcggctgcgaagtcgaggttgaaactgcaccgccaaggcgcgctcctgctgtgtctggagctccggcgtctcctctgcctcccagctcagcgcctcccaccctccttccctcctcctcttcccagctcccccgccctctgctgctcgcagcctcgccagtgagaatctactgtaagtgtgagttgcttcgacgaagtcacacacccacggagggaagtaatctggaggctgccttggtgagtgttgcctagcggtctccgggaaaggcgcgtcttcctcccgggataattagggcaaggaatcctgacgacgctggcgaggactggggttcccgggaggcggaagggagatcagccccagctcagccggcggcccttagagacgcgggtccctccgtttggcatcttgcctgctgtccctcacaggctgtggcatcaacaaccttgtcgtcacatcgccgcgcattcgcaggctctgctgg

SEQ ID NO: 92399 - DNA, 34 bp, Homo sapiens
  misc_feature 1..34: note = chr4:6660444-6660478
  misc_feature 1..34: note = hyper
  source 1..34: mol_type = genomic DNA
ggcctccctggagtgcgagcgtgcccgggcgcac

SEQ ID NO: 92400 - DNA, 93 bp, Homo sapiens
  misc_feature 1..93: note = chr4:6670121-6670214
  misc_feature 1..93: note = hypo
  source 1..93: mol_type = genomic DNA
caattgcattgtggccgtttcttgaaaatacaacgtgcaagacaccacgttttactgccccgcccggctagcagtggacgtggagacagcttt

SEQ ID NO: 92401 - DNA, 294 bp, Homo sapiens
  misc_feature 1..294: note = chr4:671984-672278
  misc_feature 1..294: note = hypo
  source 1..294: mol_type = genomic DNA
gtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaac

SEQ ID NO: 92402 - DNA, 93 bp, Homo sapiens; identical to SEQ ID NO: 40245
  misc_feature 1..93: note = chr4:6719866-6719959
  misc_feature 1..93: note = hypo
  source 1..93: mol_type = genomic DNA

SEQ ID NO: 92403 - DNA, 228 bp, Homo sapiens
  misc_feature 1..228: note = chr4:6748346-6748574
  misc_feature 1..228: note = hypo
  source 1..228: mol_type = genomic DNA
gatctccaaggggtgcggccagcggatgggtgatggcatggatggagggtgggtgcatcaatgctggagcatcaactctgtgtgcccctgcggggagaatcgcccctgccgaagccccggctggtccaaaaccacgccagccgctttaggggtgtctgtggacccaggaccacacagcctcaagagccaagagtcccgagtgtgtgcacctgtcggcctgggtctgga

SEQ ID NO: 92404 - DNA, 33 bp, Homo sapiens
  misc_feature 1..33: note = chr4:676071-676104
  misc_feature 1..33: note = hypo
  source 1..33: mol_type = genomic DNA
gactcggcctgcaggcgccggtatggggtgtgg

SEQ ID NO: 92405 - DNA, 78 bp, Homo sapiens; identical to SEQ ID NO: 40163
  misc_feature 1..78: note = chr4:676743-676821
  misc_feature 1..78: note = hypo
  source 1..78: mol_type = genomic DNA

SEQ ID NO: 92406 - DNA, 30 bp, Homo sapiens
  misc_feature 1..30: note = chr4:6771794-6771824
  misc_feature 1..30: note = hypo
  source 1..30: mol_type = genomic DNA
taggttttattacctcggttttatcacact

SEQ ID NO: 92407 - DNA, 185 bp, Homo sapiens
  misc_feature 1..185: note = chr4:678471-678656
  misc_feature 1..185: note = hypo
  source 1..185: mol_type = genomic DNA
aaatccaccctaccccggggatcccacggcactgaccagcttgagcccatccaggaacttctctgaggtggagctggcagccccggcagagggcggggtggggggcacactctcccacaggcagatggtggacagcaggcagacgacgccagcagggatggtatagacaccgagctggggagggg

SEQ ID NO: 92408 - DNA, 49 bp, Homo sapiens
  misc_feature 1..49: note = chr4:679019-679068
  misc_feature 1..49: note = hypo
  source 1..49: mol_type = genomic DNA
cacaaacacaccacccgcacctgatacacatgcacgagcacacacaggt

SEQ ID NO: 92409 - DNA, 113 bp, Homo sapiens
  misc_feature 1..113: note = chr4:6896320-6896433
  misc_feature 1..113: note = hypo
  source 1..113: mol_type = genomic DNA
aggaggagacagggacgttgctggtacccactgcctgggaacccctggtgagttctccaggatcccacagcaatccccaggctgcggggtgctgagcacgcaaggcaacccct

SEQ ID NO: 92410 - DNA, 34 bp, Homo sapiens
  misc_feature 1..34: note = chr4:692476-692510
  misc_feature 1..34: note = hypo
  source 1..34: mol_type = genomic DNA
cggcatcctaccaggcgtccgagcatgttcctag

SEQ ID NO: 92411 - DNA, 30 bp, Homo sapiens
  misc_feature 1..30: note = chr4:6946432-6946462
  misc_feature 1..30: note = hypo
  source 1..30: mol_type = genomic DNA
ctggtttacagaatgcggggatgtccaggt

SEQ ID NO: 92412 - DNA, 74 bp, Homo sapiens
  misc_feature 1..74: note = chr4:6957571-6957645
  misc_feature 1..74: note = hypo
  source 1..74: mol_type = genomic DNA
gacaggtagcagcctcggacacgtaagtccgagtcgcagctctgtgttgtttaggtggacgagtctgggcccat

SEQ ID NO: 92413 - DNA, 19 bp, Homo sapiens
  misc_feature 1..19: note = chr4:7035959-7035978
  misc_feature 1..19: note = hypo
  source 1..19: mol_type = genomic DNA
gagacgcagggaaggatgt

SEQ ID NO: 92414 - DNA, 231 bp, Homo sapiens
  misc_feature 1..231: note = chr4:7047052-7047283
  misc_feature 1..231: note = hypo
  source 1..231: mol_type = genomic DNA
cccggctgatgtttacgtttacttcttgccttgaccactttgggagcctccttgttcgttattccccctccaccccattcccctattccacacaccataaccggagcgagctttggaagcacaaagcgcctcacaccggcctcagtggcttttacttcaattaaggcagctttagaagtgttgagcaatgagatctcatctgttacctcccttgatcgttttatatttctt

SEQ ID NO: 92415 - DNA, 30 bp, Homo sapiens
  misc_feature 1..30: note = chr4:7084525-7084555
  misc_feature 1..30: note = hypo
  source 1..30: mol_type = genomic DNA
gtgagccgccatgcccggccccttgttcct

SEQ ID NO: 92416 - DNA, 34 bp, Homo sapiens
  misc_feature 1..34: note = chr4:7131141-7131175
  misc_feature 1..34: note = hypo
  source 1..34: mol_type = genomic DNA
gtcacggttccctctcgcacggcagcccagtgag

SEQ ID NO: 92417 - DNA, 30 bp, Homo sapiens; identical to SEQ ID NO: 40252
  misc_feature 1..30: note = chr4:7134112-7134142
  misc_feature 1..30: note = hypo
  source 1..30: mol_type = genomic DNA

SEQ ID NO: 92418 - DNA, 228 bp, Homo sapiens; identical to SEQ ID NO: 28972
  misc_feature 1..228: note = chr4:71600396-71600624
  misc_feature 1..228: note = hyper
  source 1..228: mol_type = genomic DNA

SEQ ID NO: 92419 - DNA, 79 bp, Homo sapiens
  misc_feature 1..79: note = chr4:718161-718240
  misc_feature 1..79: note = hypo
  source 1..79: mol_type = genomic DNA
gaaggtgaagctccacggagcaccctggtggacagcggtgctgtgggggccatggaccagaaggcggagcccatgctgt

SEQ ID NO: 92420 - DNA, 25 bp, Homo sapiens
  misc_feature 1..25: note = chr4:71925563-71925588
  misc_feature 1..25: note = hypo
  source 1..25: mol_type = genomic DNA
gctcctcccccgaggtttgctcgtt

SEQ ID NO: 92421 - DNA, 770 bp, Homo sapiens
  misc_feature 1..770: note = chr4:7194112-7194882
  misc_feature 1..770: note = hyper
  source 1..770: mol_type = genomic DNA
gcctggaggtggggccgcgctcgggtacgccgggcttcccacgagcgcctgggcggcgggccggccggcaggtggcggtgcgcgctcggcgtcgcgggtggcgccggggccgccgagtcccctcctcccgccgctccctcccctcgccggctcctttctctgcgctctcgctcgcgctccccagcgccctcctgctctcccggccgcggtcccctcgtccgcgccgccccgccgccggctccgctgccgcccctggcgaccatggcgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagcccgggcgcctgggtcctcacgcccaactgacccgggtgccgcggagccctcccgcggggcgcgcggagcccggtggcggcgaggaccggcaggcgcgcggcacggagccaggcgccccgggtccgagtcccggtcccgctcctggtcccggcgaggacggcgcccccgccgcgggctaccggcgctgggagcgggcggcgccgctggccggagtggcttcgcgggcgcaggtctcgctcatcagcacgtcgttcgtgctcaagggggacgcgacgcacaaccaggcgatggtgcactggacgggcgagaacagcagcgtaagtgacctccacgcgctcgccgcggc

SEQ ID NO: 92422 - DNA, 170 bp, Homo sapiens
  misc_feature 1..170: note = chr4:7195096-7195266
  misc_feature 1..170: note = hyper
  source 1..170: mol_type = genomic DNA
atcctgggccacctccgatactcccccactggcctccaggtcttgggttacggaggaggaccccagaaccttcggaagcctgcaggtccttgagggtaccccagctcggcgttacctcccctgcccccagactccaccagctgagcgtcgcgttctgggattttgggctc

SEQ ID NO: 92423 - DNA, 150 bp, Homo sapiens
  misc_feature 1..150: note = chr4:7195308-7195458
  misc_feature 1..150: note = hyper
  source 1..150: mol_type = genomic DNA
cgcctccgcaggctccgggacttccccggtcagctcgaatcctgttctgggactctgggatttctgggttacccctctccccggggtactctagtgcgacccgcggctgtcttgagctcttgctgccggtcgccccgcctggatgcactg

SEQ ID NO: 92424 - DNA, 237 bp, Homo sapiens
  misc_feature 1..237: note = chr4:72226735-72226972
  misc_feature 1..237: note = hypo
  source 1..237: mol_type = genomic DNA
ggaggaggagcggcccggcttctccaccctgagaacagagggaaattcccaaggctccaccccagtgcgcactcctcccagtgcacaggccggtcagagtttctccaggaacccctctatacttggttgtgacaatatcctttataacagtaaaaatcaatgcatacacatactcacgcacgcacacgttcatgtataaatatggttctttcccctggtaaccggttttcaaacatt

SEQ ID NO: 92425 - DNA, 30 bp, Homo sapiens; identical to SEQ ID NO: 40253
  misc_feature 1..30: note = chr4:7237615-7237645
  misc_feature 1..30: note = hypo
  source 1..30: mol_type = genomic DNA

SEQ ID NO: 92426 - DNA, 206 bp, Homo sapiens
  misc_feature 1..206: note = chr4:7261017-7261223
  misc_feature 1..206: note = hypo
  source 1..206: mol_type = genomic DNA
gtggaagctgaggtccgcagagttcaattccatgactgggggatttgaacccaggttgtgggactcaggatctcctcagaacccacattctcaagcacagatagaatcacggggctcacaggggttgtactctgtactcgtaggcccagggtatgtggcaggtgtttgagaaatggttgctgtgctgagggcgctcttcctggtga

SEQ ID NO: 92427 - DNA, 30 bp, Homo sapiens
  misc_feature 1..30: note = chr4:7282766-7282796
  misc_feature 1..30: note = hypo
  source 1..30: mol_type = genomic DNA
agtcgcgtgtctgaacgtgccctgcccacg

SEQ ID NO: 92428 - DNA, 35 bp, Homo sapiens
  misc_feature 1..35: note = chr4:7295601-7295636
  misc_feature 1..35: note = hypo
  source 1..35: mol_type = genomic DNA
aggacttggctattccgaggcgctgtccagcaggg

SEQ ID NO: 92429 - DNA, 32 bp, Homo sapiens
  misc_feature 1..32: note = chr4:7302270-7302302
  misc_feature 1..32: note = hypo
  source 1..32: mol_type = genomic DNA
tgtaagcaacgtgcacgcgttgacacagtagg

SEQ ID NO: 92430 - DNA, 264 bp, Homo sapiens
  misc_feature 1..264: note = chr4:73433899-73434163
  misc_feature 1..264: note = hyper
  source 1..264: mol_type = genomic DNA
ggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactaggaattgttacgaatgtcgcagact

SEQ ID NO: 92431 - DNA, 439 bp, Homo sapiens
  misc_feature 1..439: note = chr4:73434804-73435243
  misc_feature 1..439: note = hyper
  source 1..439: mol_type = genomic DNA
ccaaagcagctttttcgaggcttttcgagcaccattggtccctaaggttagcgcggagaatgcttgggttccccggagcacagcagggggaagtattagcgagagagacgagcgagcgggagcgggagaaagaggcagggagagggcgactccgccgcacacgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggtgtggcccgggctcgacctcccaccctg

SEQ ID NO: 92432 - DNA, 30 bp, Homo sapiens
  misc_feature 1..30: note = chr4:7376235-7376265
  misc_feature 1..30: note = hypo
  source 1..30: mol_type = genomic DNA
tgcgtgttgcttttccgggtgcagtggctt

SEQ ID NO: 92433 - DNA, 196 bp, Homo sapiens
  misc_feature 1..196: note = chr4:738289-738485
  misc_feature 1..196: note = hypo
  source 1..196: mol_type = genomic DNA
ggagtgaatttttgacggcatttggagtacagtgtagttttttaaatggcttgacagtttggatttcatggtgcgctatgttctgtttgtgctaaaaggtgaaaccaaagcagacgacagttcaaacaaagaggccgcggaggagaagccggaggaggacaacgactaccaccgcagcgacgagcaggtgggcggg

SEQ ID NO: 92434 - DNA, 57 bp, Homo sapiens
  misc_feature 1..57: note = chr4:741730-741787
  misc_feature 1..57: note = hypo
  source 1..57: mol_type = genomic DNA
tggcaggtcagtggccggctctggcctcagccccatggcccacgttttgtgcctttt

SEQ ID NO: 92435 - DNA, 32 bp, Homo sapiens; identical to SEQ ID NO: 40297
  misc_feature 1..32: note = chr4:74468507-74468539
  misc_feature 1..32: note = hypo
  source 1..32: mol_type = genomic DNA

SEQ ID NO: 92436 - DNA, 117 bp, Homo sapiens
  misc_feature 1..117: note = chr4:74702331-74702448
  misc_feature 1..117: note = hyper
  source 1..117: mol_type = genomic DNA
gagtttcctgccagtcgggagggatgaatgcagataaagggagtgcagaaggcacgaggaaaccaaagtgctctgtatcctccagtctccgcgcctccacccagctcaggaacccgc

SEQ ID NO: 92437 - DNA, 76 bp, Homo sapiens
  misc_feature 1..76: note = chr4:74702449-74702525
  misc_feature 1..76: note = hyper
  source 1..76: mol_type = genomic DNA
aaccctctcttgaccactatgagcctcccgtccagccgcgcggcccgtgtcccgggtccttcgggctccttgtgcg

SEQ ID NO: 92438 - DNA, 146 bp, Homo sapiens
  misc_feature 1..146: note = chr4:7475389-7475535
  misc_feature 1..146: note = hypo
  source 1..146: mol_type = genomic DNA
gtgatgatggctgggcggtagcaggactagaagggccttttgggaggaactgctcctggctgggaggctgtgacttggcaatggggaggtgggagggtgggcgcggtcctggcatggggtcaccagggacccggaggctggtgcag

SEQ ID NO: 92439 - DNA, 497 bp, Homo sapiens
  misc_feature 1..497: note = chr4:74809854-74810351
  misc_feature 1..497: note = hyper
  source 1..497: mol_type = genomic DNA
agggaagaagagactcgctgggtgagcgggactgttggcgcggggtgctaccccagccgtgtcccgctccggagaccccagggcgccgggacccatctgccgctcgccggccggaggctaccaggagcaggagcagcagcgccgcccgcagtagccggggagcgcgggggacagcggggggcgcggcgcagttcaccgggctcagaaggcaggtcgggcggcggtgcgaggagcgggagagctggcagggaggtgcctgcagcccaggctctgtggctccccaagatcggtgaaccctttttatgcatgattggggctgaaaagtctggaacccccgggccagggaaattctcggagctccaggtctatcccgagtactgaagaaaagggctggccccacccccggggtgggtgggtggtgggcggtggctggttacccactggtgcagcctccccggctcgccttccagagtaactcccgtcgactgtgggatatt

SEQ ID NO: 92440 - DNA, 458 bp, Homo sapiens
  misc_feature 1..458: note = chr4:74903976-74904434
  misc_feature 1..458: note = hyper
  source 1..458: mol_type = genomic DNA
gtggcagcggaagcgcggggcgggacttacatgacttcggtttgggcgcagtggggtccgggggaccttacattcacactttggatgttcttgaggtgaattccctgcagtgtctgcaagcactggcagcgcagttcagtgaccacggacgctcctagggaagaatagactcgctgattgagcggggctgtcggcgcggggcgcccaccccagccgcgtccggcccggggaccccagggcgccgggacccacctgctgcgcgccggctggcggccaccaggagcaggagcagcagcgccacccgcaggagccggggattgctgggggcggcggagagcgtggcgtgggccatggggctcagcagacgcgtcgggaagctgtgcgagaagcgggagagctggcggggaggtgcctgcgacccgggctgtgtggctccccaagatcggcgaacccttttt

SEQ ID NO: 92441 - DNA, 30 bp, Homo sapiens
  misc_feature 1..30: note = chr4:75200375-75200405
  misc_feature 1..30: note = hypo
  source 1..30: mol_type = genomic DNA
gagggaagtcatctgcgtgagagggggccc

SEQ ID NO: 92442 - DNA, 30 bp, Homo sapiens
  misc_feature 1..30: note = chr4:7522096-7522126
  misc_feature 1..30: note = hypo
  source 1..30: mol_type = genomic DNA
tgtgtgctggttttccgtgggtcaggtccg

SEQ ID NO: 92443 - DNA, 30 bp, Homo sapiens
  misc_feature 1..30: note = chr4:75230457-75230487
  misc_feature 1..30: note = hyper
  source 1..30: mol_type = genomic DNA
ggttagtaagtcacacgcacagctctccaa

SEQ ID NO: 92444 - DNA, 394 bp, Homo sapiens
  misc_feature 1..394: note = chr4:75230736-75231130
  misc_feature 1..394: note = hyper
  source 1..394: mol_type = genomic DNA
tgacggtcctcctgccgctcctccctcgggccaattatgaaactctgggcactcttgacctcaccccgttagggcccgggaggggctccctagtataaagttcgcagcaccagacagttgagctcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtaagttctccccctctggcttccggccgccccaaaga

SEQ ID NO: 92445 - DNA, 29 bp, Homo sapiens
  misc_feature 1..29: note = chr4:75241002-75241031
  misc_feature 1..29: note = hypo
  source 1..29: mol_type = genomic DNA
taaagtaatgactagcgattctttttttt

SEQ ID NO: 92446 - DNA, 148 bp, Homo sapiens; identical to SEQ ID NO: 40299
  misc_feature 1..148: note = chr4:75241331-75241479
  misc_feature 1..148: note = hypo
  source 1..148: mol_type = genomic DNA

SEQ ID NO: 92447 - DNA, 107 bp, Homo sapiens
  misc_feature 1..107: note = chr4:7542297-7542404
  misc_feature 1..107: note = hypo
  source 1..107: mol_type = genomic DNA
atggtcccatggtgccgagatgctttggcgctgcgctgcatcctgctgcgcagttcttcctcccgagggtctggccagcatcacccgctccccggcccacacatctg

SEQ ID NO: 92448 - DNA, 30 bp, Homo sapiens
  misc_feature 1..30: note = chr4:757296-757326
  misc_feature 1..30: note = hypo
  source 1..30: mol_type = genomic DNA
acgcaaggaaaactgcgtggcaccacgcgt

SEQ ID NO: 92449 - DNA, 66 bp, Homo sapiens
  misc_feature 1..66: note = chr4:75858458-75858524
  misc_feature 1..66: note = hyper
  source 1..66: mol_type = genomic DNA
taccagcgcccagtgcgctctgtcagtccgcaaactccttgccgcccgccccgggctgggcaccaa

SEQ ID NO: 92450 - DNA, 79 bp, Homo sapiens
  misc_feature 1..79: note = chr4:75858919-75858998
  misc_feature 1..79: note = hyper
  source 1..79: mol_type = genomic DNA
cactctgccaaagtacgggaccagacttcttgttgccgttgggccctggaagggatgaaaaagccggggaagtgggggt

SEQ ID NO: 92451 - DNA, 65 bp, Homo sapiens
  misc_feature 1..65: note = chr4:75859363-75859428
  misc_feature 1..65: note = hyper
  source 1..65: mol_type = genomic DNA
ccagatgactgagctcggcttggcggggaccggggagagattcagaaagacgctttgaatctaga

SEQ ID NO: 92452 - DNA, 104 bp, Homo sapiens
  misc_feature 1..104: note = chr4:759737-759841
  misc_feature 1..104: note = hypo
  source 1..104: mol_type = genomic DNA
cctcagcacccttcccgatgaagtaggtccttctcgcctccacccctgctaagcaggcactgtgcgttcttgtgtcttccagaaggcgccgctcctgctgcact

SEQ ID NO: 92453 - DNA, 30 bp, Homo sapiens
  misc_feature 1..30: note = chr4:7602064-7602094
  misc_feature 1..30: note = hypo
  source 1..30: mol_type = genomic DNA
gaggaacccccacagcgtggaggcttccct

SEQ ID NO: 92454 - DNA, 19 bp, Homo sapiens
  misc_feature 1..19: note = chr4:76394243-76394262
  misc_feature 1..19: note = hypo
  source 1..19: mol_type = genomic DNA
ccagcatcctgttcccgta

SEQ ID NO: 92455 - DNA, 233 bp, Homo sapiens; identical to SEQ ID NO: 40255
  misc_feature 1..233: note = chr4:7647740-7647973
  misc_feature 1..233: note = hypo
  source 1..233: mol_type = genomic DNA

SEQ ID NO: 92456 - DNA, 216 bp, Homo sapiens
  misc_feature 1..216: note = chr4:76555331-76555547
  misc_feature 1..216: note = hyper
  source 1..216: mol_type = genomic DNA
aactagcaattccagcgctgttgtgatttcttctgcggacgcagtcacgagtccagggcgaagcaggcagggaggcaggtgggcctcggtccgccgcaagctcacacttaggaggaccacgggccgcatgctgtcgtcgtcaaggcaacgacctcactctgtccccaaccataggcacaaagtcttgggagacagatacggcccaggtcagaatgc

SEQ ID NO: 92457 - DNA, 357 bp, Homo sapiens
  misc_feature 1..357: note = chr4:76555548-76555905
  misc_feature 1..357: note = hyper
  source 1..357: mol_type = genomic DNA
ttcacggcaggcaccaacacctgtgaaggccaagggctagagagcaattagctgggtgagaggcaccacctcccagctcgtaaggcgcccagtacctggagcctgggaacctgcaccgctccaactacccctgggcgaaggcgttggccgcggagctgcaagggggggcggtttctcacccgccccgagagcgccaggcctcccttcttctgattggccgagccgagtcgtcacgagccatgattggctcagggccaaccaccccgccccttcacctagggctcggcccaggttctgctccctgacacgcagaggccctgcgtccccacacgccttggttctcgtcaggaggcgcct

SEQ ID NO: 92458 - DNA, 75 bp, Homo sapiens
  misc_feature 1..75: note = chr4:7679887-7679962
  misc_feature 1..75: note = hypo
  source 1..75: mol_type = genomic DNA
gacacagcacaggggcggttggccagcctggggcaggagtcagggagtgcttcctggaggcggctgagcaggagt

SEQ ID NO: 92459 - DNA, 30 bp, Homo sapiens
  misc_feature 1..30: note = chr4:76860425-76860455
  misc_feature 1..30: note = hypo
  source 1..30: mol_type = genomic DNA
aggataaatgcagggcgacaaataagggca

SEQ ID NO: 92460 - DNA, 44 bp, Homo sapiens
  misc_feature 1..44: note = chr4:76912367-76912411
  misc_feature 1..44: note = hypo
  source 1..44: mol_type = genomic DNA
taaatgaggattaatcgtttatttttaatcccgcagtctaaaat

SEQ ID NO: 92461 - DNA, 223 bp, Homo sapiens
  misc_feature 1..223: note = chr4:76912711-76912934
  misc_feature 1..223: note = hypo
  source 1..223: mol_type = genomic DNA
accgtggcgctagataacactattccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaaccatcgttataagctttgt

SEQ ID NO: 92462 - DNA, 39 bp, Homo sapiens
  misc_feature 1..39: note = chr4:77156176-77156215
  misc_feature 1..39: note = hypo
  source 1..39: mol_type = genomic DNA
taaaaataaattggccggtcgcggtggctcacacctgta

SEQ ID NO: 92463 - DNA, 85 bp, Homo sapiens
  misc_feature 1..85: note = chr4:77172970-77173055
  misc_feature 1..85: note = hyper
  source 1..85: mol_type = genomic DNA
caggtaaacactcagcgcccgggccgagggcgcatcccacgcgggccgcgcgggggcgcctggagacccgcgcttgctggggcgg

SEQ ID NO: 92464 - DNA, 52 bp, Homo sapiens
  misc_feature 1..52: note = chr4:77227473-77227525
  misc_feature 1..52: note = hyper
  source 1..52: mol_type = genomic DNA
tccctggggagaaggcgccgaggtgcccggtgcgggccgaggcagggctggg

SEQ ID NO: 92465 - DNA, 423 bp, Homo sapiens
  misc_feature 1..423: note = chr4:77228029-77228452
  misc_feature 1..423: note = hyper
  source 1..423: mol_type = genomic DNA
ggagcaggagaaagacgcccctcttgggggagctgcgattccgggaggccatcagagtggcagcagcggactgagccctggaccttccgggcaggagctggtcaccaaaccaggtattcttccccccgtgactccagggcacatctgccagagctttgaggttcatcgaggaagggagcaaagagacaaacccacctggagctttcctaggggcccattcctgcggacgggctctcctaaggggactgggccatccccacgcccctcggtttcccaggctggttggtacgcgcaggcaggtttcttgtctggtcctccaagggccgcgcccttgccgagtccctcagcgcccgcgcctgaggacttggtcctgcccctccggcggggatgagctcctccacttggcggcgcttggtgcagtgc

SEQ ID NO: 92466 - DNA, 413 bp, Homo sapiens
  misc_feature 1..413: note = chr4:7741281-7741694
  misc_feature 1..413: note = hypo
  source 1..413: mol_type = genomic DNA
tgcggttgaccctcacgttagagatgaagaagccaaggcccagccaggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttggcactgacatccctatgcccccctctctcccactctcgcctcccggggcctcgccactctacgccctgcagcgcccactgccaggagggggcggagcctcagcccctctcgcacccccttgctgccgatgccgggggcgatccccacgcaggtcagtggctgtggcgggttggggccggcctgggcctcac

SEQ ID NO: 92467 - DNA, 155 bp, Homo sapiens
  misc_feature 1..155: note = chr4:7742306-7742461
  misc_feature 1..155: note = hypo
  source 1..155: mol_type = genomic DNA
tgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccc

SEQ ID NO: 92468 - DNA, 16 bp, Homo sapiens
  misc_feature 1..16: note = chr4:774267-774283
  misc_feature 1..16: note = hypo
  source 1..16: mol_type = genomic DNA
gcgcccagcctgtgtt

SEQ ID NO: 92469 - DNA, 30 bp, Homo sapiens
  misc_feature 1..30: note = chr4:77488004-77488034
  misc_feature 1..30: note = hypo
  source 1..30: mol_type = genomic DNA
tgctttgggcatcttcgcatgtggcagctc

SEQ ID NO: 92470 - DNA, 30 bp, Homo sapiens
  misc_feature 1..30: note = chr4:7758476-7758506
  misc_feature 1..30: note = hypo
  source 1..30: mol_type = genomic DNA
ccgggccgcatcccacgtggggtgactcgc

SEQ ID NO: 92471 - DNA, 69 bp, Homo sapiens
  misc_feature 1..69: note = chr4:77610972-77611041
  misc_feature 1..69: note = hyper
  source 1..69: mol_type = genomic DNA
tcccaggggctttcacggccagcaccccggctgatgggggcaggtggcgtgctccgagggtctcctgac

SEQ ID NO: 92472 - DNA, 177 bp, Homo sapiens
  misc_feature 1..177: note = chr4:77818008-77818185
  misc_feature 1..177: note = hyper
  source 1..177: mol_type = genomic DNA
gcagcaccgaccaggcgcggatagggccctgatcacgggcctcgggcacctgcgggtgcctggccacccactctcgagtgcgctgctgctgctgctgcagggtcgaataatgcagggagctgggggtcagcagctccggccggtctccgcggggagcggggccgggcaggagagcag

SEQ ID NO: 92473 - DNA, 97 bp, Homo sapiens
  misc_feature 1..97: note = chr4:77818657-77818754
  misc_feature 1..97: note = hyper
  source 1..97: mol_type = genomic DNA
cggctccccccggcgcgcgcctcgcggggagcagggcgcagctccccctgcactgggggcggccgcgggcggctcgcggggtcgctgcagcccctcc

SEQ ID NO: 92474 - DNA, 35 bp, Homo sapiens
  misc_feature 1..35: note = chr4:77819538-77819573
  misc_feature 1..35: note = hyper
  source 1..35: mol_type = genomic DNA
gttcctctaagtctccgccacgcaggaaacaaaag

SEQ ID NO: 92475 - DNA, 101 bp, Homo sapiens
  misc_feature 1..101: note = chr4:77869970-77870071
  misc_feature 1..101: note = hyper
  source 1..101: mol_type = genomic DNA
ctgttgccgtcgccacgccctccagccgcagccccagcgcgcattcctacgggtcgccgggtctgtcgccagcgatcgaatgaagtcggctgatcccccac

SEQ ID NO: 92476 - DNA, 126 bp, Homo sapiens
  misc_feature 1..126: note = chr4:779768-779894
  misc_feature 1..126: note = hyper
  source 1..126: mol_type = genomic DNA
gcgagggggccaggccggggggcggagagcggccgcgtgcggacgcaaatactcacggcggagcgatccgaaccccggagtccgcgtgcaggagggggacccaggccccgccgccctcgccccgcc

SEQ ID NO: 92477 - DNA, 146 bp, Homo sapiens
  misc_feature 1..146: note = chr4:780132-780278
  misc_feature 1..146: note = hyper
  source 1..146: mol_type = genomic DNA
gccgggtgagggaggcggcgggcgcgggcagggcgggcctggggctatggcttatatcggcgtgggggctgcgctctgctcgtccctcaggggcctccgcggaggatctgtagggggaggggcgggggctccgcggggccgctgtc

SEQ ID NO: 92478 - DNA, 152 bp, Homo sapiens
  misc_feature 1..152: note = chr4:78584348-78584500
  misc_feature 1..152: note = hypo
  source 1..152: mol_type = genomic DNA
gaacctagctccacccgctgtctgcttctgactcactttactcttccctttattcttagaacaattaaaaagaattctcgcccggtcttgcactgggaagctatgcttgcacttgagccttcttcaaatctgtttctatcccaagtggctta

SEQ ID NO: 92479 - DNA, 156 bp, Homo sapiens
  misc_feature 1..156: note = chr4:786342-786498
  misc_feature 1..156: note = hyper
  source 1..156: mol_type = genomic DNA
ctgggtccttctcctcgtcaccccccagcatcttccccatgtccttggtggcccctggtacagaagttggtgattcagaccgccccattcagatgtccagggccgggctagtgtctcagccacactcccccaccttctggccgaccccccaaaccc

SEQ ID NO: 92480 - DNA, 818 bp, Homo sapiens
  misc_feature 1..818: note = chr4:788774-789592
  misc_feature 1..818: note = hyper
  source 1..818: mol_type = genomic DNA
ctgggctggtccaggcgccaaaggcttctggaaggcccacctctaaggagccgaggattcgtgctccccgcaggctgcaaagccactaggctcagagggacccgccgcgaacctggggagcgtcacagatgccgcccacgcccccccgcttttcggcccgggtactgcagggaggcgcctccagaaccacttccaaaagctgggaattgggcgcagccaggagcgcaacagaaactgcgggaagcttgttcctggcacagaaacccaaagtgccatttgctctcccggcacagacgccggagcggcgagaccggcgcagaacgggcggccccgagcactgctgcgaccccgccggcctcgacctcgacaccccgcgaccccgccggaccctggaagcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggataaaccctctggggagggagttcagtcccagcgggaggggcccttcccacccgggagctcgccccaaaccgggtggagaggggg

SEQ ID NO: 92481 - DNA, 30 bp, Homo sapiens
  misc_feature 1..30: note = chr4:7941161-7941191
  misc_feature 1..30: note = hyper
  source 1..30: mol_type = genomic DNA
gggagcagtggggaccggcccccacccgca

SEQ ID NO: 92482 - DNA, 75 bp, Homo sapiens
  misc_feature 1..75: note = chr4:7941713-7941788
  misc_feature 1..75: note = hyper
  source 1..75: mol_type = genomic DNA
caaagggaggttgggcggggcggtgctgggactgggcttgcggggtcccgcgggaggacccgcctcaaagagccg

SEQ ID NO: 92483 - DNA, 192 bp, Homo sapiens
  misc_feature 1..192: note = chr4:79472791-79472983
  misc_feature 1..192: note = hyper
  source 1..192: mol_type = genomic DNA
tacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttact

SEQ ID NO: 92484 - DNA, 78 bp, Homo sapiens
  misc_feature 1..78: note = chr4:79473033-79473111
  misc_feature 1..78: note = hyper
  source 1..78: mol_type = genomic DNA
cgtccccgcgagcctcgcccacagccgcctgctgacgggtggcttggggaggtcgcggcgcctcgcccagttcccccg

SEQ ID NO: 92485 - DNA, 20 bp, Homo sapiens
  misc_feature 1..20: note = chr4:7960311-7960331
  misc_feature 1..20: note = hypo
  source 1..20: mol_type = genomic DNA
cctacaggccaggcacggtg

SEQ ID NO: 92486 - DNA, 143 bp, Homo sapiens
  misc_feature 1..143: note = chr4:7968382-7968525
  misc_feature 1..143: note = hypo
  source 1..143: mol_type = genomic DNA
ggggccagggcacctcgagaacgctgggaaggtgggctgggctgcagccacctgtgtgctccatctgatgcccgacacagccactctacagcctctccctgacaccaagccacagcggggaagggtggcgtgaagctagccgt

SEQ ID NO: 92487 - DNA, 166 bp, Homo sapiens
  misc_feature 1..166: note = chr4:79689605-79689771
  misc_feature 1..166: note = hypo
  source 1..166: mol_type = genomic DNA
ttttctctgctcacacgcagtgtcgtggcagcaggcacagtcttgagatgcagaaggacagcggcgagcttgtggacctgtacatgcggcagaaagtctctgctagtaaccgcgtcaccggtgccaagaaccatgcatccatccagatgaacgtggtggaggctga

SEQ ID NO: 92488 - DNA, 99 bp, Homo sapiens
  misc_feature 1..99: note = chr4:79861382-79861481
  misc_feature 1..99: note = hypo
  source 1..99: mol_type = genomic DNA
atgtgtataatagaacgcttagtccattgtttggcattgtaagggcaagaaaaatatcttgtcctcacttatcacaaggttcacagctgacattcctat

SEQ ID NO: 92489 - DNA, 63 bp, Homo sapiens
  misc_feature 1..63: note = chr4:80329437-80329500
  misc_feature 1..63: note = hypo
  source 1..63: mol_type = genomic DNA
agcacaaggcgcaggcgcaaggcaacctttgccctttaactggcgcggcgccttctcacccca

SEQ ID NO: 92490 - DNA, 110 bp, Homo sapiens
  misc_feature 1..110: note = chr4:8039486-8039596
  misc_feature 1..110: note = hypo
  source 1..110: mol_type = genomic DNA
acccctcagcagggtcgggggcccttctgtcctgtctacctctggcctaccctggcccacagtggcgctcctgcccttgctgaatgaatgcgggacgctgggagaacccc

SEQ ID NO: 92491 - DNA, 506 bp, Homo sapiens
  misc_feature 1..506: note = chr4:81106086-81106592
  misc_feature 1..506: note = hyper
  source 1..506: mol_type = genomic DNA
taaagacagcctccccggacagtcttcaccgttttttttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtgtgcctgtgttgagtctgtcttttaatcccgaacgtaattctaaaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtg

SEQ ID NO: 92492 - DNA, 325 bp, Homo sapiens; identical to SEQ ID NO: 28986
  misc_feature 1..325: note = chr4:81123055-81123380
  misc_feature 1..325: note = hyper
  source 1..325: mol_type = genomic DNA

SEQ ID NO: 92493 - DNA, 232 bp, Homo sapiens; identical to SEQ ID NO: 28987
  misc_feature 1..232: note = chr4:81123381-81123613
  misc_feature 1..232: note = hyper
  source 1..232: mol_type = genomic DNA

SEQ ID NO: 92494 - DNA, 290 bp, Homo sapiens; identical to SEQ ID NO: 28988
  misc_feature 1..290: note = chr4:81123614-81123904
  misc_feature 1..290: note = hyper
  source 1..290: mol_type = genomic DNA

SEQ ID NO: 92495 - DNA, 610 bp, Homo sapiens; identical to SEQ ID NO: 28989
  misc_feature 1..610: note = chr4:81124121-81124731
  misc_feature 1..610: note = hyper
  source 1..610: mol_type = genomic DNA

SEQ ID NO: 92496 - DNA, 92 bp, Homo sapiens
  misc_feature 1..92: note = chr4:81186703-81186795
  misc_feature 1..92: note = hyper
  source 1..92: mol_type = genomic DNA
ataacagtctggggacgttgcccgtacagggaaattctctgttctcaaggaaattttcccttctcgggtttcctgaggttgaaatccagcgc

SEQ ID NO: 92497 - DNA, 1002 bp, Homo sapiens
  misc_feature 1..1002: note = chr4:81186796-81187798
  misc_feature 1..1002: note = hyper
  source 1..1002: mol_type = genomic DNA
cacgtcattaatcattcactgaggtcggtccctcagtcaatggcaggtctgggtaagctaaagcgagcagttagctaacccttcctgccacggggatcctggggcgaaagaggacaactgggcggtcagttacatgtgctggtgtccagccgctgcctctctttccccggtcggagcgcgggggtgcgtgtgccctcactctcacgaatacagacggagagcttcccagaaggaaaaacaaattcgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 92498 - DNA, 517 bp, Homo sapiens; identical to SEQ ID NO: 28992
  misc_feature 1..517: note = chr4:81187799-81188316
  misc_feature 1..517: note = hyper
  source 1..517: mol_type = genomic DNA

SEQ ID NO: 92499 - DNA, 172 bp, Homo sapiens
  misc_feature 1..172: note = chr4:81188384-81188556
  misc_feature 1..172: note = hyper
  source 1..172: mol_type = genomic DNA
cgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgt

SEQ ID NO: 92500 - DNA, 231 bp, Homo sapiens
  misc_feature 1..231: note = chr4:81189430-81189661
  misc_feature 1..231: note = hyper
  source 1..231: mol_type = genomic DNA
agatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccac

SEQ ID NO: 92501 - DNA, 306 bp, Homo sapiens
  misc_feature 1..306: note = chr4:81189713-81190019
  misc_feature 1..306: note = hyper
  source 1..306: mol_type = genomic DNA
cgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagcgagtcccagggcctccctcacactcccgagaggaatctatttccatattttagagtttatttcactcatcgaataactgctcat

SEQ ID NO: 92502 - DNA, 463 bp, Homo sapiens
  misc_feature 1..463: note = chr4:81256776-81257239
  misc_feature 1..463: note = hyper
  source 1..463: mol_type = genomic DNA
gaaactgcaacaaaccgccggggggtgggattaacgtccaaagctcacaccggcttcaactgattggcaggaacgaagtgggtggagcctcctgaccctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 92503 - DNA, 76 bp, Homo sapiens
  misc_feature 1..76: note = chr4:8128936-8129012
  misc_feature 1..76: note = hypo
  source 1..76: mol_type = genomic DNA
gtgctggagtccagacgcagctccgataccagcaccgtgtgaggttggatcagactcttcccgtccccagccttag

SEQ ID NO: 92504 - DNA, 465 bp, Homo sapiens
  misc_feature 1..465: note = chr4:81307611-81308076
  misc_feature 1..465: note = hypo
  source 1..465: mol_type = genomic DNA
tgcgcccaccactgccgccacggcgcggggctgccctcttctcgcgggcggtggtggggggggggggtgccgccgggtttgcaggtccttttccttctgggggccgagacgacagcggtgatctttgaggtatttgtggcggaaaaagcccttggcacagccagcatagcggaacttgtagtagcccgtgtgggcgcgcaggtgctcggcgaggtgggcacggcggctgaaggacctgctgcacagggcgcatttgtggagcttcatgccggagtgggagaggacatgggccttcagcttgtccggccggttgaacaacttaccgcagcttgtgtgcgtcgataaagggcatttatatttcttgaagggctggtggatcaacatgtctctcttacagtttgtccttgaggttgaatgcggactcgcacaccgagcatttgtagggcttctcgcctgagtggttgt

SEQ ID NO: 92505 - DNA, 118 bp, Homo sapiens
  misc_feature 1..118: note = chr4:819123-819241
  misc_feature 1..118: note = hyper
  source 1..118: mol_type = genomic DNA
agagacactgtttgacggttcacccctcgccctccgcagaggaaggagactcgcgcggggactgggagggcggcgggcggggagcgcccctcggaggctttgccgcagcgccgattct

SEQ ID NO: 92506 - DNA, 191 bp, Homo sapiens
  misc_feature 1..191: note = chr4:81951310-81951501
  misc_feature 1..191: note = hyper
  source 1..191: mol_type = genomic DNA
aacatgatattgactcgcacatatttctcacctcgagagaagatgatgcgggagagaggggcgttatgatgggtatgctctcagaaagacaggaagctatgatgacgggctgcaggtgcaggggcccgcagtgtccgtcagaagaggctcgggaaagtaagcgagaatggtgttcacgttgtgactttgtt

SEQ ID NO: 92507 - DNA, 100 bp, Homo sapiens; identical to SEQ ID NO: 28997
  misc_feature 1..100: note = chr4:81951777-81951877
  misc_feature 1..100: note = hyper
  source 1..100: mol_type = genomic DNA

SEQ ID NO: 92508 - DNA, 375 bp, Homo sapiens; identical to SEQ ID NO: 28998
  misc_feature 1..375: note = chr4:81951937-81952312
  misc_feature 1..375: note = hyper
  source 1..375: mol_type = genomic DNA

SEQ ID NO: 92509 - DNA, 573 bp, Homo sapiens; identical to SEQ ID NO: 28999
  misc_feature 1..573: note = chr4:81952363-81952936
  misc_feature 1..573: note = hyper
  source 1..573: mol_type = genomic DNA

SEQ ID NO: 92510 - DNA, 338 bp, Homo sapiens
  misc_feature 1..338: note = chr4:8201112-8201450
  misc_feature 1..338: note = hyper
  source 1..338: mol_type = genomic DNA
ctctgaggaacacgccgcaggtatggggggctccggggcaggcggggcgtggactggccgagcaggctgctgtctgccagtcttgccatggttggatctttacactttcttgaggacttttctgacctgtttgggatgggggtggagcgaaactgcgagctgggggcctcggggaggtcgtcggcaccctcagcagaccccactcagagctcacaggtgctggcagtgccaatccgcagtgattgagggcaatgatttcagctttgaccaagcacccttgcttctgggacctggcctgaccccgtgctggcccttggcatgagcggccctgggggtct

SEQ ID NO: 92511 - DNA, 98 bp, Homo sapiens
  misc_feature 1..98: note = chr4:82135686-82135784
  misc_feature 1..98: note = hyper
  source 1..98: mol_type = genomic DNA
caactacccagagctcgacgaagcaaagccgggagcgcaagccctgacagcaccgccaagcccctagctcggagcaacagcctccaccgcttctcctc

SEQ ID NO: 92512 - DNA, 103 bp, Homo sapiens
  misc_feature 1..103: note = chr4:82135785-82135888
  misc_feature 1..103: note = hyper
  source 1..103: mol_type = genomic DNA
ctaaacctagagaaccctgaggactccccactggggctgagcccctcccgccctcaacagaacctctaaacacaagtagcctttccctgcctccaggagctca

SEQ ID NO: 92513 - DNA, 286 bp, Homo sapiens; identical to SEQ ID NO: 29001
  misc_feature 1..286: note = chr4:82135919-82136205
  misc_feature 1..286: note = hyper
  source 1..286: mol_type = genomic DNA

SEQ ID NO: 92514 - DNA, 734 bp, Homo sapiens
  misc_feature 1..734: note = chr4:82136243-82136977
  misc_feature 1..734: note = hyper
  source 1..734: mol_type = genomic DNA
cgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccgcagtctgcactttataccccataccctccatagtgaggcaacttaagtagggcgataacatcgtggttgtaagcatttttgttcatgttattatttctatttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggacagagattataccttccgaatctgcaggtct

SEQ ID NO: 92515 - DNA, 86 bp, Homo sapiens
  misc_feature 1..86: note = chr4:82157454-82157540
  misc_feature 1..86: note = hypo
  source 1..86: mol_type = genomic DNA
cgctagatgtccagccgcttgtcttcttccgcggatgtattcctctcgctgtccagcagcttcagtctctgccttgctagggtctc

SEQ ID NO: 92516 - DNA, 183 bp, Homo sapiens
  misc_feature 1..183: note = chr4:8240141-8240324
  misc_feature 1..183: note = hypo
  source 1..183: mol_type = genomic DNA
cccttgcccagcaggcgcccgcccctactcagcatcacactggcactgcatcggtgctcgttgtgggctggggggccagggcgctccagtccagggactgagctcttgggggccttagaacaacatgaggagctgcggcaaccctaagaccccgccccgtatcccccgcggcaggcctggggc

SEQ ID NO: 92517 - DNA, 32 bp, Homo sapiens; identical to SEQ ID NO: 40261
  misc_feature 1..32: note = chr4:8252769-8252801
  misc_feature 1..32: note = hypo
  source 1..32: mol_type = genomic DNA

SEQ ID NO: 92518 - DNA, 828 bp, Homo sapiens
  misc_feature 1..828: note = chr4:8271325-8272153
  misc_feature 1..828: note = hyper
  source 1..828: mol_type = genomic DNA
agtcccaaggcctgccgggtgggtccaggcccggaaggccaggcggggccctgtcggggcctgggcggggctggcggaggggccgggccgccccttccagcgagggcgggctgggcggtcgcctttaaaggcgcgggacccgccgcccgcggaccgtcaggctggagggagctggtccctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtaagcgctcgggggccagggaggaagtgaagcttctttctcttggggaaactaaggccgggagttagggccg

SEQ ID NO: 92519 - DNA, 161 bp, Homo sapiens; identical to SEQ ID NO: 40169
  misc_feature 1..161: note = chr4:828951-829112
  misc_feature 1..161: note = hypo
  source 1..161: mol_type = genomic DNA

SEQ ID NO: 92520 - DNA, 66 bp, Homo sapiens
  misc_feature 1..66: note = chr4:8293769-8293835
  misc_feature 1..66: note = hypo
  source 1..66: mol_type = genomic DNA
tctccatgcaccaggcggtgctgcctggcctccggggtgtagatgccgaagcgtatggtttgtgca

SEQ ID NO: 92521 - DNA, 487 bp, Homo sapiens
  misc_feature 1..487: note = chr4:829521-830008
  misc_feature 1..487: note = hypo
  source 1..487: mol_type = genomic DNA
cccagctcacatcaccgggggcccctcaggacattcaggggccaagacagctttggcagctcccactcctctcccagtggcctctgggctcagacacccggactgcgtcctcaggagtggagctccccgaggaaagagtgcctttgcttcccttgacgtgtcctgcactttgtgtcagccagcgcggcagcaagaacgagcacacggggacagaagctcatctgaacctgccggcccgtgtcggtgtccagcgcggaggcgctgtgtccgcagggcacctgcatcctcataagctggactgactgccgtggggcccggtgccccatgtccagtgcatcccagactagaacaaagacttgcacacggcgtccaccacagcacaagccacagcagccacgggggaggcagccacgggggaggccgcccagcgccatcggcagagcacagacacgcaaactgtggtcccgccacacgtggaccttgattc

SEQ ID NO: 92522 - DNA, 577 bp, Homo sapiens
  misc_feature 1..577: note = chr4:82965332-82965909
  misc_feature 1..577: note = hyper
  source 1..577: mol_type = genomic DNA
ggctcggggctgccccgcggctgcggcggaggggctgggccgggcggggagagctcggcggccgcccgccccgcggcgtccagcggtgcgagtgcgcgcagccccgtccgcagcccgagcctccgctctgcgggagccggggcgccgtcgccgcgctagccttttcctctgaatgtcactattaccatagtaaagggaagggccccgccgagggggtggcgggagggccaacggcgcctcaggatgggcgccaagcgtgagcaagggcagccggcgggcgcagcgccttggcgcagacaccggcccgacccacgcctgggcagggccactcttgcaacactgccgggcgggagcagacgccttaagctccgagggagagcgggcggccggggcgggggagggtctgtggatggaagccgccgggctgacccacttccccagttttcccctcggcagcactcacggaggtggaaaggcgggcgcctcgctctgctgactgacccgggagagtcgctgctgccagatgccagtggcccgcaggagctcctgcactggccggcgccgccccacccttcct

SEQ ID NO: 92523 - DNA, 34 bp, Homo sapiens
  misc_feature 1..34: note = chr4:83149079-83149113
  misc_feature 1..34: note = hypo
  source 1..34: mol_type = genomic DNA
aacaggcaatgcagccgggcgcggtggctcacac

SEQ ID NO: 92524 - DNA, 105 bp, Homo sapiens; identical to SEQ ID NO: 40262
  misc_feature 1..105: note = chr4:8327019-8327124
  misc_feature 1..105: note = hypo
  source 1..105: mol_type = genomic DNA

SEQ ID NO: 92525 - DNA, 153 bp, Homo sapiens
  misc_feature 1..153: note = chr4:83301224-83301377
  misc_feature 1..153: note = hypo
  source 1..153: mol_type = genomic DNA
ccatgaattgactatttttttagcctttcttggttaatttattctgagaagataaatctacaaagagggtgttatttacatgtggtcatgtgactttgcttatttttcctagaaggatatttttctgcaaagaaaaatcgtgctctaatgaca

SEQ ID NO: 92526 - DNA, 169 bp, Homo sapiens
  misc_feature 1..169: note = chr4:83323412-83323581
  misc_feature 1..169: note = hypo
  source 1..169: mol_type = genomic DNA
tttataaagtgttctcgagcccgctgcaaatgatctagacgcttgctggagttgacttgtttcatggtgagggctccttgaaacactggcaccaccaggtacttcaggtcggtggaagcaatctcttccaaatcttcatttcggctgaacaactcgagctgcgataaca

SEQ ID NO: 92527 - DNA, 688 bp, Homo sapiens
  misc_feature 1..688: note = chr4:83482684-83483372
  misc_feature 1..688: note = hyper
  source 1..688: mol_type = genomic DNA
acacctgtcaaaggacggggccggggccggggccggggccgcagcgggcgggctggctggcggcactgcggcggcggggaccgaggcgcgccggctcgggcgttcgcaggtcgcggggcagagccggcaccgactcctggacttgccggggagcgtgcgcccgcggagggctcgggcgggcggccccgcgcccgggacgctatgggagggggccgcagccgagcagggccccgcagccgggcggacccagccgccccagccgcgctgcagcccccgccgtccccggtctccgcctgcgggctgcgcacggggccgggccggacgccccctggctgcgcgacgggcccaggcaggggagggggcgccgcgcctacctgctctggtgcggcggggccgctgtcgcctcgaggggctgtgacctgctgcggtggcggcggcggcagcagtagcggcgggtagggcgcttccttcaggaaggggtgggatctgctcacccgcccgcccggccccctcctgccgcgccggggcccgcccccgacttattctggggtccccgctgctaggccttcggggagagttgatcccctgggtctcgggcttctgccacccccccggggcccctaatagtcacccggggcaggagccgggtgtgggcgggcgagccgcttccttccgaagcctttgtgga

SEQ ID NO: 92528 - DNA, 144 bp, Homo sapiens
  misc_feature 1..144: note = chr4:83551716-83551860
  misc_feature 1..144: note = hypo
  source 1..144: mol_type = genomic DNA
tcaagcacatgacaacgtatatttgacgtattttagctatagcgattaaatcacatgtccacactctaatgttaaatcgtagtaatattgacttgaaaagttttttaggctgggcgcgctggctcccagctactcgggaggctg

SEQ ID NO: 92529 - DNA, 42 bp, Homo sapiens
  misc_feature 1..42: note = chr4:83718792-83718834
  misc_feature 1..42: note = hyper
  source 1..42: mol_type = genomic DNA
ctctcgccatgggatcggtttgctcaccgagaaacttcaccg

SEQ ID NO: 92530 - DNA, 91 bp, Homo sapiens
  misc_feature 1..91: note = chr4:83719334-83719425
  misc_feature 1..91: note = hyper
  source 1..91: mol_type = genomic DNA
gaggcgaggggagaccgggggtcgctgcgcaccgcccgcagccgaggggcgagcggcgacctcgcgcgccccagcgcggcctggccacgga

SEQ ID NO: 92531 - DNA, 30 bp, Homo sapiens; identical to SEQ ID NO: 40263
  misc_feature 1..30: note = chr4:8378202-8378232
  misc_feature 1..30: note = hypo
  source 1..30: mol_type = genomic DNA

SEQ ID NO: 92532 - DNA, 171 bp, Homo sapiens
  misc_feature 1..171: note = chr4:8386144-8386315
  misc_feature 1..171: note = hypo
  source 1..171: mol_type = genomic DNA
gaaaacgggcactgacgggcagtgaattctcttgctcggaatgcggctgctggcggcctgaggacacacccagcgtcaacaacctctgtcctcaagactctcccagaatcctgggtcaccacggcctttccatgtgcctcacaccagaaggactctcgaaggtgcccccag

SEQ ID NO: 92533 - DNA, 21 bp, Homo sapiens
  misc_feature 1..21: note = chr4:83955217-83955238
  misc_feature 1..21: note = hypo
  source 1..21: mol_type = genomic DNA
tacagacgtgagccacggcgc

SEQ ID NO: 92534 - DNA, 30 bp, Homo sapiens
  misc_feature 1..30: note = chr4:84030886-84030916
  misc_feature 1..30: note = hyper
  source 1..30: mol_type = genomic DNA
tgcccgctctgcactcgggaaggggctgtg

SEQ ID NO: 92535 - DNA, 41 bp, Homo sapiens; identical to SEQ ID NO: 14696
  misc_feature 1..41: note = chr4:84169961-84170002
  misc_feature 1..41: note = hypo
  source 1..41: mol_type = genomic DNA

SEQ ID NO: 92536 - DNA, 97 bp, Homo sapiens
  misc_feature 1..97: note = chr4:8483866-8483963
  misc_feature 1..97: note = hypo
  source 1..97: mol_type = genomic DNA
ccttgttcagctctgcgtccctcttccagttccagcagctcatttgtcagttcttcaggaaccgcctggaggcactcctcaacggcatcctcctcca

SEQ ID NO: 92537 - DNA, 678 bp, Homo sapiens
  misc_feature 1..678: note = chr4:85402747-85403425
  misc_feature 1..678: note = hyper
  source 1..678: mol_type = genomic DNA
cccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgtca

SEQ ID NO: 92538 - DNA, 152 bp, Homo sapiens; identical to SEQ ID NO: 29009
  misc_feature 1..152: note = chr4:85403776-85403928
  misc_feature 1..152: note = hyper
  source 1..152: mol_type = genomic DNA

SEQ ID NO: 92539 - DNA, 30 bp, Homo sapiens; identical to SEQ ID NO: 375
  misc_feature 1..30: note = chr4:85404111-85404141
  misc_feature 1..30: note = hyper
  source 1..30: mol_type = genomic DNA

SEQ ID NO: 92540 - DNA, 252 bp, Homo sapiens; identical to SEQ ID NO: 376
  misc_feature 1..252: note = chr4:85404224-85404476
  misc_feature 1..252: note = hyper
  source 1..252: mol_type = genomic DNA

SEQ ID NO: 92541 - DNA, 83 bp, Homo sapiens
  misc_feature 1..83: note = chr4:85404649-85404732
  misc_feature 1..83: note = hyper
  source 1..83: mol_type = genomic DNA
cgttcggccgggctcagtaaagaatttgccgaaaggtagaaactggaccagagaagggaacacagtgccgggcacatcctagc

SEQ ID NO: 92542 - DNA, 30 bp, Homo sapiens
  misc_feature 1..30: note = chr4:85405081-85405111
  misc_feature 1..30: note = hyper
  source 1..30: mol_type = genomic DNA
tgggcttaaagccatcgataagcaaactac

SEQ ID NO: 92543 - DNA, 47 bp, Homo sapiens
  misc_feature 1..47: note = chr4:85414067-85414114
  misc_feature 1..47: note = hyper
  source 1..47: mol_type = genomic DNA
ccctaccccgccgcccgcgggggcaaaatctgggggcgagggggacc

SEQ ID NO: 92544 - DNA, 189 bp, Homo sapiens; identical to SEQ ID NO: 7440
  misc_feature 1..189: note = chr4:85414148-85414337
  misc_feature 1..189: note = hyper
  source 1..189: mol_type = genomic DNA

SEQ ID NO: 92545 - DNA, 567 bp, Homo sapiens; identical to SEQ ID NO: 29015
  misc_feature 1..567: note = chr4:85414457-85415024
  misc_feature 1..567: note = hyper
  source 1..567: mol_type = genomic DNA

SEQ ID NO: 92546 - DNA, 30 bp, Homo sapiens
  misc_feature 1..30: note = chr4:85416612-85416642
  misc_feature 1..30: note = hyper
  source 1..30: mol_type = genomic DNA
catcaagagtttgcccgcctgcaagacccc

SEQ ID NO: 92547 - DNA, 479 bp, Homo sapiens; identical to SEQ ID NO: 29016
  misc_feature 1..479: note = chr4:85416904-85417383
  misc_feature 1..479: note = hyper
  source 1..479: mol_type = genomic DNA

SEQ ID NO: 92548 - DNA, 107 bp, Homo sapiens
  misc_feature 1..107: note = chr4:85417612-85417719
  misc_feature 1..107: note = hyper
  source 1..107: mol_type = genomic DNA
ggctgccacagtccccgggcttcccaagagaacctccacttggctttcgcaacttcccgcagttactgccgctcagccgcactaaggaggtccggagacttggaaga

SEQ ID NO: 92549 - DNA, 270 bp, Homo sapiens; identical to SEQ ID NO: 29018
  misc_feature 1..270: note = chr4:85417953-85418223
  misc_feature 1..270: note = hyper
  source 1..270: mol_type = genomic DNA

SEQ ID NO: 92550 - DNA, 106 bp, Homo sapiens; identical to SEQ ID NO: 29019
  misc_feature 1..106: note = chr4:85418264-85418370
  misc_feature 1..106: note = hyper
  source 1..106: mol_type = genomic DNA

SEQ ID NO: 92551 - DNA, 62 bp, Homo sapiens; identical to SEQ ID NO: 29020
  misc_feature 1..62: note = chr4:85418521-85418583
  misc_feature 1..62: note = hyper
  source 1..62: mol_type = genomic DNA

SEQ ID NO: 92552 - DNA, 521 bp, Homo sapiens; identical to SEQ ID NO: 29021
  misc_feature 1..521: note = chr4:85419120-85419641
  misc_feature 1..521: note = hyper
  source 1..521: mol_type = genomic DNA

SEQ ID NO: 92553 - DNA, 230 bp, Homo sapiens; identical to SEQ ID NO: 29022
  misc_feature 1..230: note = chr4:85419661-85419891
  misc_feature 1..230: note = hyper
  source 1..230: mol_type = genomic DNA

SEQ ID NO: 92554 - DNA, 30 bp, Homo sapiens
  misc_feature 1..30: note = chr4:85421883-85421913
  misc_feature 1..30: note = hyper
  source 1..30: mol_type = genomic DNA
tttgatcagcaccaccgacggatggagttt

SEQ ID NO: 92555 - DNA, 279 bp, Homo sapiens; identical to SEQ ID NO: 29023
  misc_feature 1..279: note = chr4:85422188-85422467
  misc_feature 1..279: note = hyper
  source 1..279: mol_type = genomic DNA

SEQ ID NO: 92556 - DNA, 158 bp, Homo sapiens
  misc_feature 1..158: note = chr4:85422771-85422929
  misc_feature 1..158: note = hyper
  source 1..158: mol_type = genomic DNA
agtaaatagttgcaacgcttggtgtaaggatgtctccatcgttcacttttacgtatcatttgcattgccaaattaaaatggcagcattgttcttaattatgacaataaaaaattccggatccgtgtaccttgatccctggtagtgagggggtgagccc

SEQ ID NO: 92557 - DNA, 80 bp, Homo sapiens; identical to SEQ ID NO: 29024
  misc_feature 1..80: note = chr4:85422972-85423052
  misc_feature 1..80: note = hyper
  source 1..80: mol_type = genomic DNA

SEQ ID NO: 92558 - DNA, 197 bp, Homo sapiens; identical to SEQ ID NO: 29025
  misc_feature 1..197: note = chr4:85423633-85423830
  misc_feature 1..197: note = hyper
  source 1..197: mol_type = genomic DNA

SEQ ID NO: 92559 - DNA, 372 bp, Homo sapiens
  misc_feature 1..372: note = chr4:85424135-85424507
  misc_feature 1..372: note = hyper
  source 1..372: mol_type = genomic DNA
ggaaggatagcagggcgagggggagaacgtgtctgtctttctttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtccaggacctccctcagcgatatcgtcagtgagagagaggattacagctctccatagagtcgcagaatacgtacctgggagttaagtgcgctccgaagggtggcttct

SEQ ID NO: 92560 - DNA, 36 bp, Homo sapiens
  misc_feature 1..36: note = chr4:85503856-85503892
  misc_feature 1..36: note = hyper
  source 1..36: mol_type = genomic DNA
agcccgcgctggccccgcctccgcctcccagctcct

SEQ ID NO: 92561 - DNA, 558 bp, Homo sapiens
  misc_feature 1..558: note = chr4:85504235-85504793
  misc_feature 1..558: note = hyper
  source 1..558: mol_type = genomic DNA
ctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtaagtggagccgagagaggcggacgccgcgccctggctgggtcctggttggaagcgggacacttgagagcaagggtggggcccgtccagcgtcaggtgaggctgcacgctgccggtgcacc

SEQ ID NO: 92562 - DNA, 113 bp, Homo sapiens
  misc_feature 1..113: note = chr4:8582115-8582228
  misc_feature 1..113: note = hyper
  source 1..113: mol_type = genomic DNA
tataagccaccaggtcgctccagtttggtgccagcgcctggagggagaggcgtggcgagggctgtgctgcctaggatccactgagtggctcttgctggcgtgtcagctgcgcg

SEQ ID NO: 92563 - DNA, 30 bp, Homo sapiens
  misc_feature 1..30: note = chr4:8582549-8582579
  misc_feature 1..30: note = hyper
  source 1..30: mol_type = genomic DNA
ccgccgctttcctcgcgctgctctggacct

SEQ ID NO: 92564 - DNA, 86 bp, Homo sapiens
  misc_feature 1..86: note = chr4:85887114-85887200
  misc_feature 1..86: note = hyper
  source 1..86: mol_type = genomic DNA
ctccccaggaggcagcggaggactagggccaggccgcccaccctggcggcggcggcggctcccggccaaggcggaccctggggagg

SEQ ID NO: 92565 - DNA, 49 bp, Homo sapiens
  misc_feature 1..49: note = chr4:85887878-85887927
  misc_feature 1..49: note = hyper
  source 1..49: mol_type = genomic DNA
ctcctcctactgagccggccgcagaaattgcagccgctcagcttctacc

SEQ ID NO: 92566 - DNA, 34 bp, Homo sapiens
  misc_feature 1..34: note = chr4:85888365-85888399
  misc_feature 1..34: note = hyper
  source 1..34: mol_type = genomic DNA
ctcctgtgtggctcccgtccgtgatgggactgta

SEQ ID NO: 92567 - DNA, 30 bp, Homo sapiens
  misc_feature 1..30: note = chr4:8588860-8588890
  misc_feature 1..30: note = hypo
  source 1..30: mol_type = genomic DNA
tggccgacccgttcacgtactctctgctcc

SEQ ID NO: 92568 - DNA, 62 bp, Homo sapiens
  misc_feature 1..62: note = chr4:8594397-8594459
  misc_feature 1..62: note = hyper
  source 1..62: mol_type = genomic DNA
ctctctagcttctggcgctgcccactgtaacccgactccggcatttgcgtttggggcgccct

SEQ ID NO: 92569 - DNA, 30 bp, Homo sapiens
  misc_feature 1..30: note = chr4:8603223-8603253
  misc_feature 1..30: note = hypo
  source 1..30: mol_type = genomic DNA
ggtaagggaaagtggcgggggcctgtgtgg

SEQ ID NO: 92570 - DNA, 258 bp, Homo sapiens
  misc_feature 1..258: note = chr4:8607707-8607965
  misc_feature 1..258: note = hypo
  source 1..258: mol_type = genomic DNA
gcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctggatcctgtgggccaccgcccgaaccaccccctca

SEQ ID NO: 92571 - DNA, 30 bp, Homo sapiens
  misc_feature 1..30: note = chr4:8608178-8608208
  misc_feature 1..30: note = hypo
  source 1..30: mol_type = genomic DNA
ggtcagggtagctctcggggaggtgggcaa

SEQ ID NO: 92572 - DNA, 143 bp, Homo sapiens
  misc_feature 1..143: note = chr4:8608508-8608651
  misc_feature 1..143: note = hypo
  source 1..143: mol_type = genomic DNA
aacctggatctgaaccgaaatttcccggacctgacgtccgagtactaccggctggcggagacccgcggcgcacgcagcgaccacatccccatcccccagcactactggtggggtaaggtaggagccgccgctgcccatgctgg

SEQ ID NO: 92573 - DNA, 106 bp, Homo sapiens
  misc_feature 1..106: note = chr4:8615814-8615920
  misc_feature 1..106: note = hypo
  source 1..106: mol_type = genomic DNA
tcatgccgccatctgcggatctgcaaagtggggatcatatggtccaccttgcagttgttcagcccctcagctgcaggaggggcgtctgtggcgagtacctgctgca

SEQ ID NO: 92574 - DNA, 30 bp, Homo sapiens
  misc_feature 1..30: note = chr4:8620407-8620437
  misc_feature 1..30: note = hypo
  source 1..30: mol_type = genomic DNA
aggaaccagggtctgcgtctccttacagca

SEQ ID NO: 92575 - DNA, 30 bp, Homo sapiens
  misc_feature 1..30: note = chr4:8620650-8620680
  misc_feature 1..30: note = hypo
  source 1..30: mol_type = genomic DNA
gccgatgaaaaatgacggtatgctgtgata

SEQ ID NO: 92576 - DNA, 30 bp, Homo sapiens
  misc_feature 1..30: note = chr4:8647534-8647564
  misc_feature 1..30: note = hypo
  source 1..30: mol_type = genomic DNA
cgtgttggggaggagcgtggtgtggctggc

SEQ ID NO: 92577 - DNA, 30 bp, Homo sapiens
  misc_feature 1..30: note = chr4:8648137-8648167
  misc_feature 1..30: note = hypo
  source 1..30: mol_type = genomic DNA
ggatctgtgagatgccgggaaggacccgga

SEQ ID NO: 92578 - DNA, 46 bp, Homo sapiens
  misc_feature 1..46: note = chr4:8648553-8648599
  misc_feature 1..46: note = hypo
  source 1..46: mol_type = genomic DNA
tacgtggaaatgggccgtggctgggaggcggcgggcttgtgagagg

SEQ ID NO: 92579 - DNA, 203 bp, Homo sapiens
  misc_feature 1..203: note = chr4:8689984-8690187
  misc_feature 1..203: note = hyper
  source 1..203: mol_type = genomic DNA
tcgcccaggtcctcccggacactgctgtcaatgggtatttggttctttcccgtcccttccccggaggcctggcctgcagctccccgcaaggccactgcgtggcgccctgtaccccaggcgggacggccggcgccgagcccaggattcgtccacgcctcgcgcagtggagcttacgggagatgcgcgaccgtcatccttccctt

SEQ ID NO: 92580 - DNA, 30 bp, Homo sapiens; identical to SEQ ID NO: 40312
  misc_feature 1..30: note = chr4:86922651-86922681
  misc_feature 1..30: note = hypo
  source 1..30: mol_type = genomic DNA

SEQ ID NO: 92581 - DNA, 30 bp, Homo sapiens
  misc_feature 1..30: note = chr4:870008-870038
  misc_feature 1..30: note = hypo
  source 1..30: mol_type = genomic DNA
cagcaggctcaggaacgtttgctaagatgc

SEQ ID NO: 92582 - DNA, 36 bp, Homo sapiens
  misc_feature 1..36: note = chr4:8700182-8700218
  misc_feature 1..36: note = hypo
  source 1..36: mol_type = genomic DNA
cagggacagcgtgtgcgggatcggggtgagggagag

SEQ ID NO: 92583 - DNA, 495 bp, Homo sapiens
  misc_feature 1..495: note = chr4:87281168-87281663
  misc_feature 1..495: note = hyper
  source 1..495: mol_type = genomic DNA
gaaaccattgtgcagcgtgatgctgcctgtaccattgtggaacctaccagaggagacggacagagggcttggggaatggggttgctatggcaaccgaaaggagcacacatgacgtcaaagcccagagaggtctagggagggggatgagggggaaacagaaagaggaagcgtctatgtgcagctacagctactgtgttttccggtgaaatgaggaccaggcaaatgtaaaggaataaggttcgtcggcagccaacatcagcaactacgacatcaaggcagccagcctgcacaacctgaagaaaagatccattcgatgcagttctggccctttgcacagcagcacggaggagcaaataccagcagagcaaaacaccactggaaatgcaacctctgcttttcaactatctcttgtagtatctctaaacgtcaaacaagtaagagatggtaataacctcagaggagaagcaggcatttgagtgtcgcctgaaccccgag

SEQ ID NO: 92584 - DNA, 1009 bp, Homo sapiens
  misc_feature 1..1009: note = chr4:87515216-87516225
  misc_feature 1..1009: note = hyper
  source 1..1009: mol_type = genomic DNA
agcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaaacccaactcctcggttgccctggtagaaggaacttttctttggttttggtggtgggtgtttttgtacgttagagtgggggtggggtgactggagtggggaagaatgagatgaaactccattgctaattaggtagatccatctcctctgcggaagaaagccggattctcgggaat

SEQ ID NO: 92585 - DNA, 36 bp, Homo sapiens
  misc_feature 1..36: note = chr4:8774988-8775024
  misc_feature 1..36: note = hypo
  source 1..36: mol_type = genomic DNA
ggggcaagctgttcccgagtgcgccagactccctgg

SEQ ID NO: 92586 - DNA, 30 bp, Homo sapiens
  misc_feature 1..30: note = chr4:8778539-8778569
  misc_feature 1..30: note = hypo
  source 1..30: mol_type = genomic DNA
gtactgagcgctcaccgggtaccccctgag

SEQ ID NO: 92587 - DNA, 30 bp, Homo sapiens; identical to SEQ ID NO: 29031
  misc_feature 1..30: note = chr4:87813050-87813080
  misc_feature 1..30: note = hyper
  source 1..30: mol_type = genomic DNA

SEQ ID NO: 92588 - DNA, 92 bp, Homo sapiens
  misc_feature 1..92: note = chr4:87813420-87813512
  misc_feature 1..92: note = hyper
  source 1..92: mol_type = genomic DNA
ggcggcctggttacccgggctccaggggctcggagggtcgcggccggggtactgaggtaagagcgcgctgcgctaagcgcacatggccgcgc

SEQ ID NO: 92589 - DNA, 37 bp, Homo sapiens; identical to SEQ ID NO: 14697
  misc_feature 1..37: note = chr4:87899606-87899643
  misc_feature 1..37: note = hypo
  source 1..37: mol_type = genomic DNA

SEQ ID NO: 92590 - DNA, 38 bp, Homo sapiens
  misc_feature 1..38: note = chr4:8793763-8793801
  misc_feature 1..38: note = hypo
  source 1..38: mol_type = genomic DNA
ccgatgggagacagacgtgcacacgcacacacagaggg

SEQ ID NO: 92591 - DNA, 32 bp, Homo sapiens
  misc_feature 1..32: note = chr4:88010203-88010235
  misc_feature 1..32: note = hypo
  source 1..32: mol_type = genomic DNA
gtattaagccagtttgccgggcaggtctgaca

SEQ ID NO: 92592 - DNA, 30 bp, Homo sapiens; identical to SEQ ID NO: 40315
  misc_feature 1..30: note = chr4:88025280-88025310
  misc_feature 1..30: note = hypo
  source 1..30: mol_type = genomic DNA

SEQ ID NO: 92593 - DNA, 41 bp, Homo sapiens
  misc_feature 1..41: note = chr4:8822099-8822140
  misc_feature 1..41: note = hypo
  source 1..41: mol_type = genomic DNA
cctctctcaggacaacgccatctgtgcgcccccttcaccag

SEQ ID NO: 92594 - DNA, 25 bp, Homo sapiens
  misc_feature 1..25: note = chr4:88296877-88296902
  misc_feature 1..25: note = hypo
  source 1..25: mol_type = genomic DNA
agcaaaactccgtctcaaaaaataa

SEQ ID NO: 92595 - DNA, 258 bp, Homo sapiens
  misc_feature 1..258: note = chr4:8858790-8859048
  misc_feature 1..258: note = hyper
  source 1..258: mol_type = genomic DNA
cacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 92596 - DNA, 557 bp, Homo sapiens; identical to SEQ ID NO: 351
  misc_feature 1..557: note = chr4:8859381-8859938
  misc_feature 1..557: note = hyper
  source 1..557: mol_type = genomic DNA

SEQ ID NO: 92597 - DNA, 210 bp, Homo sapiens
  misc_feature 1..210: note = chr4:8860397-8860607
  misc_feature 1..210: note = hyper
  source 1..210: mol_type = genomic DNA
gtgacactcaggcacacatacaccaatgccccgggcccgctagggacgctgagctccaggcaacgaaaaacgaaggtcctggagtcggtcctgagtgcattcctccactgggccccgtcgagaatgaaactctcggagcatcgtcactgggaggtcctggggggacactggggtgggcgagcttcttcaaagactcggtttccactgggc

SEQ ID NO: 92598 - DNA, 32 bp, Homo sapiens
  misc_feature 1..32: note = chr4:8861124-8861156
  misc_feature 1..32: note = hyper
  source 1..32: mol_type = genomic DNA
atcccagaaaaggcccgcgggacttagaaaat

SEQ ID NO: 92599 - DNA, 136 bp, Homo sapiens
  misc_feature 1..136: note = chr4:8861410-8861546
  misc_feature 1..136: note = hyper
  source 1..136: mol_type = genomic DNA
tgccttctctacacacgtgcgtggtctatgtgacgtggagtcgcactgggacccgaatgaggacatccccccgccccttcgtcatcgtgggaataccgtggaacaaggcgggcaaagggctgatcagctcccgtcc

SEQ ID NO: 92600 - DNA, 148 bp, Homo sapiens; identical to SEQ ID NO: 28781
  misc_feature 1..148: note = chr4:8861605-8861753
  misc_feature 1..148: note = hyper
  source 1..148: mol_type = genomic DNA

SEQ ID NO: 92601 - DNA, 894 bp, Homo sapiens
  misc_feature 1..894: note = chr4:8861918-8862812
  misc_feature 1..894: note = hyper
  source 1..894: mol_type = genomic DNA
cgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaagacgggctcagagagatgaagtgactttcccaaagccacacagcgggccagtgaaggcaccgcgcacggtccaggaatctaacccttcctggggagtggggagggaagggctcgacccgaaggggccaggcggcagagagccccgcgtcccccgccacgggctaagacgcaaggcggcccgccgtgtctccacctgcgcgcctcgagcttcgctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 92602 - DNA, 204 bp, Homo sapiens
  misc_feature 1..204: note = chr4:8863323-8863527
  misc_feature 1..204: note = hyper
  source 1..204: mol_type = genomic DNA
cgtaggcggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 92603 - DNA, 79 bp, Homo sapiens; identical to SEQ ID NO: 28785
  misc_feature 1..79: note = chr4:8863856-8863935
  misc_feature 1..79: note = hyper
  source 1..79: mol_type = genomic DNA

SEQ ID NO: 92604 - DNA, 157 bp, Homo sapiens
  misc_feature 1..157: note = chr4:8864526-8864683
  misc_feature 1..157: note = hyper
  source 1..157: mol_type = genomic DNA
cgtttgctccccaggcggtgaggctggctcttcgaccacttagctgttctcggcgcccgatcctgtgtgtccttccgtgcatgacacgcagagcttagctctgtgaggacagggctgtcccctctccggcccacctatgaaggggtgtccacctctc

SEQ ID NO: 92605 - DNA, 357 bp, Homo sapiens
  misc_feature 1..357: note = chr4:8864763-8865120
  misc_feature 1..357: note = hyper
  source 1..357: mol_type = genomic DNA
cgaatttccggtggctgggacccacttcccagcgggaccctggataggcatgcccactctggctaccagaagggcagggtggccgaagggtatgaagcatatgagtgcacaggcggggaggaacagcagcagcaccagcgcaggagtagcccgctggcctccctcaggcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 92606 - DNA, 30 bp, Homo sapiens
  misc_feature 1..30: note = chr4:8865644-8865674
  misc_feature 1..30: note = hyper
  source 1..30: mol_type = genomic DNA
acgcccaaacaccaccgtagtggcctttcc

SEQ ID NO: 92607 - DNA, 146 bp, Homo sapiens
  misc_feature 1..146: note = chr4:8868700-8868846
  misc_feature 1..146: note = hyper
  source 1..146: mol_type = genomic DNA
tgctcccaggagggacggcacccagcgcagcttgagctgtctctgccctcgtgatcacaaagcagtgaaactgtccagaaaatgtccctttttattccatacgcaaataagtagattcatttaaaaaaacaacaacccggaggctg

SEQ ID NO: 92608 - DNA, 340 bp, Homo sapiens; identical to SEQ ID NO: 28789
  misc_feature 1..340: note = chr4:8868931-8869271
  misc_feature 1..340: note = hyper
  source 1..340: mol_type = genomic DNA

SEQ ID NO: 92609 - DNA, 788 bp, Homo sapiens
  misc_feature 1..788: note = chr4:8869368-8870156
  misc_feature 1..788: note = hyper
  source 1..788: mol_type = genomic DNA
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgag

SEQ ID NO: 92610 - DNA, 395 bp, Homo sapiens
  misc_feature 1..395: note = chr4:8872678-8873073
  misc_feature 1..395: note = hyper
  source 1..395: mol_type = genomic DNA
cagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcc

SEQ ID NO: 92611 - DNA, 211 bp, Homo sapiens; identical to SEQ ID NO: 7286
  misc_feature 1..211: note = chr4:8873773-8873984
  misc_feature 1..211: note = hyper
  source 1..211: mol_type = genomic DNA

SEQ ID NO: 92612 - DNA, 59 bp, Homo sapiens; identical to SEQ ID NO: 7287
  misc_feature 1..59: note = chr4:8874476-8874535
  misc_feature 1..59: note = hyper
  source 1..59: mol_type = genomic DNA

SEQ ID NO: 92613 - DNA, 233 bp, Homo sapiens
  misc_feature 1..233: note = chr4:8875695-8875928
  misc_feature 1..233: note = hyper
  source 1..233: mol_type = genomic DNA
ctgatcctataactgcggacgatacgcgtccctgacggtgccaggttgttgggagtagaggctggccaccaccaggcgggtggtggccctgagcgcataacgctcgcgggtgtcttcccactgcctctggggggcgcgcatgagaggggcgcttccacacactgccgcgtggggcctgggatgggagcgaagaggggcggtggatccgaagcgaggaccgtgcacccttttcc

SEQ ID NO: 92614 - DNA, 139 bp, Homo sapiens
  misc_feature 1..139: note = chr4:8878536-8878675
  misc_feature 1..139: note = hyper
  source 1..139: mol_type = genomic DNA
ggagcagtacagtctcgagacattctcgttgtcttagtctgatccccacgtcgcagccagcaggaaatgtccttgcagctgtggagatgtggatcggaactagggcacctcactccagctcagccgctggcccactaag

SEQ ID NO: 92615 - DNA, 103 bp, Homo sapiens; identical to SEQ ID NO: 28797
  misc_feature 1..103: note = chr4:8879491-8879594
  misc_feature 1..103: note = hyper
  source 1..103: mol_type = genomic DNA

SEQ ID NO: 92616 - DNA, 15 bp, Homo sapiens
  misc_feature 1..15: note = chr4:8879647-8879662
  misc_feature 1..15: note = hyper
  source 1..15: mol_type = genomic DNA
cgggaggggacgctg

SEQ ID NO: 92617 - DNA, 335 bp, Homo sapiens
  misc_feature 1..335: note = chr4:8893391-8893726
  misc_feature 1..335: note = hyper
  source 1..335: mol_type = genomic DNA
cggctcacagacgctccatcctatccgcggacagaaacgaatccgagccgcagctgcacgtttgaaccccgcaaagccactgtgagccggtactgaaaccccaaggaaaagtcggggtttgggggcgggatccttgccccatgtgggttgggaaaagacggtgggaaccttcgggactctggagtggtgaaatgacgggagaggacactcaacactcccgactcatgcccttcagagcggagctctgacctggcctcctccaggcagtcttcccggctgcgtcctgccctatctcctcctccccagctcggcgtttgcagccccgctgggccgcg

SEQ ID NO: 92618 - DNA, 221 bp, Homo sapiens
  misc_feature 1..221: note = chr4:8893815-8894036
  misc_feature 1..221: note = hyper
  source 1..221: mol_type = genomic DNA
cgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtctggagg

SEQ ID NO: 92619 - DNA, 317 bp, Homo sapiens; identical to SEQ ID NO: 28800
  misc_feature 1..317: note = chr4:8894641-8894958
  misc_feature 1..317: note = hyper
  source 1..317: mol_type = genomic DNA

SEQ ID NO: 92620 - DNA, 545 bp, Homo sapiens
  misc_feature 1..545: note = chr4:8895231-8895776
  misc_feature 1..545: note = hyper
  source 1..545: mol_type = genomic DNA
cgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaatgcgaccccaatgagctggcgctcccctctggcgaaggaccaggtggcgaggtcgcccctgtcgtgtggcccaatgcgttaccagcaagaacaaagtcccatcttaactgctcttcgcgcggcttttgaccttgggtcggggctgcgtctcagcgctcaacagccccgcttctccccacggttttaaattac

SEQ ID NO: 92621 - DNA, 134 bp, Homo sapiens; identical to SEQ ID NO: 2375
  misc_feature 1..134: note = chr4:8895964-8896098
  misc_feature 1..134: note = hyper
  source 1..134: mol_type = genomic DNA

SEQ ID NO: 92622 - DNA, 247 bp, Homo sapiens
  misc_feature 1..247: note = chr4:8896117-8896364
  misc_feature 1..247: note = hyper
  source 1..247: mol_type = genomic DNA
cgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtcccaggcctggttgtgccagaggccctgggcgaccttcagcagtg

SEQ ID NO: 92623 - DNA, 30 bp, Homo sapiens
  misc_feature 1..30: note = chr4:89054393-89054423
  misc_feature 1..30: note = hypo
  source 1..30: mol_type = genomic DNA
taatttgtggaataccggtagaagtattct

SEQ ID NO: 92624 - DNA, 128 bp, Homo sapiens; identical to SEQ ID NO: 40316
  misc_feature 1..128: note = chr4:89116521-89116649
  misc_feature 1..128: note = hypo
  source 1..128: mol_type = genomic DNA

SEQ ID NO: 92625 - DNA, 54 bp, Homo sapiens
  misc_feature 1..54: note = chr4:8911942-8911996
  misc_feature 1..54: note = hypo
  source 1..54: mol_type = genomic DNA
tggttgctttcctcacgcttgtgatacggccccaggcaacgggacctgactgct

SEQ ID NO: 92626 - DNA, 106 bp, Homo sapiens
  misc_feature 1..106: note = chr4:89291663-89291769
  misc_feature 1..106: note = hypo
  source 1..106: mol_type = genomic DNA
atgggctacctgcagcgctgctttattgttgtttttaatctgggactcagtaaaatagagcagtctctctctagaaaatcacctgttgtaacggaggaaaagaaaa

SEQ ID NO: 92627 - DNA, 450 bp, Homo sapiens
  misc_feature 1..450: note = chr4:89378317-89378767
  misc_feature 1..450: note = hyper
  source 1..450: mol_type = genomic DNA
gttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtc

SEQ ID NO: 92628 - DNA, 114 bp, Homo sapiens
  misc_feature 1..114: note = chr4:89378831-89378945
  misc_feature 1..114: note = hyper
  source 1..114: mol_type = genomic DNA
cggcgcacctgagctgtcttttatcccggtcagtgtcaggcgcggggtgagcgggatactggcgaccagcggatcctccgctcagcaaagtggccggtgcggggcatgcgggca

SEQ ID NO: 92629 - DNA, 52 bp, Homo sapiens
  misc_feature 1..52: note = chr4:8965616-8965668
  misc_feature 1..52: note = hyper
  source 1..52: mol_type = genomic DNA
gcccaggcctggccccgagcccgctggactcggccgccggccctgcccgtac

SEQ ID NO: 92630 - DNA, 133 bp, Homo sapiens
  misc_feature 1..133: note = chr4:89660145-89660278
  misc_feature 1..133: note = hypo
  source 1..133: mol_type = genomic DNA
gtgttgtaccagccacgggaaggtattctactcacaatgatgggtatggtgttagctcgggagaggatctgtttgaccagccggtacctgtcgtatagtggcttcatcacctgccgttcgttctttgttacct

SEQ ID NO: 92631 - DNA, 124 bp, Homo sapiens; identical to SEQ ID NO: 40270
  misc_feature 1..124: note = chr4:8967222-8967346
  misc_feature 1..124: note = hypo
  source 1..124: mol_type = genomic DNA

SEQ ID NO: 92632 - DNA, 20 bp, Homo sapiens
  misc_feature 1..20: note = chr4:89912577-89912597
  misc_feature 1..20: note = hypo
  source 1..20: mol_type = genomic DNA
gactccgtctcaaaataaaa

SEQ ID NO: 92633 - DNA, 91 bp, Homo sapiens
  misc_feature 1..91: note = chr4:90031770-90031861
  misc_feature 1..91: note = hyper
  source 1..91: mol_type = genomic DNA
ggaaggcagcctgaccgcgtttcccaggaaacaggtggtgcaaggtggaggtgcaccactctctcctccaggaaggcggtgacccttccgc

SEQ ID NO: 92634 - DNA, 106 bp, Homo sapiens; identical to SEQ ID NO: 40318
  misc_feature 1..106: note = chr4:90043853-90043959
  misc_feature 1..106: note = hypo
  source 1..106: mol_type = genomic DNA

SEQ ID NO: 92635 - DNA, 62 bp, Homo sapiens
  misc_feature 1..62: note = chr4:905870-905932
  misc_feature 1..62: note = hypo
  source 1..62: mol_type = genomic DNA
cctcagggggctgtgcgcagggaggctgcggcgtggctgtgtccacccgaacccacactcag

SEQ ID NO: 92636 - DNA, 1539 bp, Homo sapiens
  misc_feature 1..1539: note = chr4:90757517-90759056
  misc_feature 1..1539: note = hyper
  source 1..1539: mol_type = genomic DNA
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccaga

SEQ ID NO: 92637 - DNA, 269 bp, Homo sapiens
  misc_feature 1..269: note = chr4:90759130-90759399
  misc_feature 1..269: note = hyper
  source 1..269: mol_type = genomic DNA
cgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacatttt

SEQ ID NO: 92638 - DNA, 94 bp, Homo sapiens
  misc_feature 1..94: note = chr4:91049775-91049869
  misc_feature 1..94: note = hyper
  source 1..94: mol_type = genomic DNA
tgtgtcccagggactcgtacacacggtgccagcaaggggtaagggtgacggagggatttgtgaatggtgcttctgcgtgcgtggaggctgagcc

SEQ ID NO: 92639 - DNA, 203 bp, Homo sapiens; identical to SEQ ID NO: 40319
  misc_feature 1..203: note = chr4:91168356-91168559
  misc_feature 1..203: note = hypo
  source 1..203: mol_type = genomic DNA

SEQ ID NO: 92640 - DNA, 30 bp, Homo sapiens
  misc_feature 1..30: note = chr4:9153953-9153983
  misc_feature 1..30: note = hyper
  source 1..30: mol_type = genomic DNA
aaggcggaggaactgcgagagtgcctacgt

SEQ ID NO: 92641 - DNA, 163 bp, Homo sapiens
  misc_feature 1..163: note = chr4:93225260-93225423
  misc_feature 1..163: note = hyper
  source 1..163: mol_type = genomic DNA
ggaatctggctgctccgtttggaatctcctaatctttcctttccacttagattctggcagcgaagaccagtgattctctgcgggctgtaggggcgggggcgggggtcttttttggtccgagagggtgcggggaagggggcacatccggcgtgaggggggtgtt

SEQ ID NO: 92642 - DNA, 30 bp, Homo sapiens
  misc_feature 1..30: note = chr4:93225709-93225739
  misc_feature 1..30: note = hyper
  source 1..30: mol_type = genomic DNA
tgcgctaaactccaccgtgacctcaaactc

SEQ ID NO: 92643 - DNA, 49 bp, Homo sapiens
  misc_feature 1..49: note = chr4:93226097-93226146
  misc_feature 1..49: note = hyper
  source 1..49: mol_type = genomic DNA
tgttttgcagtgattcgtggaatgtggctggatgcgtgggggtctcgag

SEQ ID NO: 92644 - DNA, 46 bp, Homo sapiens
  misc_feature 1..46: note = chr4:93226463-93226509
  misc_feature 1..46: note = hyper
  source 1..46: mol_type = genomic DNA
gctttatgatccttgcgtgtagtctttgagacggtggcaggagggg

SEQ ID NO: 92645 - DNA, 35 bp, Homo sapiens
  misc_feature 1..35: note = chr4:93226820-93226855
  misc_feature 1..35: note = hyper
  source 1..35: mol_type = genomic DNA
cgggccgggactggccgcggcgagcaggggcgggc

SEQ ID NO: 92646 - DNA, 83 bp, Homo sapiens
  misc_feature 1..83: note = chr4:9423198-9423281
  misc_feature 1..83: note = hypo
  source 1..83: mol_type = genomic DNA
acaaaggatccataacgatgaaaaaatatttgttttcaatgtgaattaaatttctccacctttcagatgtgattaagaacacc

SEQ ID NO: 92647 - DNA, 30 bp, Homo sapiens
  misc_feature 1..30: note = chr4:94749499-94749529
  misc_feature 1..30: note = hyper
  source 1..30: mol_type = genomic DNA
tggcgggtccagaatcgcccagagccgccc

SEQ ID NO: 92648 - DNA, 246 bp, Homo sapiens
  misc_feature 1..246: note = chr4:94750031-94750277
  misc_feature 1..246: note = hyper
  source 1..246: mol_type = genomic DNA
tcccagtgctgcctccgatcctgagcctccgagcctttgcagtgcaatgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcc

SEQ ID NO: 92649 - DNA, 1043 bp, Homo sapiens
  misc_feature 1..1043: note = chr4:94750556-94751599
  misc_feature 1..1043: note = hyper
  source 1..1043: mol_type = genomic DNA
acggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 92650 - DNA, 20 bp, Homo sapiens
  misc_feature 1..20: note = chr4:94752906-94752926
  misc_feature 1..20: note = hyper
  source 1..20: mol_type = genomic DNA
ggaaaagctaatagtcgtgc

SEQ ID NO: 92651 - DNA, 268 bp, Homo sapiens
  misc_feature 1..268: note = chr4:94753279-94753547
  misc_feature 1..268: note = hyper
  source 1..268: mol_type = genomic DNA
taatgcactagggagcgcaggttctggtctccttaagtaagaaactgcagaaccagctttttactgaccacctgggtatctgtggctttcagcggaagccgaccaagagatgcagagaacgtccgccagctctctgggagaagcgagcaggcggctggtgacactttccagggcagaaataatgcacctgtcccttagataaccttttgcacccatcgagtttgccgtgctcacgataaacatcaggaatcttcgggctgctgaataa

SEQ ID NO: 92652 - DNA, 258 bp, Homo sapiens
  misc_feature 1..258: note = chr4:94755600-94755858
  misc_feature 1..258: note = hyper
  source 1..258: mol_type = genomic DNA
aaaggggaaactgagcggagaatgggttaaatccttggaagcaggggagaggcaggggaggagagaagtcggaggagtataaagaaaaggacaggaaccaagaagcgtgggggtggtttgccgtaatgtgagtgtttcttaattagagaacggttgacaatagagggtctggcagaggctcctggccgcggtgcggagcgtctggagcggagcacgcgctgtcagctggtgagcgcactctcctttcaggcagctccc

SEQ ID NO: 92653 - DNA, 154 bp, Homo sapiens
  misc_feature 1..154: note = chr4:94756001-94756155
  misc_feature 1..154: note = hyper
  source 1..154: mol_type = genomic DNA
cggccggggcccctctcctcccccagctgcgcagcgggagccgccactgcccactgcacctcccagcaaccagcccagcacgcaaagaagctgcgcaaagttaaagccaagcaatgccaaggggaggggaagctggaggcggcagaggcggcgg

SEQ ID NO: 92654 - DNA, 169 bp, Homo sapiens
  misc_feature 1..169: note = chr4:9499324-9499493
  misc_feature 1..169: note = hyper
  source 1..169: mol_type = genomic DNA
agcgaggggcataggcggggaaggtgcggggcgaggcggccgcgggtccctggcatccctctccgtacacccaggctaagctggcggtgctgctggtgacgctggtggccgccgcggtctcctacctgcggatgcagcagaagctgcggcggggcgtggccccgcgcca

SEQ ID NO: 92655 - DNA, 172 bp, Homo sapiens
  misc_feature 1..172: note = chr4:9499862-9500034
  misc_feature 1..172: note = hyper
  source 1..172: mol_type = genomic DNA
tcacctccgggcttccgaagccccctctaaggcggagtggagccttgggaacccctcggccaagcacagtggttcgaaaatacagctgaaaccctgcgggcccttagcaggcgccccagcgccggagcagggtcagggtcttcttgcgacccggccccgctccagatccccc

SEQ ID NO: 92656 - DNA, 89 bp, Homo sapiens
  misc_feature 1..89: note = chr4:95127590-95127679
  misc_feature 1..89: note = hypo
  source 1..89: mol_type = genomic DNA
attaaaacaattgaacgtatgagaaacggtagaacgatggctaccagaggctgggaagggtagtgtggggcgggggaggaccccggtgg

SEQ ID NO: 92657 - DNA, 29 bp, Homo sapiens
  misc_feature 1..29: note = chr4:95128039-95128068
  misc_feature 1..29: note = hypo
  source 1..29: mol_type = genomic DNA
gctgggattacaggcgtgagccaccactc

SEQ ID NO: 92658 - DNA, 360 bp, Homo sapiens
  misc_feature 1..360: note = chr4:955184-955544
  misc_feature 1..360: note = hypo
  source 1..360: mol_type = genomic DNA
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagctgccgcataagagagcgggcacagaggtgtaggtgcaggcaggacgagggctgagcctgcccatggccccgccgggcagagcctctggggagccccgcccgcgagcacctggggatgttgatgaagatgaggccttcaatactgggcagctccacctcctgccgctccacctgcagc

SEQ ID NO: 92659 - DNA, 1199 bp, Homo sapiens
  misc_feature 1..1199: note = chr4:955851-957050
  misc_feature 1..1199: note = hypo
  source 1..1199: mol_type = genomic DNA
agttactcatctgcacgatctggggacagggcgttcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtggaggacttcaaggtcccagcacgggatccccgtggagctcctgccggccgagacagctgtggcagcctcctggggcccttcccgcccctgctgctgccctggaccaggggtcctgctggactcacccgggaagaggacctccgttggtcaggtcgaagacctgatgagggttcagtagcttccggaagctgcagagcaggtctcggcccttgaggcctccactcttggggttcacgaacacaaggaggg

SEQ ID NO: 92660 - DNA, 146 bp, Homo sapiens
  misc_feature 1..146: note = chr4:95678853-95678999
  misc_feature 1..146: note = hyper
  source 1..146: mol_type = genomic DNA
cgccgctccccaagtcggctccgcactccgcacacaggcggcggcgctggggccgctccaagtgcgttgagaagtgtaatccctccgctaagtacttggctctcagtctccaatcactagtgggagctggagagggcaagtgaaaa

SEQ ID NO: 92661 - DNA, 266 bp, Homo sapiens
  misc_feature 1..266: note = chr4:95679059-95679325
  misc_feature 1..266: note = hyper
  source 1..266: mol_type = genomic DNA
gtcccgcggtggcggcggcggcggcggcggagcggccgcggcggccagaagttgacggcgcagccgggcgcggggcgcggagtcggcggggcctcgcgggacgccgggcagtgcggagaccgcggcgctgaggacgcgggagccgggagcgcagccgcgggtaaggcgcgcgcggcggggccccgtcccctgcgggtggccgagttcccgagcgcgcgggaggcggccgagccggcgagagccgggcagagcgaggggcggcgcgg

SEQ ID NO: 92662 - DNA, 106 bp, Homo sapiens
  misc_feature 1..106: note = chr4:95679639-95679745
  misc_feature 1..106: note = hyper
  source 1..106: mol_type = genomic DNA
ggcagtcgcggaatccgggaaatgggagggagcccggcggggcgggggcccagggccagcccaggcgggacccgcaggcacccacctgccccggacgcctcccgag

SEQ ID NO: 92663 - DNA, 30 bp, Homo sapiens
  misc_feature 1..30: note = chr4:957409-957439
  misc_feature 1..30: note = hypo
  source 1..30: mol_type = genomic DNA
ccacgtgggactctgcgtggcactctgtgc

SEQ ID NO: 92664 - DNA, 29 bp, Homo sapiens
  misc_feature 1..29: note = chr4:95762900-95762929
  misc_feature 1..29: note = hypo
  source 1..29: mol_type = genomic DNA
gagctgttcctattcggccatcttggctc

SEQ ID NO: 92665 - DNA, 30 bp, Homo sapiens
  misc_feature 1..30: note = chr4:96061185-96061215
  misc_feature 1..30: note = hypo
  source 1..30: mol_type = genomic DNA
ggagctgttcctattcggccatcttgtaac

SEQ ID NO: 92666 - DNA, 25 bp, Homo sapiens
  misc_feature 1..25: note = chr4:96180202-96180227
  misc_feature 1..25: note = hypo
  source 1..25: mol_type = genomic DNA
cgcccggcctcgaccatcttattct

SEQ ID NO: 92667 - DNA, 400 bp, Homo sapiens
  misc_feature 1..400: note = chr4:96469013-96469413
  misc_feature 1..400: note = hyper
  source 1..400: mol_type = genomic DNA
cccatccccaactcccggccacactcttcccaacccggcttcgcccagggccccggtcacttatgttaaagttcacaggcgttaaattaaaatgtcagagttataaactggtcgactaccccggggagtttcggatttggtttgaacaagcagccggttcccccagagctccgggattttcatttctacatcccctggtgggaagcaggcatgaagcggggtatgtatgagtgcagaggcatgcacatcccgggcctgcctccagccgggtacgcggattcgggtgagctgtgtatttccacagcacctgaagcagcaggcgagggggacgggtgcttttgagtccttgacagtaatggacacatttccttagctgagcgcccttcggggtctagtgtgc

SEQ ID NO: 92668 - DNA, 496 bp, Homo sapiens
  misc_feature 1..496: note = chr4:96469768-96470264
  misc_feature 1..496: note = hyper
  source 1..496: mol_type = genomic DNA
tccagttgaaagcaacgaggcaaattgaggaagtcaagagaactggggaggaggagaggaaggagggaaggaagaagctaagggaggtggccgcggagcttggcggacccccttaccttgggcggcggagccagtgccgctggcgctgagcagggccagggcaggtagcacgagcatttgcagcaagtatcccagtcccagtccgcagcgggccgctgtcgcccgcagacctttcctcatcgtagacagaggtgtgccggggggaggggagggggacagagagacgcgcaaacagctgaaagccccactgggcagaagctgaatccgtgcaccgcgaagcagtccgaagaaataacgacaaccaagcgccacactccactttctccaaaggcaggggccaaaagggggaggagaggagacgccgaggaggagtttgaaggtccctctttcccaatgccttctaactgacgtctcccgcgagcgactgctctgcccc

SEQ ID NO: 92669 - DNA, 194 bp, Homo sapiens
  misc_feature 1..194: note = chr4:96470693-96470887
  misc_feature 1..194: note = hyper
  source 1..194: mol_type = genomic DNA
ttgcagggagatcagcgcccaggagaccagctgtgggtttgcccgctgaagccgaggcgagacagaccaggggacgaagcggctgcggagagtggcagcgcgcctgcctcccgcggtgcgccagacctggacgccgggagtgcagcgggcgcgccccgggccactaggctgtgtccagtggagctcagcctgcc

SEQ ID NO: 92670 - DNA, 304 bp, Homo sapiens
  misc_feature 1..304: note = chr4:96470888-96471192
  misc_feature 1..304: note = hyper
  source 1..304: mol_type = genomic DNA
cctgccaccttcttcgccgcgccggcaaagcctcagccgaattccctaggactggactcggtctacgacttcgggtctcgcggttgacgaagccggtgcgggctcgaactgaagtccttcttggttggggaagaaggcatgaagcttttgcactgccccagccggctgctgtcctggggttgtcagcgccagtcagactgctttatgttctgagcgcgtatgacccctttgcagtggaacagaaactaaaagctcgacggaaactcattctgcaacagtgctttctttgcgtgcatgttggtgg

SEQ ID NO: 92671 - DNA, 36 bp, Homo sapiens
  misc_feature 1..36: note = chr4:967581-967617
  misc_feature 1..36: note = hyper
  source 1..36: mol_type = genomic DNA
tgggctcggtttgaccgcagccgggccagacttctc

SEQ ID NO: 92672 - DNA, 51 bp, Homo sapiens
  misc_feature 1..51: note = chr4:967716-967767
  misc_feature 1..51: note = hyper
  source 1..51: mol_type = genomic DNA
ggccgcgcaggacgcccccggcgaggggcagcgctgcgggcctcccacagt

SEQ ID NO: 92673 - DNA, 79 bp, Homo sapiens
  misc_feature 1..79: note = chr4:97118687-97118766
  misc_feature 1..79: note = hypo
  source 1..79: mol_type = genomic DNA
ggggggtttagttaccggggatggctttgggatgaaactgtcccacctcagatcatcattctcataaggagcgtgcaac

SEQ ID NO: 92674 - DNA, 18 bp, Homo sapiens
  misc_feature 1..18: note = chr4:97118826-97118844
  misc_feature 1..18: note = hypo
  source 1..18: mol_type = genomic DNA
ccgcggatctgacaggag

SEQ ID NO: 92675 - DNA, 76 bp, Homo sapiens
  misc_feature 1..76: note = chr4:9783020-9783096
  misc_feature 1..76: note = hyper
  source 1..76: mol_type = genomic DNA
aaggctccagggatgcgccaagcacccttcggttttcccggggagaattttccccggcccggggactagggtctgg

SEQ ID NO: 92676 - DNA, 299 bp, Homo sapiens
  misc_feature 1..299: note = chr4:9783125-9783424
  misc_feature 1..299: note = hyper
  source 1..299: mol_type = genomic DNA
cgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctggctgtcagcgagcaccagccgcttcctgtccccat

SEQ ID NO: 92677 - DNA, 120 bp, Homo sapiens
  misc_feature 1..120: note = chr4:9783500-9783620
  misc_feature 1..120: note = hyper
  source 1..120: mol_type = genomic DNA
cgcagcccggcgcagctcatggtgagcgccctctggggctcgagggtcccttggctgagggggcgcatcctcggggtgcccgatggggctgcctgggggtcgcagggctgaagttgggac

SEQ ID NO: 92678 - DNA, 21 bp, Homo sapiens
  misc_feature 1..21: note = chr4:9783681-9783702
  misc_feature 1..21: note = hyper
  source 1..21: mol_type = genomic DNA
cgtacccggggcagttcgctc

SEQ ID NO: 92679 - DNA, 30 bp, Homo sapiens
  misc_feature 1..30: note = chr4:980454-980484
  misc_feature 1..30: note = hyper
  source 1..30: mol_type = genomic DNA
aaatcgctgaagccccggagatggaggttg

SEQ ID NO: 92680 - DNA, 176 bp, Homo sapiens
  misc_feature 1..176: note = chr4:9847574-9847750
  misc_feature 1..176: note = hypo
  source 1..176: mol_type = genomic DNA
tcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgat

SEQ ID NO: 92681 - DNA, 117 bp, Homo sapiens
  misc_feature 1..117: note = chr4:994673-994790
  misc_feature 1..117: note = hypo
  source 1..117: mol_type = genomic DNA
tgagctgatgggcagcgcctcgggccacttcactgactttgaggacaagcagcaggtgtttgagtggaaggacttggtctccagcctggccaggagatacatcggtgggcgagcgca

SEQ ID NO: 92682 - DNA, 106 bp, Homo sapiens; identical to SEQ ID NO: 40325
  misc_feature 1..106: note = chr4:99495888-99495994
  misc_feature 1..106: note = hypo
  source 1..106: mol_type = genomic DNA

SEQ ID NO: 92683 - DNA, 30 bp, Homo sapiens
  misc_feature 1..30: note = chr4:99503312-99503342
  misc_feature 1..30: note = hypo
  source 1..30: mol_type = genomic DNA
ttttgcaagtgattgcggttctcttgtcca

SEQ ID NO: 92684 - DNA, 30 bp, Homo sapiens
  misc_feature 1..30: note = chr4:99559227-99559257
  misc_feature 1..30: note = hypo
  source 1..30: mol_type = genomic DNA
gtctgaccacccttgcgccttgcctctgcc

SEQ ID NO: 92685 - DNA, 171 bp, Homo sapiens
  misc_feature 1..171: note = chr4:99579127-99579298
  misc_feature 1..171: note = hyper
  source 1..171: mol_type = genomic DNA
tgtttatctctccaacgcgcaagctggaaaggcggaaggcgaatgcctctatgctgctccggcaagcgcctgcggggctgcgaaaagtaaaggcaacgaacaacgtgggggaaatcgtcgcgaatcgatcggccacaatagttggaatcccaggagcgctccaacttaccc

SEQ ID NO: 92686 - DNA, 119 bp, Homo sapiens; identical to SEQ ID NO: 28679
  misc_feature 1..119: note = chr4:995875-995994
  misc_feature 1..119: note = hyper
  source 1..119: mol_type = genomic DNA

SEQ ID NO: 92687 - DNA, 75 bp, Homo sapiens; identical to SEQ ID NO: 7206
  misc_feature 1..75: note = chr4:996100-996175
  misc_feature 1..75: note = hyper
  source 1..75: mol_type = genomic DNA

SEQ ID NO: 92688 - DNA, 44 bp, Homo sapiens; identical to SEQ ID NO: 7207
  misc_feature 1..44: note = chr4:996495-996539
  misc_feature 1..44: note = hyper
  source 1..44: mol_type = genomic DNA

SEQ ID NO: 92689 - DNA, 30 bp, Homo sapiens
  misc_feature 1..30: note = chr4:99846517-99846547
  misc_feature 1..30: note = hypo
  source 1..30: mol_type = genomic DNA
agctacaaagaaacacgacctactggaggt

SEQ ID NO: 92690 - DNA, 1730 bp, Homo sapiens
  misc_feature 1..1730: note = chr5:100236150-100237880
  misc_feature 1..1730: note = hyper
  source 1..1730: mol_type = genomic DNA
ctcctccaccagaagcgctgtttgggagttgaaacgaaataatgagctcgggtcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgagccttggccgctttgtctgggatcaggcttatcctcctagcccacggcccgggagggaacaaagagcctcgaccctcaagctctagcctctgcctctcatcggagccccatgcgcccattcatcacctttctaaagacccctttgtctgcctggcaagcacaggtctgcaagggatgcccacgcccctgcccaaagtcctgcttttctaacaactgagctagattggattttcaagccacccagtcttgtgtaaacgacctcataccggtcttttttaccccctcagaatagaccatgtatagattcgttgatgcatgacgaccattccagcccattccttgctagctttttcattctcttccagtccgctttgactgtgctactgttttcctggttttctacagaatagcaagtccttctgtaaggatcaacctgcatcttgctcgcttaaataaatgcttattacctagggagcaggaatattaagaaatggagtgcaggaagtttaagagcatgtgtgtgtgttagcagtcccatctctctctctctcacacacacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttgaatagagttgacaatcaggttcacatcctcagaaaaagccttccaagctatgtcagcaacacaaagttgcaccacctcctgggtaaacttcaaagacacagaggccagcgggtggaaggaagtgtgatatttagagaacttagtggggcgggggagagtctga

SEQ ID NO: 92691 - DNA, 694 bp, Homo sapiens
  misc_feature 1..694: note = chr5:100238283-100238977
  misc_feature 1..694: note = hyper
  source 1..694: mol_type = genomic DNA
tgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttc

SEQ ID NO: 92692 - DNA, 44 bp, Homo sapiens; identical to SEQ ID NO: 2619
  misc_feature 1..44: note = chr5:100238978-100239022
  misc_feature 1..44: note = hyper
  source 1..44: mol_type = genomic DNA

SEQ ID NO: 92693 - DNA, 97 bp, Homo sapiens; identical to SEQ ID NO: 2620
  misc_feature 1..97: note = chr5:100239023-100239120
  misc_feature 1..97: note = hyper
  source 1..97: mol_type = genomic DNA

SEQ ID NO: 92694 - DNA, 590 bp, Homo sapiens; identical to SEQ ID NO: 2621
  misc_feature 1..590: note = chr5:100239134-100239724
  misc_feature 1..590: note = hyper
  source 1..590: mol_type = genomic DNA

SEQ ID NO: 92695 - DNA, 77 bp, Homo sapiens
  misc_feature 1..77: note = chr5:100240068-100240145
  misc_feature 1..77: note = hyper
  source 1..77: mol_type = genomic DNA
tgttggctggtaggtcgggaggcacctctagcatgagacagtgtctggaagccaggatttccctcatctatatgcgc

SEQ ID NO: 92696 - DNA, 57 bp, Homo sapiens
  misc_feature 1..57: note = chr5:100240232-100240289
  misc_feature 1..57: note = hyper
  source 1..57: mol_type = genomic DNA
cgctcagaaatgatgaggcccaattccaatcttccctcccgccggaagtaagaaggg

SEQ ID NO: 92697 - DNA, 95 bp, Homo sapiens; identical to SEQ ID NO: 40410
  misc_feature 1..95: note = chr5:1003105-1003200
  misc_feature 1..95: note = hypo
  source 1..95: mol_type = genomic DNA

SEQ ID NO: 92698 - DNA, 30 bp, Homo sapiens
  misc_feature 1..30: note = chr5:1007449-1007479
  misc_feature 1..30: note = hypo
  source 1..30: mol_type = genomic DNA
agcccatcgcaggcacggcctggccgggtg

SEQ ID NO: 92699 - DNA, 43 bp, Homo sapiens
  misc_feature 1..43: note = chr5:1008040-1008083
  misc_feature 1..43: note = hypo
  source 1..43: mol_type = genomic DNA
ggttggagacgtgggcgtggcaacagcccgtggggaaaatgct

SEQ ID NO: 92700 - DNA, 367 bp, Homo sapiens
  misc_feature 1..367: note = chr5:1009258-1009625
  misc_feature 1..367: note = hyper
  source 1..367: mol_type = genomic DNA
tcgttttcctctccccgcgtcccgccgtgccgcagccgccgccgcccgcaagcggagagagagcccggaaggtgagcgggcgagccgacgggcggggcggggggcggcgacccggcccgggaccctcagagctaggagcccgcgcgcgtcctgccctggagccagcagtggggggacggggccgcgggtctccaggagcgcgcgggacccccacgcctgcccctgcgcggtctccaggcgatggggacacagcgaaggcgcagcgcccgcggggctcacggcgcgtctctttccctcctcggtgcgggtttcccgcgcgtccgcccccggaccgcaggggacagcttcgtggcgtccgcgtacgcga

SEQ ID NO: 92701 - DNA, 208 bp, Homo sapiens
  misc_feature 1..208: note = chr5:101631427-101631635
  misc_feature 1..208: note = hyper
  source 1..208: mol_type = genomic DNA
aggctggctgggggccggtaggttgaccttggtgagagcgcaagcaagttccaaacccggggccaccttgcagggcgcgtccaccgtcccacggaccccgcgcacctgccctctcccccggctggctcgccgtgcccacctcgctctccactggcccgagcctcaagcgggcgctggactttaccttgcgtgacggccaagaggcagt

SEQ ID NO: 92702 - DNA, 40 bp, Homo sapiens
  misc_feature 1..40: note = chr5:101632034-101632074
  misc_feature 1..40: note = hyper
  source 1..40: mol_type = genomic DNA
acaggcaggtgacagcgcccccgtgcgggaagcttcccgc

SEQ ID NO: 92703 - DNA, 35 bp, Homo sapiens
  misc_feature 1..35: note = chr5:102048048-102048083
  misc_feature 1..35: note = hypo
  source 1..35: mol_type = genomic DNA
aagtgtggccgggcgcggtggctcacgcttgtaat

SEQ ID NO: 92704 - DNA, 30 bp, Homo sapiens
  misc_feature 1..30: note = chr5:102090335-102090365
  misc_feature 1..30: note = hyper
  source 1..30: mol_type = genomic DNA
ccaggctttcagccccggtactctgccatc

SEQ ID NO: 92705 - DNA, 177 bp, Homo sapiens
  misc_feature 1..177: note = chr5:1021313-1021490
  misc_feature 1..177: note = hypo
  source 1..177: mol_type = genomic DNA
caaacccagaagaaccgatgggcaaaatctgcaaatgcctctcagatatggaggctccgtctgaatgtatctagggcttatgtgggaagcccggctcccctgcccggtccccccggccccccacctcccagcccctttgctcctcccgctgacccggccccccgcccctccacccac

SEQ ID NO: 92706 - DNA, 84 bp, Homo sapiens
  misc_feature 1..84: note = chr5:10248589-10248673
  misc_feature 1..84: note = hypo
  source 1..84: mol_type = genomic DNA
cacttcaaggtctagcgcgtaagtatgccaagcatgaagagttaacagatcaccaaccatcccatgacagtcagtcctccctgt

SEQ ID NO: 92707 - DNA, 84 bp, Homo sapiens
  misc_feature 1..84: note = chr5:10248733-10248817
  misc_feature 1..84: note = hypo
  source 1..84: mol_type = genomic DNA
cactgtaaactgaactcctgggctccacccatcctcctgcctcagccccagagtagatgggaacacagtcgccaagtctgttct

SEQ ID NO: 92708 - DNA, 16 bp, Homo sapiens
  misc_feature 1..16: note = chr5:10252583-10252599
  misc_feature 1..16: note = hypo
  source 1..16: mol_type = genomic DNA
gggcgcggtggctcac

SEQ ID NO: 92709 - DNA, 16 bp, Homo sapiens
  misc_feature 1..16: note = chr5:10252719-10252735
  misc_feature 1..16: note = hypo
  source 1..16: mol_type = genomic DNA
ccgtctcaaaaaaaaa

SEQ ID NO: 92710 - DNA, 299 bp, Homo sapiens
  misc_feature 1..299: note = chr5:10267147-10267446
  misc_feature 1..299: note = hypo
  source 1..299: mol_type = genomic DNA
cagaggaaggtgacacggtagtaactgactaatcagtaatttgtaagcatggagaagtttctccaacctaggtgttccttgcaggcagtcttggcagaatggggtcatctaaaagcaccagaaaagtggggaccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtct

SEQ ID NO: 92711 - DNA, 30 bp, Homo sapiens; identical to SEQ ID NO: 40498
  misc_feature 1..30: note = chr5:10269033-10269063
  misc_feature 1..30: note = hypo
  source 1..30: mol_type = genomic DNA

SEQ ID NO: 92712 - DNA, 30 bp, Homo sapiens
  misc_feature 1..30: note = chr5:1028378-1028408
  misc_feature 1..30: note = hypo
  source 1..30: mol_type = genomic DNA
ccttcctgagcatcccgtagggccgtggga

SEQ ID NO: 92713 - DNA, 398 bp, Homo sapiens
  misc_feature 1..398: note = chr5:10307528-10307926
  misc_feature 1..398: note = hyper
  source 1..398: mol_type = genomic DNA
tcggacgcatgggatcgtggaggctgctgttctgcaaggacaacgtatcacttttatgaaagtcagcttctgaaaacggactatgggaagttccttacccgtgcacgcggcaaagaccttctttgccatagtcagaacacacgcgggagttcagaggagcggggcccgggcttgtgtgggcttgtgtgccccggggacgcgcacgtaccttgtcccgcggcctgagactgcgctgcaccgcgcggaggccgaacccagaggaggcggcgtggcgccgggcggggacgcgagagggacgtggacgcggcgaccgaggacgcggggatcctgcgggaccagtggctccagtcgtagcctcctgggagagccaagcccggagggggcggagaggtggagga

SEQ ID NO: 92714 - DNA, 709 bp, Homo sapiens
  misc_feature 1..709: note = chr5:10333423-10334132
  misc_feature 1..709: note = hyper
  source 1..709: mol_type = genomic DNA
ccagagcaccccagccgtcctgggagcccccgaagccaagcatattcgaactccgaatccgctcgatcgccggggacctgccatctgggttcggttccccaaggtcgctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctagg

SEQ ID NO: 92715 - DNA, 62 bp, Homo sapiens
  misc_feature 1..62: note = chr5:1033612-1033674
  misc_feature 1..62: note = hypo
  source 1..62: mol_type = genomic DNA
acgtgggtctctctccggcctcacttgcgggaacacgtccctggggccgggggctcagggac

SEQ ID NO: 92716 - DNA, 431 bp, Homo sapiens
  misc_feature 1..431: note = chr5:1034304-1034735
  misc_feature 1..431: note = hypo
  source 1..431: mol_type = genomic DNA
ggcgtgggtaggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcccatttctgcggctgtgcttcccacactgcaaggctgccctcagggcactggaggcgctcacagggccacctgggcagacccaggctgctccgagaagatgcctgt

SEQ ID NO: 92717 - DNA, 30 bp, Homo sapiens
  misc_feature 1..30: note = chr5:1037486-1037516
  misc_feature 1..30: note = hypo
  source 1..30: mol_type = genomic DNA
gcaccctacagggctcgcactgcacgttgt

SEQ ID NO: 92718 - DNA, 40 bp, Homo sapiens
  misc_feature 1..40: note = chr5:1037995-1038035
  misc_feature 1..40: note = hypo
  source 1..40: mol_type = genomic DNA
gccagatacacatgccgtacaccaccgcaggtcacaggtg

SEQ ID NO: 92719 - DNA, 126 bp, Homo sapiens
  misc_feature 1..126: note = chr5:1039154-1039280
  misc_feature 1..126: note = hypo
  source 1..126: mol_type = genomic DNA
ggtagcccctggtcccggagccacagcagctcaggtgcatgcaggacacagtcaaggcggggaggggcagggcaacagatgctggggagagggagaggctcgcgctgggtgcggctcagaacacgg

SEQ ID NO: 92720 - DNA, 70 bp, Homo sapiens
  misc_feature 1..70: note = chr5:1039613-1039683
  misc_feature 1..70: note = hypo
  source 1..70: mol_type = genomic DNA
tttttaaggataaagcggtgctgggtggggtctgtgggaggggtttgagccatggcggaagatccctggt

SEQ ID NO: 92721 - DNA, 153 bp, Homo sapiens
  misc_feature 1..153: note = chr5:10442372-10442525
  misc_feature 1..153: note = hyper
  source 1..153: mol_type = genomic DNA
cgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtat

SEQ ID NO: 92722 - DNA, 39 bp, Homo sapiens
  misc_feature 1..39: note = chr5:10464558-10464597
  misc_feature 1..39: note = hypo
  source 1..39: mol_type = genomic DNA
ttgtgctctctgatgcggctactccgcctgacagagcca

SEQ ID NO: 92723 - DNA, 30 bp, Homo sapiens
  misc_feature 1..30: note = chr5:10538891-10538921
  misc_feature 1..30: note = hypo
  source 1..30: mol_type = genomic DNA
gccgactccatgccacgcctgctatgaaat

SEQ ID NO: 92724 - DNA, 84 bp, Homo sapiens
  misc_feature 1..84: note = chr5:10563513-10563597
  misc_feature 1..84: note = hyper
  source 1..84: mol_type = genomic DNA
ttttgggcagccagacgtggggtcagcgcccagtcgcagcctccgggggtgagtccgcagatccccgcacgtgacacaggccag

SEQ ID NO: 92725 - DNA, 188 bp, Homo sapiens
  misc_feature 1..188: note = chr5:10564471-10564659
  misc_feature 1..188: note = hyper
  source 1..188: mol_type = genomic DNA
cggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccgggg

SEQ ID NO: 92726 - DNA, 428 bp, Homo sapiens; identical to SEQ ID NO: 429
  misc_feature 1..428: note = chr5:10564800-10565228
  misc_feature 1..428: note = hyper
  source 1..428: mol_type = genomic DNA

SEQ ID NO: 92727 - skipped

SEQ ID NO: 92728 - DNA, 480 bp, Homo sapiens
  misc_feature 1..480: note = chr5:10565264-10565744
  misc_feature 1..480: note = hyper
  source 1..480: mol_type = genomic DNA
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaa

SEQ ID NO: 92729 - DNA, 129 bp, Homo sapiens
  misc_feature 1..129: note = chr5:10618114-10618243
  misc_feature 1..129: note = hypo
  source 1..129: mol_type = genomic DNA
tctgccgtgctctgtcgtttatttctctacgagccccatagttggtgtgtttccctccctggagaaagcacaccccaggagggctgagaccttagcagttcactgatgttttcacgtctaggccctcac

SEQ ID NO: 92730 - DNA, 195 bp, Homo sapiens
  misc_feature 1..195: note = chr5:10630367-10630562
  misc_feature 1..195: note = hypo
  source 1..195: mol_type = genomic DNA
tgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccac

SEQ ID NO: 92731 - DNA, 115 bp, Homo sapiens
  misc_feature 1..115: note = chr5:10652320-10652435
  misc_feature 1..115: note = hypo
  source 1..115: mol_type = genomic DNA
gtggtctcccaggcacgcttctcaacaccggctacccctgctgtgaaggttctcaaggccctggtccggggagccaagccctgggagcgccctaaagctccgcaggtaactgcac

SEQ ID NO: 92732 - DNA, 193 bp, Homo sapiens
  misc_feature 1..193: note = chr5:10675371-10675564
  misc_feature 1..193: note = hypo
  source 1..193: mol_type = genomic DNA
gctagcaggtgataacgtttgtttggtaattgaacataagcctttacggtgacactgcctgcgtgcaagtcccaagtcttccaagcctcagtttcctcatcttgtaaatgggtatgacaacatggggatccatctcctggagcagatggtgcgcgtctatggctcagacagtaacgcacgcctgcacagaagg

SEQ ID NO: 92733 - DNA, 514 bp, Homo sapiens
  misc_feature 1..514: note = chr5:107005171-107005685
  misc_feature 1..514: note = hyper
  source 1..514: mol_type = genomic DNA
gaagcaataaaggttcggaactgctccagacccggaggaccccgccgggcactctggataacctccccactccacttccagggtccgaaaacacgggacgtctgcgactggccggtgtccagcacgcgcactaggaccgcccccggcgcccacctctagtctcccgcatacccggcgggcttcgggacgcctacaaatcggttccaggtaatcgcgcgcgttcctccggcagcacatcgccaggccgcgggcgaagggctcccacctcctggctcggccaactctggcagcttgttctgcacacatgacgtaacccggcattagatcaaactttctggcaccttgaacccactggggtgggtggagggatggagaagatgggagaatcctctccactgccaggcgcgccgggcccagactgactcaggggccgaatgatttcctcgcagttgaagaggaaaataaaaacctaaagcttccgcttcccagcccccctcacttcccccagcccgtg

SEQ ID NO: 92734 - DNA, 277 bp, Homo sapiens
  misc_feature 1..277: note = chr5:107005983-107006260
  misc_feature 1..277: note = hyper
  source 1..277: mol_type = genomic DNA
ggtacctggcctttccgcggcggcttaacaaagaggggcgcgacgcgagcgcttcccgccgacgcctcaagccatcagcgcccgggcgacgcaggctccgagggtgcgcgccgccagcggttggtgcgcgccgatccccgccgccgctccttccgcagggccccgaggcccgggtagccctggctctccgcctgttatcggcttacctggggttgctgctgttccagtagacagcgtagcggtcggcgacggccttggagcccgggtcctggctgaa

SEQ ID NO: 92735 - DNA, 718 bp, Homo sapiens
  misc_feature 1..718: note = chr5:107006709-107007427
  misc_feature 1..718: note = hyper
  source 1..718: mol_type = genomic DNA
ggctgcagcgcgggtcggggcaggcggcggcgcgcgctgcacagtcaccgggagttgcgcgccgcagccgcggggagacatacaccggcccgccgggcccggctcagcgtcggcgcagcaggctacgcacggctccgccaccgcccggggccctcgcactgcgccacgcttcgctccaagttactttggcggccggtgggaaactgcaggagaagggcgacgtgctgatagagggcttcgcgcttgtggtcccgggagtctgagaacccctttcctcagcctcctctgtgccttagcggggcgacccccagaaatctcagaggagtcgtaagtgctgcggtaccgggcggtgcgccgagaagggtggggatccggagccgcaacccagccttgtcggtgtcctggaactggttaagcggcagctgcgccggctttcgaagcggtcttgcctcgaaaacctcaaagaaaagtttggctcttcgcgtcttccggcaggtcccccagcagagtcggaacgcggcggtagcggaagagggcaccccgggggctggccgagcctcggggatttctcgcgcgtgctttccttggctgggtgtgggtgcaccacagtgaatgaagagcagaggttaagaccagccggcctggcagagctgggattcctaaacctgcaagacgacgccaacccaactgttcggctggagagcgggaggggaaacaa

SEQ ID NO: 92736 - DNA, 909 bp, Homo sapiens
  misc_feature 1..909: note = chr5:1073480-1074389
  misc_feature 1..909: note = hypo
  source 1..909: mol_type = genomic DNA
ggggctcacccatggcgggaggaggcggtcccagggttcgcccttggaaagctaatggccctcacacctcccaagcttcccggggtgcggctggtgctcccaggccttagcgcgctgctctgagctcaaagccaccgccacggctaaaacacagcagcgccacgcacagcaccgtgttgacacgctgcgatgaggacatgccagggcacgtttcctgtgcagctggggtgggaaagaggcctggcccccagaccccgcccggcccacctcctcggcccgctgagcctccatgtgcttgtccaggtacgtcccctccagcaccgagcccacgatggtcaggcccttgccggccttcagctgcgacgtgaaggacagcaggcgggggtgcttcacggcctgctccgcgtccaggttcagcatcaccagcacctggggcctgcagccagggtggggcggctgttaccacggcaacgcttaccagggcacggcccatcaacaggcagggcagatgggacgggcggggcacacgacacaggtgggacgggagatacatgacaggcgggacaggggacaaaaggggcaggtgacagatgggatggggaaacgtgacacacgtggggtaagttgaacaggtgacaggtgagacaggccacagaagccaggtgggacaggcagggccgatggacaggtgggcactagccaggcaggacaggagaacaggtaggttagacaggtgggacaggtgacatgctagacaggtgagacaatggcccaggacacacacctgaagcccccaccgaggccctgaggggacaatggcccggggcacacccgaggcccccgccgaggcccctgaggggacaatggcccggggcacacacctgaggcccccgccgaggccctgagggg

SEQ ID NO: 92737 - DNA, 179 bp, Homo sapiens
  misc_feature 1..179: note = chr5:107840292-107840471
  misc_feature 1..179: note = hypo
  source 1..179: mol_type = genomic DNA
agtaactctggcacccgttacctcctcggtgaaatctctgaaattgtcaagttgttgactatactttctcctttgtatgccaactatagttgggtatttcatgtcaattactatctaccatatactaagtgggatatgtgtatttaccagttttctctgatcaacgccgtgtgctcttt

SEQ ID NO: 92738 - DNA, 30 bp, Homo sapiens; identical to SEQ ID NO: 40501
  misc_feature 1..30: note = chr5:10864262-10864292
  misc_feature 1..30: note = hypo
  source 1..30: mol_type = genomic DNA

SEQ ID NO: 92739 - DNA, 185 bp, Homo sapiens
  misc_feature 1..185: note = chr5:10915475-10915660
  misc_feature 1..185: note = hypo
  source 1..185: mol_type = genomic DNA
gaaagacaagcactgcgtgggtaggtgctgataataatgatgaagacgatggtaacagtaacagcctcggctgaccttcatccaagatgcgcttggctgcttatggctggtgttcattctgaccagtcagtgcctatgctaatctggttgtaaaatatgtttaatatcaccgctgaaaataatac

SEQ ID NO: 92740 - DNA, 30 bp, Homo sapiens
  misc_feature 1..30: note = chr5:1094019-1094049
  misc_feature 1..30: note = hypo
  source 1..30: mol_type = genomic DNA
gggttcccgtggggccggagcaccctagat

SEQ ID NO: 92741 - DNA, 33 bp, Homo sapiens
  misc_feature 1..33: note = chr5:10972987-10973020
  misc_feature 1..33: note = hypo
  source 1..33: mol_type = genomic DNA
atagatgaggaaacacggcggcattggtgtaat

SEQ ID NO: 92742 - DNA, 36 bp, Homo sapiens; identical to SEQ ID NO: 40379
  misc_feature 1..36: note = chr5:109867-109903
  misc_feature 1..36: note = hypo
  source 1..36: mol_type = genomic DNA

SEQ ID NO: 92743 - DNA, 30 bp, Homo sapiens
  misc_feature 1..30: note = chr5:10986789-10986819
  misc_feature 1..30: note = hypo
  source 1..30: mol_type = genomic DNA
acgtctcaggagcagcgctgaggtgttccc

SEQ ID NO: 92744 - DNA, 197 bp, Homo sapiens
  misc_feature 1..197: note = chr5:110022402-110022599
  misc_feature 1..197: note = hypo
  source 1..197: mol_type = genomic DNA
ttgaattaggtttagcgacatataacagaaataaaaataagggctcaaacagtatagaagcatatttctctctgatgtacgaaaataaaaaataaaagaacataaaagttcaaaaacaatgtagggtgtattgggcagcttcacagtcatgagaccaaggctctgtctaaatcttcctttcacggtcattgttaggc

SEQ ID NO: 92745 - DNA, 777 bp, Homo sapiens
  misc_feature 1..777: note = chr5:110408656-110409433
  misc_feature 1..777: note = hyper
  source 1..777: mol_type = genomic DNA
ctttctccagggagacgccaggcattttggagagggagtatcctgctacgtgcagaactccgagaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcaggtaagcccgaagcctcagacgtttgctgtaccttggggctaacctcaaattaaactggggctttggtgcagaagtcgttctcttattttt

SEQ ID NO: 92746 - DNA, 91 bp, Homo sapiens
  misc_feature 1..91: note = chr5:1104793-1104884
  misc_feature 1..91: note = hyper
  source 1..91: mol_type = genomic DNA
ggtgcgtgtggggtgcgtgtggggtgctgcccaagaaaaccccagaacgcaggaaacaaaccaccccaggtccacacgtgattcagaagca

SEQ ID NO: 92747 - DNA, 565 bp, Homo sapiens
  misc_feature 1..565: note = chr5:110559554-110560119
  misc_feature 1..565: note = hyper
  source 1..565: mol_type = genomic DNA
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagctccggtccccgcgggagggcgcgtgggatgatgcgcgggtccttgtgccttccccaagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggc

SEQ ID NO: 92748 - DNA, 539 bp, Homo sapiens
  misc_feature 1..539: note = chr5:110560138-110560677
  misc_feature 1..539: note = hyper
  source 1..539: mol_type = genomic DNA
cggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtaggatcagcccgactccctcccaccttccctccttctcgcaggctgccacttcccttgggtgacagctcccaccgcacgtgggccctgctttcccaattgatatctttgctcacgattatagcttgcc

SEQ ID NO: 92749 - DNA, 18 bp, Homo sapiens
  misc_feature 1..18: note = chr5:110885341-110885359
  misc_feature 1..18: note = hypo
  source 1..18: mol_type = genomic DNA
agaagactgagaggccgg

SEQ ID NO: 92750 - DNA, 17 bp, Homo sapiens
  misc_feature 1..17: note = chr5:111306228-111306245
  misc_feature 1..17: note = hypo
  source 1..17: mol_type = genomic DNA
gaagtcttactgggtcg

SEQ ID NO: 92751 - DNA, 30 bp, Homo sapiens
  misc_feature 1..30: note = chr5:111602040-111602070
  misc_feature 1..30: note = hypo
  source 1..30: mol_type = genomic DNA
aaaaagagagattaacgatctcttacacta

SEQ ID NO: 92752 - DNA, 30 bp, Homo sapiens
  misc_feature 1..30: note = chr5:11169751-11169781
  misc_feature 1..30: note = hypo
  source 1..30: mol_type = genomic DNA
ttacaaagatagagacggctattgccttgg

SEQ ID NO: 92753 - DNA, 30 bp, Homo sapiens
  misc_feature 1..30: note = chr5:111706271-111706301
  misc_feature 1..30: note = hypo
  source 1..30: mol_type = genomic DNA
atttttagaaaagttcgattttccagttac

SEQ ID NO: 92754 - DNA, 376 bp, Homo sapiens
  misc_feature 1..376: note = chr5:111754705-111755081
  misc_feature 1..376: note = hyper
  source 1..376: mol_type = genomic DNA
attcttccggaacagcgcagaaacagcccatgtcggttgtggtcgtctccagccaggagagaaagctaccaccgaggcgcccagccgccccctccactcaagcgcgatgcattaatttattgtccgcgccgtggcgagggtgagacgagcagctcccggcggggtccggggaccggccgccgaaccgcccggcggggcgggagcgagaaaggcggaaaagcccgggagagtcagcgcccgggagccgccggggaagcgccggcggaactgggcgcggagggcggtggcgcgtccccgcgcatcctgcggctcgagctcctccgaaggcgggggcgcggggcccctcccgcagtcctggggacgacaaaagtctcct

SEQ ID NO: 92755 - DNA, 128 bp, Homo sapiens; identical to SEQ ID NO: 40578
  misc_feature 1..128: note = chr5:111813766-111813894
  misc_feature 1..128: note = hypo
  source 1..128: mol_type = genomic DNA

SEQ ID NO: 92756 - DNA, 79 bp, Homo sapiens; identical to SEQ ID NO: 40579
  misc_feature 1..79: note = chr5:111875281-111875360
  misc_feature 1..79: note = hypo
  source 1..79: mol_type = genomic DNA

SEQ ID NO: 92757 - DNA, 37 bp, Homo sapiens
  misc_feature 1..37: note = chr5:1118984-1119021
  misc_feature 1..37: note = hypo
  source 1..37: mol_type = genomic DNA
gctgaacttctgggccggctggcgggagaggcagagc

SEQ ID NO: 92758 - DNA, 31 bp, Homo sapiens
  misc_feature 1..31: note = chr5:111987787-111987818
  misc_feature 1..31: note = hypo
  source 1..31: mol_type = genomic DNA
cgtgagccaccgcgcccggcctccaggtcac

SEQ ID NO: 92759 - DNA, 74 bp, Homo sapiens
  misc_feature 1..74: note = chr5:112073410-112073484
  misc_feature 1..74: note = hyper
  source 1..74: mol_type = genomic DNA
ccctgtgccccactgcggagtgcgggtcgggaagcggagagagaagcagctgtgtaatccgctggatgcggacc

SEQ ID NO: 92760 - DNA, 206 bp, Homo sapiens; identical to SEQ ID NO: 40581
  misc_feature 1..206: note = chr5:112198294-112198500
  misc_feature 1..206: note = hypo
  source 1..206: mol_type = genomic DNA

SEQ ID NO: 92761 - DNA, 36 bp, Homo sapiens
  misc_feature 1..36: note = chr5:1122889-1122925
  misc_feature 1..36: note = hypo
  source 1..36: mol_type = genomic DNA
tgtccactgtctggacgggcacgttttgttcaccca

SEQ ID NO: 92762 - DNA, 78 bp, Homo sapiens
  misc_feature 1..78: note = chr5:112629200-112629278
  misc_feature 1..78: note = hyper
  source 1..78: mol_type = genomic DNA
cagcacccagttctacgggcttctcatcacttttcaggtattcaaagctttgagggatgtgcccgaagcatccctaaa

SEQ ID NO: 92763 - DNA, 290 bp, Homo sapiens
  misc_feature 1..290: note = chr5:112629488-112629778
  misc_feature 1..290: note = hyper
  source 1..290: mol_type = genomic DNA
cagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaacaagggatgcagactgtcgtgagtaaaacgcctcgcggcttgg

SEQ ID NO: 92764 - DNA, 451 bp, Homo sapiens
  misc_feature 1..451: note = chr5:112630247-112630698
  misc_feature 1..451: note = hyper
  source 1..451: mol_type = genomic DNA
cttaaaaagagcagccgtggctcgcgtttcacggacgagccattgctgcaggaggctcggtggcgcggcgcgctcgcagctgcggcagcggcggagcccgcgcggggaccctcccgcgcgcacccagcgccccgttccggggcagtgccaccctgggcgccgcctcgccactcctacggtgcctcgccgccccccattaccaggatggagggcacttcccagcacgagccgacaccctagagggcaccggcgagctcccgaaaaaactagggcggtggggcgaggaagatccgcgcctcggattccagagaaggaaagaaagctagagggagccggagcggagctgcacttcacgccgaagtttccccttcgaatcgtctggagttgtaagtggtttctgattgaacacagctgtctagctgctggccacggggtgcgcggaggaggcggg

SEQ ID NO: 92765 - DNA, 129 bp, Homo sapiens
  misc_feature 1..129: note = chr5:112823685-112823814
  misc_feature 1..129: note = hyper
  source 1..129: mol_type = genomic DNA
ggagatgtctcccaacgcctagacaaagacagcgctgggaaaagttggaccaactggcacccccgcaaggcgaacagagcagtcccctcggccttcgtggccgagccggctacgcgctctcggagtcgc

SEQ ID NO: 92766 - DNA, 251 bp, Homo sapiens
  misc_feature 1..251: note = chr5:112824066-112824317
  misc_feature 1..251: note = hyper
  source 1..251: mol_type = genomic DNA
gctgctggagctccccgcagccgctgccgccgcggccgccatcatgcgcccgctccctacttgggaggaggagtacgcgcgaccgcagctggaatccgcgcggcgcgcaagctgcctgcagccccgaacttgcctgacaacggagcatgcccagtggccgccggggcgctccgggcgagggattccacctctccgggttttgcccggactgggaagatgggcgctctggaatcgcccgaggaggcacctca

SEQ ID NO: 92767 - DNA, 164 bp, Homo sapiens
  misc_feature 1..164: note = chr5:1131227-1131391
  misc_feature 1..164: note = hypo
  source 1..164: mol_type = genomic DNA
ctcagcgcctgtattcgcagggacacacagggactcacagggacgtcccggatcgctaggggactcacggggacacgtggggacacgctcggactcacggggacttgcaggggcccatggggatgtgcagggacaccgtccctcccggccgtcctgctccttgc

SEQ ID NO: 92768 - DNA, 83 bp, Homo sapiens
  misc_feature 1..83: note = chr5:113391056-113391139
  misc_feature 1..83: note = hyper
  source 1..83: mol_type = genomic DNA
agagctcaaaatgctcggcgcggctggtgagttccctgcagcagctggaagtggagctataaatagagcggggagggaagcgc

SEQ ID NO: 92769 - DNA, 397 bp, Homo sapiens
  misc_feature 1..397: note = chr5:113391377-113391774
  misc_feature 1..397: note = hyper
  source 1..397: mol_type = genomic DNA
ctctgcagctccccccggttaacacccgaaattcggccttagaatacacacacacgatggaatttgttccatatctttttttttaaccttcgataggcataaatccaaacctaaaattaaaatcatccccaaatttggttttgggaatcatgttggttttcacccttgagcggcgttccctccccagtgccgcatgctgcttaaggactgttactttcttggggagggaagtatcaaatggaaacggtgtgtgtgtgcgcgcgcgcgtttatttttggcgcatgcacacccctcggtagcctcaaggtcggcgataccctgagcattcgggcccccgcctgcaggactcgctcctgccagccaaggactcaagaaggagggagtccccagtcccggc

SEQ ID NO: 92770 - DNA, 433 bp, Homo sapiens
  misc_feature 1..433: note = chr5:113391775-113392208
  misc_feature 1..433: note = hyper
  source 1..433: mol_type = genomic DNA
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggtcctggctaggactcctgattcttctcagatggaaacagtttctcccggtgaacctgccggaattctcagtggactcgatcttcagctttgtccactggcgcatttcaccaaggccgcatttaccgctttgaggcaaatttgagcttcaaatggagcgggactcctggttgcagaacgaggtaaggtcgcg

SEQ ID NO: 92771 - DNA, 315 bp, Homo sapiens; identical to SEQ ID NO: 29821
  misc_feature 1..315: note = chr5:113696418-113696733
  misc_feature 1..315: note = hyper
  source 1..315: mol_type = genomic DNA

SEQ ID NO: 92772 - DNA, 1189 bp, Homo sapiens
  misc_feature 1..1189: note = chr5:113696951-113698140
  misc_feature 1..1189: note = hyper
  source 1..1189: mol_type = genomic DNA
gcccccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctcggcgggatgatctgggagaagcgggcgtgggacgagggggctgctgttttgcagccctgcgaggcgtgcagtcggagaagtggtcggggttccacaccgtccctgagcctgcccccggccaaggtggcccgacgtgctgcagtggctggcgcaggtgatccgggcagcgcgtccggcactagtcaagggggcagcggcacgggagggaggggcgcctttctcttttctcctccccctgcagcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatgggcccttcctcgcaccagcagcaggagtccccgctcccgaccataacgcattgcgcagggtgcaccaccgcttggtctccctgcagctttaacagccctgacatggaaaccccattgcagttccagcgcggcttcttcccagagcagccgccgccgccgccgcgctcctcacacctgcattgccagcagcagcaacagagccaggacaagccgtgcccgcccttcgcgcccctcccgcaccctcaccaccacccgcacctcgcgcaccagcagccggccagcggcggcagcagcccatgcctccggtgcaacagctgcgcctcctccggtgccccggcggcgggggcgggagataacctgtccctgctgctccgcacctcctcgcccggcggcgccttccggaccc

SEQ ID NO: 92773 - DNA, 26 bp, Homo sapiens
  misc_feature 1..26: note = chr5:113698141-113698167
  misc_feature 1..26: note = hyper
  source 1..26: mol_type = genomic DNA
cacctcctcgccgctgtcgggctcgt

SEQ ID NO: 92774 - DNA, 198 bp, Homo sapiens; identical to SEQ ID NO: 29826
  misc_feature 1..198: note = chr5:113698386-113698584
  misc_feature 1..198: note = hyper
  source 1..198: mol_type = genomic DNA

SEQ ID NO: 92775 - DNA, 175 bp, Homo sapiens; identical to SEQ ID NO: 29827
  misc_feature 1..175: note = chr5:113698669-113698844
  misc_feature 1..175: note = hyper
  source 1..175: mol_type = genomic DNA

SEQ ID NO: 92776 - DNA, 168 bp, Homo sapiens
  misc_feature 1..168: note = chr5:113698951-113699119
  misc_feature 1..168: note = hyper
  source 1..168: mol_type = genomic DNA
cgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtcag

SEQ ID NO: 92777 - DNA, 293 bp, Homo sapiens
  misc_feature 1..293: note = chr5:113699370-113699663
  misc_feature 1..293: note = hyper
  source 1..293: mol_type = genomic DNA
ccagcagcccagccacgcgtcttcccagtctttccaggtctactctcgtctcttttggttttgaggccgagtgatctgacagatcacagagccaagacaggtgcacccctctccccttatcttccttctgtgagttcaggtccacctgtgggggactgactgactctggggacgtggaaggcggttaaaagtgcttctttcttaaaagtgcttctgtctgactgtgttgcaggcgtcgctgtattccttagctctgaaatgccttatcagtctctccacgatcatcctgctcg

SEQ ID NO: 92778 - DNA, 103 bp, Homo sapiens
  misc_feature 1..103: note = chr5:11384964-11385067
  misc_feature 1..103: note = hyper
  source 1..103: mol_type = genomic DNA
cggatcggggacaggccggccgaggacacgacgatgttgatgggcgagctggtgctgtaggacttggccaggcggctgggcgactgcttgggcgaggagccgc

SEQ ID NO: 92779 - DNA, 520 bp, Homo sapiens
  misc_feature 1..520: note = chr5:11385068-11385588
  misc_feature 1..520: note = hyper
  source 1..520: mol_type = genomic DNA
cggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 92780 - DNA, 30 bp, Homo sapiens
  misc_feature 1..30: note = chr5:11397823-11397853
  misc_feature 1..30: note = hypo
  source 1..30: mol_type = genomic DNA
taatagctctttgtacgatgtggaattcac

SEQ ID NO: 92781 - DNA, 30 bp, Homo sapiens
  misc_feature 1..30: note = chr5:114506521-114506551
  misc_feature 1..30: note = hyper
  source 1..30: mol_type = genomic DNA
cggctccggcacccccgcacccccgcgggg

SEQ ID NO: 92782 - DNA, 571 bp, Homo sapiens; identical to SEQ ID NO: 2623
  misc_feature 1..571: note = chr5:114515009-114515580
  misc_feature 1..571: note = hyper
  source 1..571: mol_type = genomic DNA

SEQ ID NO: 92783 - DNA, 61 bp, Homo sapiens; identical to SEQ ID NO: 2624
  misc_feature 1..61: note = chr5:114515610-114515671
  misc_feature 1..61: note = hyper
  source 1..61: mol_type = genomic DNA

SEQ ID NO: 92784 - DNA, 374 bp, Homo sapiens
  misc_feature 1..374: note = chr5:114515900-114516274
  misc_feature 1..374: note = hyper
  source 1..374: mol_type = genomic DNA
tgaaatgaaggccatcgagggctcccgggcagcctcgcccggcttgctaggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaacgcgcacacaaagcgggtccgcactcggctcagcgcggccccagctagacattccccggcctttatcgcatgccggcaggttggccgtccccggctctcggcgcgaagatctggaaaaaagccccatctcactgtctggaggtgcgagggcagacagaa

SEQ ID NO: 92785 - DNA, 157 bp, Homo sapiens
  misc_feature 1..157: note = chr5:114972859-114973016
  misc_feature 1..157: note = hypo
  source 1..157: mol_type = genomic DNA
ttttatggcatgacacgaattagtaaatgcctgcaattccttgtgaatggaactctttattttttttttttttctactctggttctgtactttatttgttttgaattctggttactagccaagctacatataagacttagggcgtgattcttagctt

SEQ ID NO: 92786 - DNA, 30 bp, Homo sapiens
  misc_feature 1..30: note = chr5:1151152-1151182
  misc_feature 1..30: note = hypo
  source 1..30: mol_type = genomic DNA
gccttgggagctggacggagatggcggggc

SEQ ID NO: 92787 - DNA, 195 bp, Homo sapiens; identical to SEQ ID NO: 29833
  misc_feature 1..195: note = chr5:115151163-115151358
  misc_feature 1..195: note = hyper
  source 1..195: mol_type = genomic DNA

SEQ ID NO: 92788 - DNA, 736 bp, Homo sapiens; identical to SEQ ID NO: 478
  misc_feature 1..736: note = chr5:115151649-115152385
  misc_feature 1..736: note = hyper
  source 1..736: mol_type = genomic DNA

SEQ ID NO: 92789 - DNA, 249 bp, Homo sapiens
  misc_feature 1..249: note = chr5:115152616-115152865
  misc_feature 1..249: note = hyper
  source 1..249: mol_type = genomic DNA
ggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggc

SEQ ID NO: 92790 - DNA, 32 bp, Homo sapiens; identical to SEQ ID NO: 40582
  misc_feature 1..32: note = chr5:115176272-115176304
  misc_feature 1..32: note = hypo
  source 1..32: mol_type = genomic DNA

SEQ ID NO: 92791 - DNA, 135 bp, Homo sapiens
  misc_feature 1..135: note = chr5:115297158-115297293
  misc_feature 1..135: note = hyper
  source 1..135: mol_type = genomic DNA
ttcccaattcaccagcgtgcgtgaatgcagactccagatccagcgcagacgccaagaattcgctcaggggcaccagctaaatagcaaacagatgccatgtcaaacatgtgaaagcctcagcgactagggtaccgc

SEQ ID NO: 92792 - DNA, 610 bp, Homo sapiens
  misc_feature 1..610: note = chr5:115297376-115297986
  misc_feature 1..610: note = hyper
  source 1..610: mol_type = genomic DNA
cggttctgaaagcaggtgtcccctctcccccggcttcaggaagggaaaccccggccccaggcagttgcagagctaagaaaaaccatcccgccaggccccttcttgtggtaacgcggtcctaaccctgctctgccccacaaccccatttcacccgggagacgcagacgccaggctccctagcactttgtcgcctcttcctccagcctggcttcctgagctctggaaaagttccgggcctccggacgttgtttccatcttcgccttcgctgcctgggccgcatgcctcctgggcttatttaggaagcgaagttagcgccacacatttggctccagaaatttgttctgacggcgcggccgacgccctgcagggtcatttctgaacgcattcccaaatatcctggtcctcaagcccttaccaccccctagcacacgaagccccagctggcggtggagcaggtgtgttgctggtagctcatcgctggcttggagatagaggtgcttggtacctgtcccctttccgacaacacctgaaaccgtatcggggcacacccctcatccaaatatccacgtttaaggtgtccggattcgtttggcttgaccaccccctccc

SEQ ID NO: 92793 - DNA, 378 bp, Homo sapiens; identical to SEQ ID NO: 29839
  misc_feature 1..378: note = chr5:115298204-115298582
  misc_feature 1..378: note = hyper
  source 1..378: mol_type = genomic DNA

SEQ ID NO: 92794 - DNA, 335 bp, Homo sapiens
  misc_feature 1..335: note = chr5:115298781-115299116
  misc_feature 1..335: note = hyper
  source 1..335: mol_type = genomic DNA
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgcgtctgctgcccttt

SEQ ID NO: 92795 - DNA, 884 bp, Homo sapiens
  misc_feature 1..884: note = chr5:1155674-1156558
  misc_feature 1..884: note = hyper
  source 1..884: mol_type = genomic DNA
accccaggcagggaccgacccccgggctgaccgggagccccacccccgccggcccgccaggccgccgccgcccacctgcgcccctcgaggggaccggcacctgcgcgcacctaccgtagcggccgggctcgcggcagtagagcagaatgggaagcgggtcctcgtcaggcggctcgggcgcggctgcggggtccaggccggggtcgggggcccggcgggggctcggggtggggcgctggctgtcgccttccttggccccgggccccgcaccccccgccgcgggggtcaccacgaagcgctgggacatggtgtccgcgacggctgcggggagcggggacctgagcgcggggagggcggggccggcggggcgggcgcgggaggccgggaggaagggagggaggccgggggggagagagggaccgagcgcaccgccggggatggggccgcgcggcgcggggaggggccgggagggcgaggcggactccggctgacacctcggcagcggtccctgcccgcggggggaccacggcctcggcccccgaagaacgaagagcggcctcggctctcgctgcgtgaccttggagacgccccagccgggcgaccgggtcagcgcgcggtgcagaagcctgaggggaggaacagacctcgctctgcgccgcctggaaccgacgacgaccaaccctggcagcaacgctgcagcccgcggtctctggcgacgcccaccgagggccgggaccagggggccggtgagggtggaggtctcgctggcctttgggtccgtggggaggggcgccctgatctggggcctccacctcccccatccccagactccagcccttggccaagcagggttcagccgtgcctgcgtgcgaggcagaggcctc

SEQ ID NO: 92796 - DNA, 30 bp, Homo sapiens; identical to SEQ ID NO: 29841
  misc_feature 1..30: note = chr5:115908915-115908945
  misc_feature 1..30: note = hyper
  source 1..30: mol_type = genomic DNA

SEQ ID NO: 92797 - DNA, 400 bp, Homo sapiens
  misc_feature 1..400: note = chr5:115909717-115910117
  misc_feature 1..400: note = hyper
  source 1..400: mol_type = genomic DNA
ctgctcccccaggaccgggcaaggctcgggaaacagagacacaagacaaaataaaacgcaggcaccacaaagccgacagcacgcgctagccacggccccgggaccctcaggctggagtccagctgcccgggaggtggggcgcgcccgggcgcccggggcgtaccttttcggtgcatcgacggacaggcggccggggctcggagcgaactggtacagcgtgtatcccatttagtaatccattatcgaggggatctctccgggccgcgggctgcgctctctccttcgcaagcctttgtcattcctacatgtgtgcttgtctctttgggggaaatagtcgcggcgactactttctgggatgcaaacgcgatgtgttcatctccaatgacgagcggagaagggg

SEQ ID NO: 92798 - DNA, 267 bp, Homo sapiens
  misc_feature 1..267: note = chr5:115910908-115911175
  misc_feature 1..267: note = hyper
  source 1..267: mol_type = genomic DNA
ataaataaaaatagacgtagtgcaggagcgagttacaagaaaggttttgttcatcgattttcttaaatggaaaagttttaaaggatgagggtaagtgaacggcgagcttttctgattctgattactgttatcaagaggtagattccagaagcgatggacgctctacgtagttagatgaattggatagaagccggtgcggttaaaaatacacttggaagataagaacacagctattaattacgcacatacacacgttaataaagcatg

SEQ ID NO: 92799 - DNA, 138 bp, Homo sapiens
  misc_feature 1..138: note = chr5:115911452-115911590
  misc_feature 1..138: note = hyper
  source 1..138: mol_type = genomic DNA
aggcttgtgccaactcgtcgggccacaccacgttcccctccccctgccgctgcgccccgaaatcaactgcgcgccgcggctcttgctccccaagggggcttcgcagatggtacggatcctagtcgcaacctttaaaca

SEQ ID NO: 92800 - DNA, 279 bp, Homo sapiens
  misc_feature 1..279: note = chr5:115911835-115912114
  misc_feature 1..279: note = hyper
  source 1..279: mol_type = genomic DNA
aacacccattccccccgcaccactaccaccacctggaaaaggtagggagaatggtaggaaaaaaagaaaaaatcagtacccctgctgttctccagagctgtcagcaggggccgctatccccacctttctcgggcaaaggcctctatagacctggggtagtggggggcgcggccctaggtgcgcgcgcagcccccgcggcttcaagagccagcctcgggagggggttggggagtgtggggcggtgggtaggattgcgctttcccgcgggttgggtggggg

SEQ ID NO: 92801 - DNA, 223 bp, Homo sapiens
  misc_feature 1..223: note = chr5:115958432-115958655
  misc_feature 1..223: note = hypo
  source 1..223: mol_type = genomic DNA
aggcaaccctcaacacgagatgggggaaagaatgctgttgaactaaactgaatttaaataaaagccaacaccctttccagaaatgcaagaaattttgcttgtttagaatatctactgggcattgaatgggcaggtctctagcagttgtccgggaccacctagtttctgactaccacccaggcatctcccagtctccagttcaagataacgcctatcctgcaag

SEQ ID NO: 92802 - DNA, 30 bp, Homo sapiens
  misc_feature 1..30: note = chr5:116052021-116052051
  misc_feature 1..30: note = hypo
  source 1..30: mol_type = genomic DNA
ccacacgaacaagcgcgtgtgtgaggagat

SEQ ID NO: 92803 - DNA, 35 bp, Homo sapiens
  misc_feature 1..35: note = chr5:11644483-11644518
  misc_feature 1..35: note = hypo
  source 1..35: mol_type = genomic DNA
gtaaatgataccaagcggctgtgccgggtgcagtg

SEQ ID NO: 92804 - DNA, 30 bp, Homo sapiens
  misc_feature 1..30: note = chr5:1169521-1169551
  misc_feature 1..30: note = hypo
  source 1..30: mol_type = genomic DNA
atgcaagcatcaccccgttgggatctgtca

SEQ ID NO: 92805 - DNA, 22 bp, Homo sapiens
  misc_feature 1..22: note = chr5:117258296-117258318
  misc_feature 1..22: note = hypo
  source 1..22: mol_type = genomic DNA
ccgcgcccggccaaaatatccc

SEQ ID NO: 92806 - DNA, 125 bp, Homo sapiens; identical to SEQ ID NO: 5026
  misc_feature 1..125: note = chr5:1174263-1174388
  misc_feature 1..125: note = hypo
  source 1..125: mol_type = genomic DNA

SEQ ID NO: 92807 - DNA, 149 bp, Homo sapiens
  misc_feature 1..149: note = chr5:1189557-1189706
  misc_feature 1..149: note = hypo
  source 1..149: mol_type = genomic DNA
tcaaggccaggaggccgccatggggaccccacccagcactgtgctggacacaacgcggcaagacaagaaacacagaagaagcaaaggtgacagagtgggggaggagaaataaagccggcacctgcagttggcataattttgtattaaga

SEQ ID NO: 92808 - DNA, 357 bp, Homo sapiens
  misc_feature 1..357: note = chr5:11903368-11903725
  misc_feature 1..357: note = hyper
  source 1..357: mol_type = genomic DNA
ggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccc

SEQ ID NO: 92809 - DNA, 293 bp, Homo sapiens; identical to SEQ ID NO: 7750
  misc_feature 1..293: note = chr5:11903821-11904114
  misc_feature 1..293: note = hyper
  source 1..293: mol_type = genomic DNA

SEQ ID NO: 92810 - DNA, 59 bp, Homo sapiens; identical to SEQ ID NO: 7751
  misc_feature 1..59: note = chr5:11904115-11904174
  misc_feature 1..59: note = hyper
  source 1..59: mol_type = genomic DNA

SEQ ID NO: 92811 - DNA, 185 bp, Homo sapiens; identical to SEQ ID NO: 29479
  misc_feature 1..185: note = chr5:11904195-11904380
  misc_feature 1..185: note = hyper
  source 1..185: mol_type = genomic DNA

SEQ ID NO: 92812 - DNA, 537 bp, Homo sapiens
  misc_feature 1..537: note = chr5:11904455-11904992
  misc_feature 1..537: note = hyper
  source 1..537: mol_type = genomic DNA
cggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagag

SEQ ID NO: 92813 - DNA, 30 bp, Homo sapiens; identical to SEQ ID NO: 40418
  misc_feature 1..30: note = chr5:1193360-1193390
  misc_feature 1..30: note = hypo
  source 1..30: mol_type = genomic DNA

SEQ ID NO: 92814 - DNA, 249 bp, Homo sapiens
  misc_feature 1..249: note = chr5:1193747-1193996
  misc_feature 1..249: note = hypo
  source 1..249: mol_type = genomic DNA
ggcagcatctcccctcgtgggcgcttacctcggagaactccgggcatgaatgtgcgaaaggcaggaacagacgtccacggcggctttcatcctcatggcgcaaacgggacccctaccgtcagcaatggagccgtgaaggagctgcagccgtggacctggagcaggcacagcgagccagggtgcgaggcccggacagctctgagcggaacagcgagccacctgcagcgtccagctcgagacagtggctcc

SEQ ID NO: 92815 - DNA, 67 bp, Homo sapiens
  misc_feature 1..67: note = chr5:1196184-1196251
  misc_feature 1..67: note = hypo
  source 1..67: mol_type = genomic DNA
cgggcacgcagtcgacggccatcgccgacggtcacctcccacctcccgggcacgcagtcgacggcca

SEQ ID NO: 92816 - DNA, 287 bp, Homo sapiens
  misc_feature 1..287: note = chr5:119799856-119800143
  misc_feature 1..287: note = hyper
  source 1..287: mol_type = genomic DNA
cctggcgcggcagcacggcgcccctctccgcgggcggggagcgagcgcgtgtgcgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctc

SEQ ID NO: 92817 - DNA, 1362 bp, Homo sapiens
  misc_feature 1..1362: note = chr5:119800144-119801506
  misc_feature 1..1362: note = hyper
  source 1..1362: mol_type = genomic DNA
cccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtgagaggcgcaggggtggggagggagttcggcacccttcgacccctccggggtcccctttccgattttcagcagggacagccagatttccaaactcctgggaaactacagaaaaggcgcctgcagacggactttctttgctcctggagtcctgagaggagttgttgttgcactttttaatttttttttttaatcaggaagaaatcaactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 92818 - DNA, 26 bp, Homo sapiens
  misc_feature 1..26: note = chr5:120884207-120884233
  misc_feature 1..26: note = hypo
  source 1..26: mol_type = genomic DNA
aaaaaataacttgcccgccaggcaca

SEQ ID NO: 92819 - DNA, 30 bp, Homo sapiens
  misc_feature 1..30: note = chr5:1210123-1210153
  misc_feature 1..30: note = hypo
  source 1..30: mol_type = genomic DNA
gccacgggggcttcccggtttgggtcaggg

SEQ ID NO: 92820 - DNA, 30 bp, Homo sapiens
  misc_feature 1..30: note = chr5:1210355-1210385
  misc_feature 1..30: note = hypo
  source 1..30: mol_type = genomic DNA
tgtgagcctggaaggcgtgtacaggctgca

SEQ ID NO: 92821 - DNA, 162 bp, Homo sapiens
  misc_feature 1..162: note = chr5:1213550-1213712
  misc_feature 1..162: note = hypo
  source 1..162: mol_type = genomic DNA
ccatcccacatgtcccgccctccgcaggccgtgtacatcacctccacgctgccctatgtcgtcctgaccatcttcctcatccgaggcctgacgctgaagggcgccaccaatggcatcgtcttcctcttcacgcccaacgtaagtccccgaggctgccctggg

SEQ ID NO: 92822 - DNA, 1291 bp, Homo sapiens
  misc_feature 1..1291: note = chr5:121412520-121413811
  misc_feature 1..1291: note = hyper
  source 1..1291: mol_type = genomic DNA
aaccaggcaccagagcgccccctgaaggtagaccggggagcggggcctcagacatatcagcccgtacctggccagacagttttcctccgccgcgcatctcaggttgtacatggacatcttctgcacgtacgtggacgcctggatgtagtaggggtcggccaccaggtctgggagacctaaacgtcagcaggcgacgggcgcagcagtgaaacaacccggcgccccccgctccaactccctacccctctaggtcccttactcctcacccttcgcccaccgggactgcagagtggagcggaggacagcaagagaactggggacgcccgggactgcaaagcaatgtgaaaaggaagcaggaggggccagacgcgcggtttgcactggattccagggctgccactgcaggcgcgtgggggagggatcggatctgcgaggaccggggcccgccgcgcccaggcagccacgtcgagaagccacatagctggggaccaggtgcacgggtgcttccagcggacttgggggtacttaccgtactggaagtagccagtgccgtatccgggccggtacctgcccccaggtctgggcctttcataagtatcgtagtagttgtaataagggttgtcgtcagagtacttgtaggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttggaaccagtgacgggcggtgggcctggggcggccagcggtgactccagatgagccggccgtccgcgttcgcgccgcggcggtgcggttgtcgcggatcagcaggatcggagtgcggggctgctgggcggaggcgttggctgcaccagggacggcggcgcccgggtcccggcggcgctgaggctggtactgtgagcccaggctcagcaagctgaacacctgcccgttgttctcccattggatctgctggcgccaggcgcccggagccgccggcggctcgcgcgggggctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 92823 - DNA, 56 bp, Homo sapiens
  misc_feature 1..56: note = chr5:121414034-121414090
  misc_feature 1..56: note = hyper
  source 1..56: mol_type = genomic DNA
tcagctatttgttcacgtaatgcgattggaaacgtgcaaggcggacagctcctcgc

SEQ ID NO: 92824 - DNA, 1112 bp, Homo sapiens
  misc_feature 1..1112: note = chr5:121647381-121648493
  misc_feature 1..1112: note = hyper
  source 1..1112: mol_type = genomic DNA
gagaaaagtgggaagcgcggacaaaaagtaggcggggaggagaggagagccccagctggggaaaagcaacggcagtcgaggtaaaaagagcgaaaggtaaagaaagagcaggttcgtggacaggagccggcgggcaggccgggggatccctggtgaggaagcggcgagggaggggcgtgggccgagccgggggcgccgcggggagggtcgctgtcagtcaggccgagcggggctcgctggcctgggggcggccgcaggggcgcagcgcagcctgagggcgcggcggccccggcagcctccgcagtggcagtggtggccgcgcccccgtccccggccgggcgcccgcgctgcgttccttgtcccccagcgccggcttcgggccgcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggtgagtccaggtcccaagcggacgccgcggggaggcgggaggcgggcagccagcggctcagcctttccaagtttgcaccaggcgaccccggcgggtgtcgccccgtgctccccaagccccgggacccctttgtgccgcgagtctcggctgctccgggcagcagaggcgcctctgcagaaagggtttgagggggaggtctctatagtaacagtaacagtggtggcggcagcggctgctttactggggaaagggggaaacaacccccgcctcggtttccaaaggattgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtcca

SEQ ID NO: 92825 - DNA, 292 bp, Homo sapiens
  misc_feature 1..292: note = chr5:121648747-121649039
  misc_feature 1..292: note = hyper
  source 1..292: mol_type = genomic DNA
attctttgaggaacacgctactgcttgcagcgaagaaagtcttaggaaacaaaaaggcaacagcattgttgctcattttcaatggacggctaggaggggggaaacgtgttgttttttcctgtgggaacgttgctttccttgggaaagttaattaaggaagcattactgtcggtgccccttttcacttgctggaggcaggatcggattcctcttggctgttactgacaagtgcccatcaaagagcccggaggacgggagaactgctgcaggacagtctcgccacacaccacgt

SEQ ID NO: 92826 - DNA, 30 bp, Homo sapiens
  misc_feature 1..30: note = chr5:1218808-1218838
  misc_feature 1..30: note = hypo
  source 1..30: mol_type = genomic DNA
tggtgatgggatccacgtgctggtcctgat

SEQ ID NO: 92827 - DNA, 223 bp, Homo sapiens
  misc_feature 1..223: note = chr5:1221121-1221344
  misc_feature 1..223: note = hypo
  source 1..223: mol_type = genomic DNA
ccaggagggagggatcgggccctggcaaggggaggccgggcacctcgcagcacaccatctgttcgggtagcagaacgtacagaaagcttagcgagttgaagcccagctggtagcagcagtgacagctgtctctggccttggcaggttcaataaggacatcgagttcatgatcggccacaagcccaacatcttctggcaagtcacgtggcgcgtggtcagcccc

SEQ ID NO: 92828 - DNA, 37 bp, Homo sapiens; identical to SEQ ID NO: 40421
  misc_feature 1..37: note = chr5:1223271-1223308
  misc_feature 1..37: note = hypo
  source 1..37: mol_type = genomic DNA

SEQ ID NO: 92829 - DNA, 40 bp, Homo sapiens
  misc_feature 1..40: note = chr5:122371217-122371257
  misc_feature 1..40: note = hyper
  source 1..40: mol_type = genomic DNA
cccgtcctcaggtggcgtctgcggtcgaggatgtaagcat

SEQ ID NO: 92830 - DNA, 30 bp, Homo sapiens
  misc_feature 1..30: note = chr5:122371686-122371716
  misc_feature 1..30: note = hyper
  source 1..30: mol_type = genomic DNA
ctcatctgaaccaggcgctttaatgcctgc

SEQ ID NO: 92831 - DNA, 30 bp, Homo sapiens
  misc_feature 1..30: note = chr5:122372558-122372588
  misc_feature 1..30: note = hyper
  source 1..30: mol_type = genomic DNA
ccgccgcgccttaggcgggtgcggagggcg

SEQ ID NO: 92832 - DNA, 78 bp, Homo sapiens
  misc_feature 1..78: note = chr5:122422237-122422315
  misc_feature 1..78: note = hyper
  source 1..78: mol_type = genomic DNA
cgggggtccagcttacgccgctgcgcgcccttgtgcgcaccgggtgaggatgccgagctctgcgggcatcccggaagc

SEQ ID NO: 92833 - DNA, 218 bp, Homo sapiens; identical to SEQ ID NO: 29853
  misc_feature 1..218: note = chr5:122422616-122422834
  misc_feature 1..218: note = hyper
  source 1..218: mol_type = genomic DNA

SEQ ID NO: 92834 - DNA, 208 bp, Homo sapiens
  misc_feature 1..208: note = chr5:122423168-122423376
  misc_feature 1..208: note = hyper
  source 1..208: mol_type = genomic DNA
caagaaggcaaatgacgggaccgccgccggagtccggacttccatccctggagttcactgtctctcccagggaacagaggagtgtcctggtttctcagcaatgaaccaggagagtgtgagaaagagcatttgtttcttctcccgtggcccgacaagccactcttcggcagttctgcgagcagattaattgaaacgggcctggaacttc

SEQ ID NO: 92835 - DNA, 30 bp, Homo sapiens
  misc_feature 1..30: note = chr5:122423599-122423629
  misc_feature 1..30: note = hyper
  source 1..30: mol_type = genomic DNA
gaagtctgaacagcacgtttcccaggttca

SEQ ID NO: 92836 - DNA, 231 bp, Homo sapiens
  misc_feature 1..231: note = chr5:122423874-122424105
  misc_feature 1..231: note = hyper
  source 1..231: mol_type = genomic DNA
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcggcagccgcaggcagctgaccgcaaacagcctcgcccgtgtcccggagcagttgtgccaccagacgtaacactggatac

SEQ ID NO: 92837 - DNA, 252 bp, Homo sapiens; identical to SEQ ID NO: 29856
  misc_feature 1..252: note = chr5:122424436-122424688
  misc_feature 1..252: note = hyper
  source 1..252: mol_type = genomic DNA

SEQ ID NO: 92838 - DNA, 731 bp, Homo sapiens
  misc_feature 1..731: note = chr5:122424910-122425641
  misc_feature 1..731: note = hyper
  source 1..731: mol_type = genomic DNA
aacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacgcggctcgggcgctgcgccacgccggctcgggtcggctccgggcgctggctgagggcgggggctgcgtcctgcagccgagttctacggggcagcgccctcctgtcgggccccagcattgctggatgggagctggacgctgcgatcggggaggcagagcagggtgcacacagctccctctgtgcggcgccgcagcttcggagtaaactttgcgcccaagcggagttgggaagagggagccgcggaaccgggcggccgccggctgaaccaccggctcgggcactttctccagggtcccagtggccctcttcc

SEQ ID NO: 92839 - DNA, 255 bp, Homo sapiens
  misc_feature 1..255: note = chr5:122425701-122425956
  misc_feature 1..255: note = hyper
  source 1..255: mol_type = genomic DNA
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgc

SEQ ID NO: 92840 - DNA, 703 bp, Homo sapiens
  misc_feature 1..703: note = chr5:122426004-122426707
  misc_feature 1..703: note = hyper
  source 1..703: mol_type = genomic DNA
cggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggtggggagcacctggtcctggccgctggcccgcgcctccccgatctctgtgacaaaagttttctggcgttggagaaggaaagagaacggatgggacggccggtggcactttggggttccctctccctccctctcctcacctgcttcacagtcccaagtgtttggggccggagtctaccgtggacccggcctaacagacctctgccctcccgccggacagtgcccggggccaggcgggtactggcagcgtgtgacagggggtgtctgggtcaggccctgcctggccttagccggga

SEQ ID NO: 92841 - DNA, 53 bp, Homo sapiens; identical to SEQ ID NO: 29861
  misc_feature 1..53: note = chr5:122426796-122426849
  misc_feature 1..53: note = hyper
  source 1..53: mol_type = genomic DNA

SEQ ID NO: 92842 - DNA, 1031 bp, Homo sapiens
  misc_feature 1..1031: note = chr5:122430402-122431433
  misc_feature 1..1031: note = hyper
  source 1..1031: mol_type = genomic DNA
gagccagcccagacccgcttcgatctcctctcgcggctcctattcatcatctccgcattgtatatggcagcctcgcaggggcaggggccggcgaggtttatctctgcgcaatattctctcaccctcacaaactggcgctcccatttaatttattaatacagtcatcggaagacaaataagacccacattttctccctcccaccttcttgctctcttctttttgtctctccctcttggtcccagggtcaagcccgcagccaggcagggcagagaacgcccagagcttttgcgattcgcggggagctttaaactcgcgtagagggagagttcctgagagaattcccaggagctgggccgccccgcagggtcgagactgaaatcaattggctccccttccggcggccaggcaaacctgcctcgcctctggatctgcttctagacccgctcccggggcttggaagacccctgccgggtagaggaggagggccgggtgggtggcggggtgcagtggggacgtcggatcgtgggtggtgtcggcggccacgcctcatgtcagaagagagcctttcgtgggcaggagcggggtgggaccttcaaaactcagccttcggcgctgaggcctgggcgccccaccccgcccatcgctccctttcagccatcccatctagcctatagctcgagaaggcagtggggggaccgcaggctggagccccgggggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggcttttcacctactccttgctttcctatatgcagggcgggtgagagccaac

SEQ ID NO: 92843 - DNA, 100 bp, Homo sapiens
  misc_feature 1..100: note = chr5:122434428-122434528
  misc_feature 1..100: note = hyper
  source 1..100: mol_type = genomic DNA
aacaattaggctgatcgttaaatttgctattcctttcttccggcgtctagggagagcgtgcacaccaaaccctccagaacagcaccccggtcccccaccc

SEQ ID NO: 92844 - DNA, 125 bp, Homo sapiens
  misc_feature 1..125: note = chr5:122434605-122434730
  misc_feature 1..125: note = hyper
  source 1..125: mol_type = genomic DNA
cgcccttggagtcctggggctgcggctcctgctctaccgggctgcaggcttgctctgccccgtcccgtggcgtttgggaggcagtcgaggaagcctccgagtctctgggtcgaaggaagtgcgaa

SEQ ID NO: 92845 - DNA, 43 bp, Homo sapiens
  misc_feature 1..43: note = chr5:122621308-122621351
  misc_feature 1..43: note = hyper
  source 1..43: mol_type = genomic DNA
cgcaggaacccactgcccggggccccagcgctgtcagcccctc

SEQ ID NO: 92846 - DNA, 82 bp, Homo sapiens
  misc_feature 1..82: note = chr5:1228694-1228776
  misc_feature 1..82: note = hypo
  source 1..82: mol_type = genomic DNA
cacagccacctttcccgtcttcggcagacaccactgcgtcctccatgcttatgaacgactgctaaacttcacgtaattgtta

SEQ ID NO: 92847 - DNA, 472 bp, Homo sapiens
  misc_feature 1..472: note = chr5:1232819-1233291
  misc_feature 1..472: note = hypo
  source 1..472: mol_type = genomic DNA
gctgggaaggagccccggggccacctgacatggtccctgtccacagggctgggctgtgtcacgctgtccttcctgatcagcctgtactacaacaccatcgtggcgtgggtgctgtggtacctcctcaactccttccagcacccgctgccctggagctcctgcccaccggacctcaacagaacaggtgagctgggcgccgcctgctgtgtgggtccgtgcacggccgagagaggcatgtgctgcagcgtgtccagcatcagagcagctgcgggtggcggatgctcaccgcggggggagggccggggaaccggttgctctgtgtgcacatgcacgcgcctcggtctccccaggagcacacgtgcagtccagttcttatgacctccacgctgtgctgtgcttccctgccaggtccggaccaccgaggtccccttgcagccatgtgcatggcgtggtcatgcgagggcactgctgt

SEQ ID NO: 92848 - DNA, 27 bp, Homo sapiens
  misc_feature 1..27: note = chr5:12351623-12351650
  misc_feature 1..27: note = hypo
  source 1..27: mol_type = genomic DNA
agccaccgcgcccgcccattttcactc

SEQ ID NO: 92849 - DNA, 30 bp, Homo sapiens
  misc_feature 1..30: note = chr5:124082412-124082442
  misc_feature 1..30: note = hyper
  source 1..30: mol_type = genomic DNA
attccgcctgttagtcgggaagtggcattt

SEQ ID NO: 92850 - DNA, 516 bp, Homo sapiens
  misc_feature 1..516: note = chr5:124083366-124083882
  misc_feature 1..516: note = hyper
  source 1..516: mol_type = genomic DNA
atgtgaaacatttctcggagatctaggatctccgaagttcggaaggagcgaaatgtaatgagcacaagagcaaagcagatgttttaaagaaacactttataaacctttcctcaacttatctccaatttgtcggctttcccaaggggccagggacggggacgcctgggggagggagaagggtatctccgagctacttggattttagggacccccacttcatgtattaaacaaagaaaaaccttttgcttgctccccagcctggtcctgtaataaatacaccattgttactatttgtgggtttgtttgggttgggtggggcttttattttttctcttaatggtatttttgttgcttgcttttttaaggagatggcgaatggtaattataaccattacatgtaatgagtgactattcccttgtttaatattaaattatcgggcactgggatctgacaggagacagaaatcggcttgttctgcccttgcccccattttcctggatcgctttgggaggggg

SEQ ID NO: 92851 - DNA, 107 bp, Homo sapiens
  misc_feature 1..107: note = chr5:124084195-124084302
  misc_feature 1..107: note = hyper
  source 1..107: mol_type = genomic DNA
tatagagacacaccacgcaaccgtacttacggtctgtattggatcgagttgaccttttccttctaactgcattgaatgtgtttggttgcagccgctttattttggaa

SEQ ID NO: 92852 - DNA, 206 bp, Homo sapiens
  misc_feature 1..206: note = chr5:124084771-124084977
  misc_feature 1..206: note = hyper
  source 1..206: mol_type = genomic DNA
ggcaaaaaaatggtgcgcccctttcaattactacatcattcacataaaacacttatttattaaaacaaatctcaaacaggctgcgaggagaggatgtcggtaaatacaagtttgattgtgttatcttgggggaaataatgtatgtgatcgctcggtggcagagagaagccaaacgagccgctagcgcgtagcgaagagaaaaggga

SEQ ID NO: 92853 - DNA, 84 bp, Homo sapiens
  misc_feature 1..84: note = chr5:124128502-124128586
  misc_feature 1..84: note = hypo
  source 1..84: mol_type = genomic DNA
attcacttccatgtcctcatcagaagcactcacactaccgtcaaacatttaaggttaaaacaaagattacgttatgtgtagcag

SEQ ID NO: 92854 - DNA, 30 bp, Homo sapiens
  misc_feature 1..30: note = chr5:1245053-1245083
  misc_feature 1..30: note = hypo
  source 1..30: mol_type = genomic DNA
atgggctttgtgcagcgcccgagtgcccgc

SEQ ID NO: 92855 - DNA, 30 bp, Homo sapiens
  misc_feature 1..30: note = chr5:1254554-1254584
  misc_feature 1..30: note = hypo
  source 1..30: mol_type = genomic DNA
ggcacagccactgcacggcctcggagggca

SEQ ID NO: 92856 - DNA, 476 bp, Homo sapiens
  misc_feature 1..476: note = chr5:125930586-125931062
  misc_feature 1..476: note = hyper
  source 1..476: mol_type = genomic DNA
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagcccgggactcgggatgagcccaaggccctgagagctgctgaaatagagccccgccccccgcccgggagaacccattgggcagacccgacccctcccactgggcacgaccccgccaccgccccgtctgcccctggtcttccggaggagcctgcggctgaatcctgcc

SEQ ID NO: 92857 - DNA, 30 bp, Homo sapiens
  misc_feature 1..30: note = chr5:125931300-125931330
  misc_feature 1..30: note = hyper
  source 1..30: mol_type = genomic DNA
cctcagcgatggtgacgcctcttgtccctg

SEQ ID NO: 92858 - DNA, 18 bp, Homo sapiens
  misc_feature 1..18: note = chr5:125937930-125937948
  misc_feature 1..18: note = hypo
  source 1..18: mol_type = genomic DNA
gcccggcccagcttccct

SEQ ID NO: 92859 - DNA, 337 bp, Homo sapiens
  misc_feature 1..337: note = chr5:126199749-126200086
  misc_feature 1..337: note = hypo
  source 1..337: mol_type = genomic DNA
gctggggacgataggcgaagacgggctccaaaaaattctgtcctgccctgtctgcgtgtagctcctcccacaagaggcgggcctgtgactgctttgaccaataggatacagagtaagcactgccctgggactgcctagccccgtgtttaagcaggagccttgggccgctgccactgccatttcacggagtcctacaaacagctgccacgtggagaggcgggccacatggagcagcactgtgccatcggactgtgtaagacacctggcagaggtactgcccagctgtggccagatcaacccgtggaataatgagatacaataacgtagttgttttgga

SEQ ID NO: 92860 - DNA, 35 bp, Homo sapiens
  misc_feature 1..35: note = chr5:126327499-126327534
  misc_feature 1..35: note = hypo
  source 1..35: mol_type = genomic DNA
tccttggcaaatgtacgcctcgacctgataaaaca

SEQ ID NO: 92861 - DNA, 97 bp, Homo sapiens
  misc_feature 1..97: note = chr5:126328776-126328873
  misc_feature 1..97: note = hypo
  source 1..97: mol_type = genomic DNA
ttttaaagcagaccatcatgatccacaataggctacagaaagacgagccctccaactcaaatagtccttgcactgatttttccgttgagtataaaag

SEQ ID NO: 92862 - DNA, 150 bp, Homo sapiens
  misc_feature 1..150: note = chr5:126339372-126339522
  misc_feature 1..150: note = hypo
  source 1..150: mol_type = genomic DNA
cggagcttgcagtgagccgagatcgtgccagaggagtatacaaccttggtagatgaggagtgaagagaaaaacttacaaaaagtggatagtgaattatgtgtcatgagaggatcccacaaaaacgttacatttgtcgtacacagttgtgc

SEQ ID NO: 92863 - DNA, 144 bp, Homo sapiens
  misc_feature 1..144: note = chr5:126366959-126367103
  misc_feature 1..144: note = hyper
  source 1..144: mol_type = genomic DNA
ggaggcttgggcgctcgacggcgccggaacctgtgagaccgtcgctctgggcgggctgccgtgcggggtggcatcctctgcggtgacttctgctgtcttttgggtccgccaggattccaaaatcccaggcgggtcgctagaatt

SEQ ID NO: 92864 - DNA, 30 bp, Homo sapiens; identical to SEQ ID NO: 40585
  misc_feature 1..30: note = chr5:126409452-126409482
  misc_feature 1..30: note = hypo
  source 1..30: mol_type = genomic DNA

SEQ ID NO: 92865 - DNA, 30 bp, Homo sapiens
  misc_feature 1..30: note = chr5:1264364-1264394
  misc_feature 1..30: note = hypo
  source 1..30: mol_type = genomic DNA
cagccccagatgggacgaggggcaccctgt

SEQ ID NO: 92866 - DNA, 385 bp, Homo sapiens
  misc_feature 1..385: note = chr5:126626332-126626717
  misc_feature 1..385: note = hyper
  source 1..385: mol_type = genomic DNA
agatcctgcatgttgcgctagggactgcgcgcggcgccaagcgacaaccccccagcggccactgccccggcagcagcagctgcagcagcggcaactgctcgaatcccggccccggctcgggttacccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggtt

SEQ ID NO: 92867 - DNA, 30 bp, Homo sapiens; identical to SEQ ID NO: 40586
  misc_feature 1..30: note = chr5:126851264-126851294
  misc_feature 1..30: note = hypo
  source 1..30: mol_type = genomic DNA

SEQ ID NO: 92868 - DNA, 30 bp, Homo sapiens
  misc_feature 1..30: note = chr5:1272253-1272283
  misc_feature 1..30: note = hypo
  source 1..30: mol_type = genomic DNA
ccactgctgggagtccgtgcccaaccctgc

SEQ ID NO: 92869 - DNA, 146 bp, Homo sapiens
  misc_feature 1..146: note = chr5:127537084-127537230
  misc_feature 1..146: note = hyper
  source 1..146: mol_type = genomic DNA
gatttcagtgtaactcgccgagtgaggactcttggcccacgctgggagcccgcagccggcatccgccaccgccgggcaggtgtgcgctgggcgggcgcgcggactcgcctttgcccggcccgcggctcccccgtgtggcctgagta

SEQ ID NO: 92870 - DNA, 335 bp, Homo sapiens
  misc_feature 1..335: note = chr5:127872845-127873180
  misc_feature 1..335: note = hyper
  source 1..335: mol_type = genomic DNA
ccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 92871 - DNA, 254 bp, Homo sapiens; identical to SEQ ID NO: 29874
  misc_feature 1..254: note = chr5:127873552-127873806
  misc_feature 1..254: note = hyper
  source 1..254: mol_type = genomic DNA

SEQ ID NO: 92872 - DNA, 497 bp, Homo sapiens; identical to SEQ ID NO: 29875
  misc_feature 1..497: note = chr5:127873981-127874478
  misc_feature 1..497: note = hyper
  source 1..497: mol_type = genomic DNA

SEQ ID NO: 92873 - DNA, 472 bp, Homo sapiens
  misc_feature 1..472: note = chr5:127874705-127875177
  misc_feature 1..472: note = hyper
  source 1..472: mol_type = genomic DNA
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtggtgacaaggcgggtaaatgaggctcggggcatgcccttgcttcctggcttggaccccttctgattgattaaatcctagcaattggtgcaaccctctgtacctcttagagtgcctctcaccggcctgctctgggt

SEQ ID NO: 92874 - DNA, 30 bp, Homo sapiens
  misc_feature 1..30: note = chr5:12805470-12805500
  misc_feature 1..30: note = hypo
  source 1..30: mol_type = genomic DNA
cccccagcctccagacgctgcccctgggcc

SEQ ID NO: 92875 - DNA, 40 bp, Homo sapiens; identical to SEQ ID NO: 8024
  misc_feature 1..40: note = chr5:128300655-128300695
  misc_feature 1..40: note = hyper
  source 1..40: mol_type = genomic DNA

SEQ ID NO: 92876 - DNA, 162 bp, Homo sapiens
  misc_feature 1..162: note = chr5:128300712-128300874
  misc_feature 1..162: note = hyper
  source 1..162: mol_type = genomic DNA
cgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggc

SEQ ID NO: 92877 - DNA, 411 bp, Homo sapiens
  misc_feature 1..411: note = chr5:128300900-128301311
  misc_feature 1..411: note = hyper
  source 1..411: mol_type = genomic DNA
cggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagc

SEQ ID NO: 92878 - DNA, 641 bp, Homo sapiens
  misc_feature 1..641: note = chr5:128795456-128796097
  misc_feature 1..641: note = hyper
  source 1..641: mol_type = genomic DNA
acccacctctctagtcgtgtcttcccatctccctactcattccctcccgcgccgctgcgggtgagagccttcagcggtgcgtcctaaggagcgtgaggagtgtgcggagcttggcacaccaagttgctgagactgtgacaccagcctccgcccgttccgcgcgggtgcaggcggcgagcctcggctcggacaccacagctctcctgcccgcgccgggcagtcctctgcctgtccagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 92879 - DNA, 1372 bp, Homo sapiens
  misc_feature 1..1372: note = chr5:128796098-128797470
  misc_feature 1..1372: note = hyper
  source 1..1372: mol_type = genomic DNA
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtctttgcatcggttttcttttcaacaatgaagtgcggtcaccaaactttgattccccctcccccgcccctaatataatcgtacttttactctgaaaatgctggggtctgtaatctgatcgcaaggcttctggggttgcagagtttcagggtctagacgggtggtctccattgcattcaacgcgagcgccctgtatctatggactgtgagcttggaaatgtttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 92880 - DNA, 31 bp, Homo sapiens
  misc_feature 1..31: note = chr5:1291862-1291893
  misc_feature 1..31: note = hypo
  source 1..31: mol_type = genomic DNA
acgtgacagggacacccggggaccacgcctc

SEQ ID NO: 92881 - DNA, 45 bp, Homo sapiens
  misc_feature 1..45: note = chr5:129239737-129239782
  misc_feature 1..45: note = hyper
  source 1..45: mol_type = genomic DNA
cccggacccgagctccgccgatgaggtcagcggagcctaggcgcc

SEQ ID NO: 92882 - DNA, 877 bp, Homo sapiens
  misc_feature 1..877: note = chr5:129240024-129240901
  misc_feature 1..877: note = hyper
  source 1..877: mol_type = genomic DNA
ctctccggctggcagcggtgccgcctgcggctcctcctccgggccagctcggagcccggcggcggggggagcgggaggcgggagtgagggcgggggctcgggaaggagggaggagggagggcccaggcgcgccactgacagggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtg

SEQ ID NO: 92883 - DNA, 35 bp, Homo sapiens
  misc_feature 1..35: note = chr5:129241105-129241140
  misc_feature 1..35: note = hyper
  source 1..35: mol_type = genomic DNA
gggcgcgtttcatcccgggccgcgtggagttcttt

SEQ ID NO: 92884 - DNA, 466 bp, Homo sapiens
  misc_feature 1..466: note = chr5:129241413-129241879
  misc_feature 1..466: note = hyper
  source 1..466: mol_type = genomic DNA
gcttctctgccagcacgtgcttcgggctcccacaggccctggcccgccctccccaccccttgcatccgcccacaattcgtagcccgttcctcgtcttctgcaatctggaccctcctcacacctgcctggctttattcgccttcctcacttgctgttttcggtgccgcctcgcgcttgtcccttagtctttacctcgtcggagaggttagaaaaggaaccttagagctaaaccaaaggccattcccactctgccctcctctgaaagcccctgctgatggtagtttccccaatcggtccagaggggcgtggtcttcaggaagggaagacggaggatgctagctacaactagtctggagatccagtgttctggctttggatcttgctcttttgtttaaactggatctagcgcacttttggaactgctcagattgaggaatcgtcttcgctgtcccggaccctttcctat

SEQ ID NO: 92885 - DNA, 144 bp, Homo sapiens
  misc_feature 1..144: note = chr5:1294182-1294326
  misc_feature 1..144: note = hypo
  source 1..144: mol_type = genomic DNA
accacacagaaaccacggtcactcggtccacgcgtcctgcccgggtgggcccaggacccctgcccaacgggcgtccgctccggctcaggggcagcgccacgcctgggcctcttgggcaacggcagacttcggctggcactgccc

SEQ ID NO: 92886 - DNA, 900 bp, Homo sapiens
  misc_feature 1..900: note = chr5:1294543-1295443
  misc_feature 1..900: note = hyper
  source 1..900: mol_type = genomic DNA
gcaggtgaaccagcacgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 92887 - DNA, 900 bp, Homo sapiens; identical to SEQ ID NO: 92886
  misc_feature 1..900: note = chr5:1294543-1295443
  misc_feature 1..900: note = hypo
  source 1..900: mol_type = genomic DNA

SEQ ID NO: 92888 - DNA, 115 bp, Homo sapiens
  misc_feature 1..115: note = chr5:1295604-1295719
  misc_feature 1..115: note = hyper
  source 1..115: mol_type = genomic DNA
cgctggcctgatccggagacccagggctgcctccaggtccggacgcggggcgtcgggctccgggcaccacgaatgccggacgtgaaggggaggacggaggcgcgtagacgcggct

SEQ ID NO: 92889 - DNA, 30 bp, Homo sapiens
  misc_feature 1..30: note = chr5:130331203-130331233
  misc_feature 1..30: note = hypo
  source 1..30: mol_type = genomic DNA
tgagaacgggaagtccgtgggtctagcggg

SEQ ID NO: 92890 - DNA, 92 bp, Homo sapiens; identical to SEQ ID NO: 40587
  misc_feature 1..92: note = chr5:131305994-131306086
  misc_feature 1..92: note = hypo
  source 1..92: mol_type = genomic DNA

SEQ ID NO: 92891 - DNA, 403 bp, Homo sapiens
  misc_feature 1..403: note = chr5:131346834-131347237
  misc_feature 1..403: note = hyper
  source 1..403: mol_type = genomic DNA
ggagatggacaaggacgcaatgtctgttcctggccttggctcagggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagagggagccccccgacacgaggaagaa

SEQ ID NO: 92892 - DNA, 162 bp, Homo sapiens
  misc_feature 1..162: note = chr5:131347627-131347789
  misc_feature 1..162: note = hyper
  source 1..162: mol_type = genomic DNA
ctggaagggggagcacgggcgacgagcgccagagcgtgacattgagcccaccccgccgccacccaccccatcaacacgcgaccctgcccccgcgcgactcgcagcctgggttttatggctgggcaggctcgaatggcagccgggtcgcggttacctgtccta

SEQ ID NO: 92893 - DNA, 324 bp, Homo sapiens
  misc_feature 1..324: note = chr5:131593088-131593412
  misc_feature 1..324: note = hyper
  source 1..324: mol_type = genomic DNA
agctgggtttgggtccgcggcctgcagatccaaggcccgagcaggatccaggccgtcggggccgtccgaacgcggggatctctgagagctgagtgggggtgccgggttgccggcagccggggctgagggcgggtcctcagagccccccgaagtgggagggtcgggctggccgcggggccaatccaggcgcacagggagcgggggcgggggctgggccgagtggggacaggggcgggcgggccgggggcgggcgcggcgtccaggcggcggcggcggctgcggcggcggcggctcctcctcagagtccggctcaggctccggctg

SEQ ID NO: 92894 - DNA, 43 bp, Homo sapiens
  misc_feature 1..43: note = chr5:131593472-131593515
  misc_feature 1..43: note = hyper
  source 1..43: mol_type = genomic DNA
cgcctggtgggcggccgggacttcagcgcgcccctcaccatct

SEQ ID NO: 92895 - DNA, 30 bp, Homo sapiens
  misc_feature 1..30: note = chr5:131608230-131608260
  misc_feature 1..30: note = hypo
  source 1..30: mol_type = genomic DNA
ctgggatgctgcgtgcggcgcgacgacagg

SEQ ID NO: 92896 - DNA, 30 bp, Homo sapiens
  misc_feature 1..30: note = chr5:131608541-131608571
  misc_feature 1..30: note = hyper
  source 1..30: mol_type = genomic DNA
ggtttcttccacccacgagcactttattct

SEQ ID NO: 92897 - DNA, 227 bp, Homo sapiens
  misc_feature 1..227: note = chr5:131610019-131610246
  misc_feature 1..227: note = hypo
  source 1..227: mol_type = genomic DNA
tgcccaccctgcctccgctgacttggtcccagccccacccagtcataggtgggagaggagaggatgactggcacccaggaaagcagggaagcattattaagcacaggagtgggtggaaaaataccgggagccatgggccctggcccccacctctcactcccactcacccgcagaaactcgactctcccactggccaccacagatccactagccgctggtactcacct

SEQ ID NO: 92898 - DNA, 267 bp, Homo sapiens
  misc_feature 1..267: note = chr5:131613605-131613872
  misc_feature 1..267: note = hypo
  source 1..267: mol_type = genomic DNA
aaaaaaaagcatcattcttgccacgcaacaggctgttctcctacagccatggtaaggactttgacttttactctgagatgaaaagccagaggagcggcatgacctggaattatgttttaactaggatcacattgtctgctgtatggagaataggccctaaggggcaaaggtagacgcagtaaaaccagttagcaagcatgactgcgttcatccctaactaattccaaactagcccactctccccagtccagacgccactgtctcatg

SEQ ID NO: 92899 - DNA, 30 bp, Homo sapiens; identical to SEQ ID NO: 40589
  misc_feature 1..30: note = chr5:131787174-131787204
  misc_feature 1..30: note = hypo
  source 1..30: mol_type = genomic DNA

SEQ ID NO: 92900 - DNA, 532 bp, Homo sapiens
  misc_feature 1..532: note = chr5:131991814-131992346
  misc_feature 1..532: note = hyper
  source 1..532: mol_type = genomic DNA
cagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccat

SEQ ID NO: 92901 - DNA, 360 bp, Homo sapiens
  misc_feature 1..360: note = chr5:132083017-132083377
  misc_feature 1..360: note = hyper
  source 1..360: mol_type = genomic DNA
aggcgcggcccggtgcgccagaggtagctccaccgcgagcgttgtgggtggggcccgccgagcccgcctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggag

SEQ ID NO: 92902 - DNA, 37 bp, Homo sapiens
  misc_feature 1..37: note = chr5:132083472-132083509
  misc_feature 1..37: note = hyper
  source 1..37: mol_type = genomic DNA
gccccagagcaagctccgcggccggctccacagtccc

SEQ ID NO: 92903 - DNA, 98 bp, Homo sapiens
  misc_feature 1..98: note = chr5:132083866-132083964
  misc_feature 1..98: note = hypo
  source 1..98: mol_type = genomic DNA
gggtgatgggtgagccgctgcgccggggggcgcttactcccagcgggcatgcagaggaagggacttctcactgccccaccccccgcaccttaagcagg

SEQ ID NO: 92904 - DNA, 77 bp, Homo sapiens
  misc_feature 1..77: note = chr5:132113493-132113570
  misc_feature 1..77: note = hyper
  source 1..77: mol_type = genomic DNA
gcgcgtccggccaggcggccttcccgggcaagggaccagccttcggctccttgtgcaaccaacgagcaggatgcgca

SEQ ID NO: 92905 - DNA, 54 bp, Homo sapiens
  misc_feature 1..54: note = chr5:132201467-132201521
  misc_feature 1..54: note = hypo
  source 1..54: mol_type = genomic DNA
caagacacctcagggcgagctgtacattgacaacagcatcgtcaagcagaatgc

SEQ ID NO: 92906 - DNA, 20 bp, Homo sapiens
  misc_feature 1..20: note = chr5:132399919-132399939
  misc_feature 1..20: note = hypo
  source 1..20: mol_type = genomic DNA
aggtgcggtggctcacgcct

SEQ ID NO: 92907 - DNA, 30 bp, Homo sapiens
  misc_feature 1..30: note = chr5:132759633-132759663
  misc_feature 1..30: note = hyper
  source 1..30: mol_type = genomic DNA
ggagctgaggaacagcgctggggtcccggc

SEQ ID NO: 92908 - DNA, 60 bp, Homo sapiens
  misc_feature 1..60: note = chr5:132888793-132888853
  misc_feature 1..60: note = hyper
  source 1..60: mol_type = genomic DNA
ctgacctccagggggcgcgggagagagggtgagtcccgcggtacccggaacccacagtct

SEQ ID NO: 92909 - DNA, 1822 bp, Homo sapiens
  misc_feature 1..1822: note = chr5:132946707-132948529
  misc_feature 1..1822: note = hyper
  source 1..1822: mol_type = genomic DNA
cttgcaacaaatttacgaaggtaacagaccaagctgccggcgctgtttttcactggaggaaagctcggcggaagcgacacctagaggggagcggcgggctgtggccgcgccattcatcagtgtcggcggcccgcggccgcgagcgagggctgctggacagcgccccggcacccgctctcgagccgcgacaccgacctcgccgggcccgccccgctgacccgcgcactcctagtgcacttgccgcgccgcgcggaggctcgccgcgctctggaaaacaagaaaccccactgcctcggcggctttccgctcccgcaagagttgcgggcacaaagtcctcaggtggcaggcctggggttggcgccgctttgtcggctgcagggagccccaaagactagcgtcagctcgtccccaaactcgaggcgacaggcgccgaaagcagagtgctgtgcctgcctcgtccaggtccctcctgaaactcagaactcgtctttgttttgcgggcgcaaagagggcggagatcatccacagtgcaagctctcttaggaccaagcccccagcccgaacgctgaacgcccccaacacactgctccctagacacgttcaagcgggtaccccgggccgctcactctggaccgcggccggctacgcacaagcagcgccgcaggctgcctggagtcgggtcgtgccctgattccttcctccccagcctcacatgcggcggaccccggggaagccagggccaggcgaagcgcagcgggccctttgggctgcagcgaggagacgcaagtttccccgcaaagccgcggggaggaggtgctgagaatgcctgcccggcgccccaacccggagccaagggcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 92910 - DNA, 30 bp, Homo sapiens
  misc_feature 1..30: note = chr5:133262317-133262347
  misc_feature 1..30: note = hypo
  source 1..30: mol_type = genomic DNA
ctccacagcacagcccgcagcccggcgagg

SEQ ID NO: 92911 - DNA, 168 bp, Homo sapiens
  misc_feature 1..168: note = chr5:133406834-133407002
  misc_feature 1..168: note = hyper
  source 1..168: mol_type = genomic DNA
ccccgaggggatcctcggcccagccttcctgggggatgaatttacaaagagttcccagcgggtgccaccctccccttcccttggaaggcgctcagccactgccaaggtgcggacgcagcgggggcggcgccgtgcgggagggggcagccagcgcggccacttcaaagc

SEQ ID NO: 92912 - DNA, 251 bp, Homo sapiens
  misc_feature 1..251: note = chr5:133449673-133449924
  misc_feature 1..251: note = hyper
  source 1..251: mol_type = genomic DNA
tgggacttggaggatcggctgaggtccggtgctcttggctgtgttcgcggctcggagccgtcgcctgactgaggggcccgtcacagatgtgtgatgtataagctctgcacgcaacaggagctcaataaatgtgcgaaggggggtatacttatgttcgcactgtatgcaggcggcctagaaggaagtccctgattggcacagggatggaggatggggcaagagccgcaacagcgccgcggagttccaacgct

SEQ ID NO: 92913 - DNA, 27 bp, Homo sapiens
  misc_feature 1..27: note = chr5:133682096-133682123
  misc_feature 1..27: note = hypo
  source 1..27: mol_type = genomic DNA
ttgttaaatttgtcacgcttttctctt

SEQ ID NO: 92914 - DNA, 120 bp, Homo sapiens
  misc_feature 1..120: note = chr5:133820016-133820136
  misc_feature 1..120: note = hypo
  source 1..120: mol_type = genomic DNA
gagccaacgcgcccggcccgtgttttgttttgttttgttttgttttttactgtgatggccagaaccgttagtataatgttaaataaaagtggtagtaatgatgccaggcgcggtggctca

SEQ ID NO: 92915 - DNA, 71 bp, Homo sapiens
  misc_feature 1..71: note = chr5:134242171-134242242
  misc_feature 1..71: note = hypo
  source 1..71: mol_type = genomic DNA
aaatttaaaatagctcgaagacggaggaagataggcactccgccgcttcttgtccacgaaggggagaacac

SEQ ID NO: 92916 - DNA, 30 bp, Homo sapiens
  misc_feature 1..30: note = chr5:134256782-134256812
  misc_feature 1..30: note = hypo
  source 1..30: mol_type = genomic DNA
ggttctgtcaggattcgtgaacccagcaga

SEQ ID NO: 92917 - DNA, 96 bp, Homo sapiens
  misc_feature 1..96: note = chr5:134339741-134339837
  misc_feature 1..96: note = hypo
  source 1..96: mol_type = genomic DNA
ggagctatagactggagttgttcttattcagccatcatctcctccagtatttcgtcttttggtaaagaggggtcccccacccgcattcagttgcca

SEQ ID NO: 92918 - DNA, 67 bp, Homo sapiens
  misc_feature 1..67: note = chr5:134365027-134365094
  misc_feature 1..67: note = hyper
  source 1..67: mol_type = genomic DNA
gagaagggtcagggccgctgcgggccgggagggaccccacccccttccccaccgcctggagccttcc

SEQ ID NO: 92919 - DNA, 548 bp, Homo sapiens
  misc_feature 1..548: note = chr5:134366718-134367266
  misc_feature 1..548: note = hyper
  source 1..548: mol_type = genomic DNA
ggggttgccttagtccgaggatcaggtaggatgagggtcaaaggggttgaaggtccgaggcgcctggaggcctggcagacgctagtgggccagggcctaaggtggggatctccggtggagggagggagcaggtctgaatggtgggagagtgaagttctgcttgtgggtctaagctttggagggctgcagcagaggcggcccgggagccctctgcgcgggtgcccttaggcgcgcaccccttgctcacccgcacgcgcggctcggtgaggttggtccacacggcgatctcctccctcatgctcatgtcggggtagcggttcctctggaacgtggcctctagctcttgcaactgctggcttgtgaagtgcgtacgttgccgccgctgcttcttcttcttggctgggtcgtctgcgccgccgcagcccgtgcctcccgcaccactgtcctcgggccccttgggttccccgccgcgctccttctctgcagtaggcaggacggggagcgggtcacctgggcttacgccccgttgcaccccgtcccggctccac

SEQ ID NO: 92920 - DNA, 21 bp, Homo sapiens
  misc_feature 1..21: note = chr5:134367284-134367305
  misc_feature 1..21: note = hyper
  source 1..21: mol_type = genomic DNA
cgctggcggtcttccctccct

SEQ ID NO: 92921 - DNA, 124 bp, Homo sapiens
  misc_feature 1..124: note = chr5:134368720-134368844
  misc_feature 1..124: note = hyper
  source 1..124: mol_type = genomic DNA
caaaaaaaggcagcgcggagggagacgcgcaggagccggggcgggggccagagccgggctgctccgggcttcggccgcgcacgtgggccggatcccttgatcggcgttccggctggccttgctg

SEQ ID NO: 92922 - DNA, 59 bp, Homo sapiens
  misc_feature 1..59: note = chr5:134374447-134374506
  misc_feature 1..59: note = hyper
  source 1..59: mol_type = genomic DNA
tcaatttcagaaatccgagacccggttcttgagaagcgactgcgtgctccgggaccctg

SEQ ID NO: 92923 - DNA, 1060 bp, Homo sapiens; identical to SEQ ID NO: 29897
  misc_feature 1..1060: note = chr5:134374791-134375851
  misc_feature 1..1060: note = hyper
  source 1..1060: mol_type = genomic DNA

SEQ ID NO: 92924 - DNA, 163 bp, Homo sapiens
  misc_feature 1..163: note = chr5:134376212-134376375
  misc_feature 1..163: note = hyper
  source 1..163: mol_type = genomic DNA
ttcctggctggctgccgctgggagacgggctggacgcaagggaactgggagcctgtcctttgcccaccctcaggccacagggctccccagcgttgcctcgtggccagataaccctgtgcgcgaagcctcatggtggaaaccagttggccgaacctactcctgg

SEQ ID NO: 92925 - DNA, 132 bp, Homo sapiens
  misc_feature 1..132: note = chr5:134376731-134376863
  misc_feature 1..132: note = hyper
  source 1..132: mol_type = genomic DNA
cgaagcgggaagccggcccgacccaagctcacagaggcctcggtgttcaggccctgccaggtggcctctgcaccctgtcgtgctgttccagggactccataccctcctctcaaccctcgacagcaggaaccc

SEQ ID NO: 92926 - DNA, 279 bp, Homo sapiens
  misc_feature 1..279: note = chr5:134385889-134386168
  misc_feature 1..279: note = hyper
  source 1..279: mol_type = genomic DNA
caccaggagctgtctcgggacctgggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagagg

SEQ ID NO: 92927 - DNA, 199 bp, Homo sapiens
  misc_feature 1..199: note = chr5:134386184-134386383
  misc_feature 1..199: note = hyper
  source 1..199: mol_type = genomic DNA
cgccgcctcactcttccgcgcgaggtgccgggtggcccagcagcaggtgctcgcgcgcaggtccagagcggcgcgttgcagagcccgctgtgccaccggagaaccgtggagcagccagggccgcactcgggcgtctgtccccagcctcatggttgccagcagagctggcgcaggggcgcgcaggcggtgagagcaatga

SEQ ID NO: 92928 - DNA, 120 bp, Homo sapiens
  misc_feature 1..120: note = chr5:134583042-134583162
  misc_feature 1..120: note = hypo
  source 1..120: mol_type = genomic DNA
agagcaaatgccttacgtttagcggatgcgctaggaacggctaggacctcccagggtttgccttgtgcccatggaaccagcagttccgccccaagggaagccagccgtgtgtcctagtgc

SEQ ID NO: 92929 - DNA, 166 bp, Homo sapiens
  misc_feature 1..166: note = chr5:1346140-1346306
  misc_feature 1..166: note = hypo
  source 1..166: mol_type = genomic DNA
cctggagcaggcacccgaggccgcgtgcaggggcggtcctgggccaccaacccctggaagctgggccaggagcttcggagccatccgaggcttttttcgctcctctcactctcatgcacctagttaccctccccacagagtcttctcacggcgcggttttcggcta

SEQ ID NO: 92930 - DNA, 50 bp, Homo sapiens; identical to SEQ ID NO: 40424
  misc_feature 1..50: note = chr5:1346659-1346709
  misc_feature 1..50: note = hypo
  source 1..50: mol_type = genomic DNA

SEQ ID NO: 92931 - DNA, 109 bp, Homo sapiens
  misc_feature 1..109: note = chr5:134801812-134801921
  misc_feature 1..109: note = hyper
  source 1..109: mol_type = genomic DNA
ctcttctcaagtaggcggcaaagtttactggtgattgcgaagtgattgcagagcggttggagagtgaatggatccggagcagcgtagcaaacagcgcagtctggggggc

SEQ ID NO: 92932 - DNA, 144 bp, Homo sapiens
  misc_feature 1..144: note = chr5:134802222-134802366
  misc_feature 1..144: note = hyper
  source 1..144: mol_type = genomic DNA
gaccgcaattaggaccggagagcacttgatttctaaactgcgccttctggaagatttctaaacttgcgcctcctgggaagaaggctagagttagcgttgccgcagggctgtgcctcagacgaccaggcacgaccaagcacacag

SEQ ID NO: 92933 - DNA, 89 bp, Homo sapiens
  misc_feature 1..89: note = chr5:134824488-134824577
  misc_feature 1..89: note = hyper
  source 1..89: mol_type = genomic DNA
gggttggctgggtgacggcctgtctccctccgctagcctcctcgggtccttcgggaggcgccagattgtgtgggcggcatcgcctgggg

SEQ ID NO: 92934 - DNA, 30 bp, Homo sapiens
  misc_feature 1..30: note = chr5:134824825-134824855
  misc_feature 1..30: note = hyper
  source 1..30: mol_type = genomic DNA
ggccctgggctttgtcgctttcagggaact

SEQ ID NO: 92935 - skipped

SEQ ID NO: 92936 - DNA, 408 bp, Homo sapiens
  misc_feature 1..408: note = chr5:134825383-134825791
  misc_feature 1..408: note = hyper
  source 1..408: mol_type = genomic DNA
tgtttaaaagggggccgagagcgagggcgcccaatctttgaactggtcgggttttgcatgcctccgctccgagcccgtggagcgctgcacaaaatcgtctagcgcggagcagggcggggacggggagagacacaaaacaatcctcgggctttctcgctactgagccttcggggccgtttccccaagcgcaaacagatgcaaatgtctctgcaaacattgcacaaagctattcagagagaggcagcctctcgcggcctcaatagccctttaaacctagtccaattgcccccaagtagaggtaaagagtccacatgcattttttcactttggctggaagaggggcggaggaggcgagggccttggggagcaaggtatgagggctgctctggttcagcggttcgtgccatc

SEQ ID NO: 92937 - DNA, 348 bp, Homo sapiens
  misc_feature 1..348: note = chr5:134825912-134826260
  misc_feature 1..348: note = hyper
  source 1..348: mol_type = genomic DNA
ggagaggcccccgggacctttcaggcccacaaacgccgcgctaaatagccacgcgcacaatagcatgaaagggctcactcggaccttactgcaacacagtagattcacacccctccgaggggactaataagctcgtaactaacgcgcaacgctcagcggtgagagcgggcttgcgccctgctggcccctcgcagtacgcagactcagtctttcagcgtcactcggaggcccaagggcagccgctgcacggagggccaggcatttccttctaacctcgccagtagaggagcctggggcctgccggtgcagtccttaatgcaccccaaactcacgtggggctggcgaccc

SEQ ID NO: 92938 - DNA, 30 bp, Homo sapiens
  misc_feature 1..30: note = chr5:134826479-134826509
  misc_feature 1..30: note = hyper
  source 1..30: mol_type = genomic DNA
cgtgcgctgagggcccggaaaagccccttc

SEQ ID NO: 92939 - DNA, 504 bp, Homo sapiens
  misc_feature 1..504: note = chr5:134870423-134870927
  misc_feature 1..504: note = hyper
  source 1..504: mol_type = genomic DNA
tgcaaaaggaaaggccgtctaggggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatc

SEQ ID NO: 92940 - DNA, 723 bp, Homo sapiens
  misc_feature 1..723: note = chr5:134871417-134872140
  misc_feature 1..723: note = hyper
  source 1..723: mol_type = genomic DNA
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacga

SEQ ID NO: 92941 - DNA, 702 bp, Homo sapiens
  misc_feature 1..702: note = chr5:134879271-134879973
  misc_feature 1..702: note = hyper
  source 1..702: mol_type = genomic DNA
tgcatctctttgggacgccggccgcgcccccacccttgccgccgccgtcgccgccgccacttcggttttgctctggctggggagacccggcgtttctggatttcttttatgcagccacaaataaaggctcctaggctggaagaaggggatttccccccaagtcttgagcaaacgaccctagcgccgtggctcttcctacggcgggggcctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaa

SEQ ID NO: 92942 - DNA, 11 bp, Homo sapiens
  misc_feature 1..11: note = chr5:134880603-134880614
  misc_feature 1..11: note = hyper
  source 1..11: mol_type = genomic DNA
agccagtcttc

SEQ ID NO: 92943 - DNA, 885 bp, Homo sapiens
  misc_feature 1..885: note = chr5:134914192-134915077
  misc_feature 1..885: note = hyper
  source 1..885: mol_type = genomic DNA
atcttgggtcccttccgggagcacttgcatttggaccctgcgagcgagcgcggggcaacggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgcccagggctgtctgtggccgtgcgctgcgctctgcgcttgtctccgcgctctctccacagcctccctccgcccgccctggcctcttttaaatccgctcctgccctcgcagcgagcgagctcattaatatgcagaaccactcggtgactcactgagatttctcaatgtggtgaggggaggagaccttcccagcccgcccgtcgcccgccccgggaaaggacccgctatcgcagcggcgcacacccggagccacgcgcgcacacgcacacacacatccgctaccctctcgctcacacaacacgccgccttcgcacacttgcacacccataccacagcgcgcacacatttccagcgtcccgctctgcctttggggagcccagacggtggagaggctgctgaagggcactgcttttctgaatcgtgtggttctctctctggcccggcaggccagcttt

SEQ ID NO: 92944 - DNA, 290 bp, Homo sapiens; identical to SEQ ID NO: 29911
  misc_feature 1..290: note = chr5:135170256-135170546
  misc_feature 1..290: note = hyper
  source 1..290: mol_type = genomic DNA

SEQ ID NO: 92945 - DNA, 278 bp, Homo sapiens
  misc_feature 1..278: note = chr5:135170915-135171193
  misc_feature 1..278: note = hyper
  source 1..278: mol_type = genomic DNA
tgcacacctgaattgcggacgtggctcgcgggaacttatgtatgagggtagcgcttggctgctgatcccggggcgcagggtggtgggagccaggcttcgagattaggccggcccaacggggcgtcccgactggagggagcagagctctcacagcagggagcggagcgccggctgcaggtgcccattgccaggctgcgaggagcacttattgccttcagccgccgccaaccgtcagccatcgcctacctccaaggccccttctccgggcactgttgggt

SEQ ID NO: 92946 - DNA, 159 bp, Homo sapiens; identical to SEQ ID NO: 29913
  misc_feature 1..159: note = chr5:135265701-135265860
  misc_feature 1..159: note = hyper
  source 1..159: mol_type = genomic DNA

SEQ ID NO: 92947 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 92948 - DNA, 197 bp, Homo sapiens; identical to SEQ ID NO: 485
  misc_feature 1..197: note = chr5:135265932-135266129
  misc_feature 1..197: note = hyper
  source 1..197: mol_type = genomic DNA

SEQ ID NO: 92949 - DNA, 128 bp, Homo sapiens; identical to SEQ ID NO: 29916
  misc_feature 1..128: note = chr5:135266577-135266705
  misc_feature 1..128: note = hyper
  source 1..128: mol_type = genomic DNA

SEQ ID NO: 92950 - DNA, 53 bp, Homo sapiens
  misc_feature 1..53: note = chr5:135364596-135364649
  misc_feature 1..53: note = hyper
  source 1..53: mol_type = genomic DNA
ccggcccagcttccccgcccctggcgtccgctccctcccgctcgcagcttact

SEQ ID NO: 92951 - DNA, 1088 bp, Homo sapiens
  misc_feature 1..1088: note = chr5:135527803-135528891
  misc_feature 1..1088: note = hyper
  source 1..1088: mol_type = genomic DNA
agcgatccccggtgtcgtgccctccctaccaggctcaagctggctgctcttggctaggtcgggacggggcgcccggcggccgtggctcagtcccaagctacaccggccgcgtcttccagggcgcgcgggcgtcgcgcagcgagcggtcgtggggcagcgcggcgaaggccgaatggcgcagctggcaaccgatgaagaggacgacgagcgccaccgagagcagcagcaggaagaagagcagcaggtaggtgggcaggtcgggctttgtggccgcgccgtccctcataccgcgcgcagtggccagctccagcggcaaagcgccttctgccttgaccgtggctcctggggccagcgcgctgcctaccgccgcctcggggccgcccgtggcgttgaatatgtcgccgtacatggcccgcgggtcccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcgggggttcggggga

SEQ ID NO: 92952 - DNA, 28 bp, Homo sapiens
  misc_feature 1..28: note = chr5:1356625-1356653
  misc_feature 1..28: note = hypo
  source 1..28: mol_type = genomic DNA
cggctcacgtggccacggagcagcaccg

SEQ ID NO: 92953 - DNA, 182 bp, Homo sapiens
  misc_feature 1..182: note = chr5:1357154-1357336
  misc_feature 1..182: note = hypo
  source 1..182: mol_type = genomic DNA
ttccagcgcctctgacgaccgcaggctggggcttagacaggacatttattgctcaaagtacagtccatgaggctggcggtcccagatccaggtgtggcagggctacttcctcctgaggcctctccttggcttccagacaccgtcttctccctgagtcctcaccgggtcgcccctctctgcgt

SEQ ID NO: 92954 - DNA, 186 bp, Homo sapiens
  misc_feature 1..186: note = chr5:1362617-1362803
  misc_feature 1..186: note = hypo
  source 1..186: mol_type = genomic DNA
aaccttccggatctgcgctagcgccgggcagtgttggagctgaattaaattgcaggacactcgggtggtgtctgcagagacccggagaattggctggtgtgcaaaacccacacgcttgttgtcagccgtgtcgtgaatcgaggaacagctttcctttatccacaaaaaaagcgagttttcattccc

SEQ ID NO: 92955 - DNA, 40 bp, Homo sapiens
  misc_feature 1..40: note = chr5:136834011-136834051
  misc_feature 1..40: note = hyper
  source 1..40: mol_type = genomic DNA
ccctccgagaggctccgcgccccccagggccgggtggcgc

SEQ ID NO: 92956 - DNA, 203 bp, Homo sapiens; identical to SEQ ID NO: 29920
  misc_feature 1..203: note = chr5:136834289-136834492
  misc_feature 1..203: note = hyper
  source 1..203: mol_type = genomic DNA

SEQ ID NO: 92957 - DNA, 171 bp, Homo sapiens; identical to SEQ ID NO: 29921
  misc_feature 1..171: note = chr5:136834493-136834664
  misc_feature 1..171: note = hyper
  source 1..171: mol_type = genomic DNA

SEQ ID NO: 92958 - DNA, 175 bp, Homo sapiens; identical to SEQ ID NO: 29922
  misc_feature 1..175: note = chr5:136834706-136834881
  misc_feature 1..175: note = hyper
  source 1..175: mol_type = genomic DNA

SEQ ID NO: 92959 - DNA, 232 bp, Homo sapiens
  misc_feature 1..232: note = chr5:136834912-136835144
  misc_feature 1..232: note = hyper
  source 1..232: mol_type = genomic DNA
cgcggcacggtcgccgggaaggctgatcgccggctcgcgcccctgcgctcctgccacacgccgccgccgagcgtctggccgctttgtgagcccgcagcgatgtgctctgctcgctcgctggctcgggcgcggcgtccgcgggcggaggaggccgagcgcgcgagccaaggctctggcgccccctggtggccgcgcgctgcctgcccgacagcccggccgccccagcccggaa

SEQ ID NO: 92960 - DNA, 76 bp, Homo sapiens
  misc_feature 1..76: note = chr5:137225091-137225167
  misc_feature 1..76: note = hyper
  source 1..76: mol_type = genomic DNA
cgtcagagccgggcagcgcgcgccgcaagactagcgcgcaagcgccgcggcctcaggcgaacgaacgggcggtgta

SEQ ID NO: 92961 - DNA, 30 bp, Homo sapiens
  misc_feature 1..30: note = chr5:137474889-137474919
  misc_feature 1..30: note = hyper
  source 1..30: mol_type = genomic DNA
acagcggcgggtgagcggcctcggccagct

SEQ ID NO: 92962 - DNA, 26 bp, Homo sapiens
  misc_feature 1..26: note = chr5:137548023-137548049
  misc_feature 1..26: note = hypo
  source 1..26: mol_type = genomic DNA
tttgagacagtgtcccgctctgccct

SEQ ID NO: 92963 - DNA, 412 bp, Homo sapiens
  misc_feature 1..412: note = chr5:137577572-137577984
  misc_feature 1..412: note = hyper
  source 1..412: mol_type = genomic DNA
ctcccgcagtcaagccgggacctcgcccagcaaggactccagggctgcccaggcaggggcgcccgtccggcaccggactcccgccctgggcccagctccggcgctcggccagccccgtgccccgggcggccgctgatagtcggctaatgcgtatcgaatttttgtggagttcggcccgcgcagagtgcgcgcggaggcgctgcccgagcctcttaattccctttgcatcgatcctgccgttaatgacataaccttctcccctaattaactgacaactgcattaggcggcgcgcctccgccgcacgccgcccacagcttcccccacgcagttccgcccgcgccggtgcggggctggggcgcagcggctccgcctggactcaactcagggtccggctgccgtggtggaggggag

SEQ ID NO: 92964 - DNA, 51 bp, Homo sapiens
  misc_feature 1..51: note = chr5:137727606-137727657
  misc_feature 1..51: note = hypo
  source 1..51: mol_type = genomic DNA
caaaacctttagtaacgtctttggcaggcactcaggcggctttctgtcctc

SEQ ID NO: 92965 - DNA, 23 bp, Homo sapiens
  misc_feature 1..23: note = chr5:137769715-137769738
  misc_feature 1..23: note = hypo
  source 1..23: mol_type = genomic DNA
accgtgcccgtccaacattggtg

SEQ ID NO: 92966 - DNA, 30 bp, Homo sapiens
  misc_feature 1..30: note = chr5:1379058-1379088
  misc_feature 1..30: note = hypo
  source 1..30: mol_type = genomic DNA
tggcccccacttctccgcaaagtggaaact

SEQ ID NO: 92967 - DNA, 30 bp, Homo sapiens
  misc_feature 1..30: note = chr5:138060847-138060877
  misc_feature 1..30: note = hypo
  source 1..30: mol_type = genomic DNA
tgttagtgtggggagcgcatctttgttgca

SEQ ID NO: 92968 - DNA, 38 bp, Homo sapiens
  misc_feature 1..38: note = chr5:1381049-1381087
  misc_feature 1..38: note = hypo
  source 1..38: mol_type = genomic DNA
ggctgcctcatgggacgccacatccgccagcaccctgg

SEQ ID NO: 92969 - DNA, 97 bp, Homo sapiens
  misc_feature 1..97: note = chr5:1381147-1381244
  misc_feature 1..97: note = hypo
  source 1..97: mol_type = genomic DNA
aggcttaggcgtgttgtcacagcagcccgaatggactccagcagcagagcagccagggctgcacgtggtgcgtgaacacacccgccgccctcctcct

SEQ ID NO: 92970 - DNA, 122 bp, Homo sapiens
  misc_feature 1..122: note = chr5:138273634-138273756
  misc_feature 1..122: note = hypo
  source 1..122: mol_type = genomic DNA
ctcctcccctccccacggaagcaagagagaaggagctgccacgtgctgggcacctcagagcctgtgtccagcctttactctcgtcaccccatttcatctgtgcgacccgagatgtcagtgcc

SEQ ID NO: 92971 - DNA, 75 bp, Homo sapiens
  misc_feature 1..75: note = chr5:1384936-1385011
  misc_feature 1..75: note = hypo
  source 1..75: mol_type = genomic DNA
gagcaaaccaggcctcggcatgggcacgggatgaactcagggcaccggtggggtgttggccgtttctgggtaaca

SEQ ID NO: 92972 - DNA, 55 bp, Homo sapiens
  misc_feature 1..55: note = chr5:138586687-138586742
  misc_feature 1..55: note = hypo
  source 1..55: mol_type = genomic DNA
gaaggaatggaaggacgagaagctcatggggagccatcgccgccctgcctctccc

SEQ ID NO: 92973 - DNA, 95 bp, Homo sapiens
  misc_feature 1..95: note = chr5:138627655-138627750
  misc_feature 1..95: note = hypo
  source 1..95: mol_type = genomic DNA
gacaatgtctgactctgtagcccaggctggagtgtgcagtggtgcactaggctcacggcaacctccgcctccggctcaaacgatcctcagccccg

SEQ ID NO: 92974 - DNA, 30 bp, Homo sapiens
  misc_feature 1..30: note = chr5:138670672-138670702
  misc_feature 1..30: note = hypo
  source 1..30: mol_type = genomic DNA
gcactccttcctcggcgacagactgagact

SEQ ID NO: 92975 - DNA, 143 bp, Homo sapiens
  misc_feature 1..143: note = chr5:138676299-138676442
  misc_feature 1..143: note = hypo
  source 1..143: mol_type = genomic DNA
cacccatttcctagtcggtcatttgccctctccaaagggaagaaattagtttgtgtccctttttcaaagatagtatctacacatttgaacatccagatttgtaaaacacatactctcggccgggtgcggtggctcacacctgt

SEQ ID NO: 92976 - DNA, 37 bp, Homo sapiens
  misc_feature 1..37: note = chr5:138679633-138679670
  misc_feature 1..37: note = hypo
  source 1..37: mol_type = genomic DNA
tgactttgtgatccgcccccgtcggcctcccaacaga

SEQ ID NO: 92977 - DNA, 24 bp, Homo sapiens
  misc_feature 1..24: note = chr5:138971490-138971514
  misc_feature 1..24: note = hypo
  source 1..24: mol_type = genomic DNA
ttgaaaacctggggccgggcgcgg

SEQ ID NO: 92978 - DNA, 309 bp, Homo sapiens
  misc_feature 1..309: note = chr5:139047939-139048248
  misc_feature 1..309: note = hyper
  source 1..309: mol_type = genomic DNA
ctgccgcctcccagccggacgcggacgtgcctgcgcggctctggcggccgcgtctgccgccccggcgcccgcccgggtcccaggccgactaattaggcccggctacctcccgcgccgcccactgcccgctccaggcccgctgcccgctccaggcccgaggtgatggcggctgttcctgccgttctggggcctgtgccccagagctggccgcgtttctcggggcgggagccagctctgctcgcctggcttaacccagacgagcccaggacgccctatccctgaaccccatcgtggcgtgcaggtctgagt

SEQ ID NO: 92979 - DNA, 32 bp, Homo sapiens
  misc_feature 1..32: note = chr5:139090340-139090372
  misc_feature 1..32: note = hyper
  source 1..32: mol_type = genomic DNA
ggctggggcctgagccgcgagcagggcggagc

SEQ ID NO: 92980 - DNA, 172 bp, Homo sapiens
  misc_feature 1..172: note = chr5:139142327-139142499
  misc_feature 1..172: note = hypo
  source 1..172: mol_type = genomic DNA
ccggcagacccctcccggcagagccagccccctttcctgccagggggatggcaggacaggaggcctggctggggaggtggtggggctgtggcagcagagaggggaggcaaaggttggcagagtggggagagatggcctggggggagagcagcggagtcgctggggagagagg

SEQ ID NO: 92981 - DNA, 142 bp, Homo sapiens
  misc_feature 1..142: note = chr5:139144114-139144256
  misc_feature 1..142: note = hyper
  source 1..142: mol_type = genomic DNA
cgggaccccgttgccaggagcagtcaggatgcggcagcgtctccatggcaacgcggcatctcgagccgcgcgccgccctcccccggcgccccgcagtgggcaggaggccgagcctggcagcccctcccggcccagcagccag

SEQ ID NO: 92982 - DNA, 467 bp, Homo sapiens
  misc_feature 1..467: note = chr5:139175410-139175877
  misc_feature 1..467: note = hyper
  source 1..467: mol_type = genomic DNA
tcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtgagtggggccgcggggctccgggacccgcccctccccgctggcggccaggccggggcgggacgggccggggagagggccgcgtgcgggtggggggcgtcgccctcgccctcggtgcccacccgggtccgctaacaaagctacatttccagatcaattccgcggcgtctggagcatccgaaggatacggttgtcatggagatggggccgagagaggaagcccgggctggccgggtctgggccggggagagggggcgccgcgggaaagcccgagcccagcctgagggacggtgggggctgccgggccgattgtctcc

SEQ ID NO: 92983 - DNA, 58 bp, Homo sapiens; identical to SEQ ID NO: 29929
  misc_feature 1..58: note = chr5:139175929-139175987
  misc_feature 1..58: note = hyper
  source 1..58: mol_type = genomic DNA

SEQ ID NO: 92984 - DNA, 97 bp, Homo sapiens
  misc_feature 1..97: note = chr5:139227527-139227624
  misc_feature 1..97: note = hyper
  source 1..97: mol_type = genomic DNA
cccgcgggggcggcccgcggctgtgtctgctgctggcccgcgtgctgtggctgtccagtgagtagtaagtcctgctgtcggccgccgggcacagtgg

SEQ ID NO: 92985 - DNA, 234 bp, Homo sapiens
  misc_feature 1..234: note = chr5:139227704-139227938
  misc_feature 1..234: note = hyper
  source 1..234: mol_type = genomic DNA
cgtcgtccgcgtcgtcgtccgacgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactcgtcgtcctcggggatgc

SEQ ID NO: 92986 - DNA, 913 bp, Homo sapiens
  misc_feature 1..913: note = chr5:139283550-139284463
  misc_feature 1..913: note = hyper
  source 1..913: mol_type = genomic DNA
ccgccgcctttctgtcggtatccgcggctccatccccgctcgctcagggctgctcgcctgcaggccggtaccggcgtgcagcgcctcttgcccgcccctgcgtggggacgcggccgcccggggagaggcgcgcacagccactgtcgggctcctggcacgcagccccttgctctcccggccgcgacgacccgctcgcacgcaggcacgcgcgccctcggtgcctgtcaccgcggcggccgctagcgcagcctagactcacccgcgctgcgctgggggcgggtgagcgggcggcaggtttctcccagggaaaccgggtttctgggcgcgcggaggtgccctacctttctccccgggatcgggctccctctcccgcttcctcccctctgggtgcttcttgccgcggccgcggcccctcctcctggactccgacattctgcacggggtcccaggcggtgggacggcctcagctctccgctgccgcgctgcgcccccgccgcctgcagcctcagtgcccgagcgcggcgcctttcttataggcggtcacaccctccgggggaggggagcagcgagccttaactcttcccctcccgcgccctccaccctcgccccccctccaccggctcgggccgcgggggcgtgtgggcggccggtctgggccctaggccccctccctgggcccaccgaggtaggcaagaccggcgcctaaacagggcgccacagacctcctcgccgaagagggggcttgagctgggctgggggcctgagcatgattggggagggcggagtagagatcccccagcgagggccaggctaaggacagcatgggggtggggagacagcgaggaaagggcccaggaagggaccaaaatgaagcccgctagccagcccagcggggtagcgagcacccttggct

SEQ ID NO: 92987 - DNA, 62 bp, Homo sapiens
  misc_feature 1..62: note = chr5:139422801-139422863
  misc_feature 1..62: note = hyper
  source 1..62: mol_type = genomic DNA
ggggcaggcggcaagcgggccgcgatgcgcagcgcggcgcagcgcagcgctcccaccctgtg

SEQ ID NO: 92988 - DNA, 70 bp, Homo sapiens
  misc_feature 1..70: note = chr5:139492746-139492816
  misc_feature 1..70: note = hyper
  source 1..70: mol_type = genomic DNA
accctagccctggtgcgtctactgtcctctgctcggctccccccatcggtgagtgcgcccgcccgcccga

SEQ ID NO: 92989 - DNA, 391 bp, Homo sapiens
  misc_feature 1..391: note = chr5:139525423-139525814
  misc_feature 1..391: note = hyper
  source 1..391: mol_type = genomic DNA
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggcctaggggtggggggccgtaggtgctgcgcgcccgcacaggtggtcaggccgtcagcatgcctggctcgtcgcgcacagaacactgc

SEQ ID NO: 92990 - DNA, 97 bp, Homo sapiens
  misc_feature 1..97: note = chr5:139556302-139556399
  misc_feature 1..97: note = hypo
  source 1..97: mol_type = genomic DNA
gtggggcattggattcgctgaaaggagtcccatactatttgttgattgtagatcaaagatctctagacctggcctggtgcggtggctcacacctgta

SEQ ID NO: 92991 - DNA, 59 bp, Homo sapiens
  misc_feature 1..59: note = chr5:139686-139745
  misc_feature 1..59: note = hypo
  source 1..59: mol_type = genomic DNA
agtcaggctccagcccggggacttctacctgcaggtcacgtcggcggggaagcagtcag

SEQ ID NO: 92992 - DNA, 32 bp, Homo sapiens
  misc_feature 1..32: note = chr5:139779839-139779871
  misc_feature 1..32: note = hypo
  source 1..32: mol_type = genomic DNA
gcgtgagccacggcgcccgctatagaatctga

SEQ ID NO: 92993 - DNA, 30 bp, Homo sapiens
  misc_feature 1..30: note = chr5:139993-140023
  misc_feature 1..30: note = hypo
  source 1..30: mol_type = genomic DNA
tgcacaggtcctgagcggctgcccagcagc

SEQ ID NO: 92994 - DNA, 48 bp, Homo sapiens
  misc_feature 1..48: note = chr5:140011748-140011796
  misc_feature 1..48: note = hyper
  source 1..48: mol_type = genomic DNA
acatgcatctcggagcgctagggtttacggtggcgcgcagcgagttgt

SEQ ID NO: 92995 - DNA, 142 bp, Homo sapiens
  misc_feature 1..142: note = chr5:140012151-140012293
  misc_feature 1..142: note = hyper
  source 1..142: mol_type = genomic DNA
ggcttccagaggcagcggaggcatggtgccggttatctttaggtcctcgagcgtcagttccttgaggcgggagtacgctagcacacgcagggcgcctaccagtagctgagcaggaacctgtgcggctcccactgtgagccgc

SEQ ID NO: 92996 - DNA, 156 bp, Homo sapiens
  misc_feature 1..156: note = chr5:140012364-140012520
  misc_feature 1..156: note = hyper
  source 1..156: mol_type = genomic DNA
cggctctaggttgagaccgccggcatggatctccacctctactgcagacacacactggaaggcttcggaccagtcgggctgaggttcggagaagttgcagacgcagcggaaatcttcatcgtccagctcacaaggttctggcgtggtcgcagagac

SEQ ID NO: 92997 - DNA, 27 bp, Homo sapiens
  misc_feature 1..27: note = chr5:140045321-140045348
  misc_feature 1..27: note = hypo
  source 1..27: mol_type = genomic DNA
cacgcctgtaatacccgcactttggga

SEQ ID NO: 92998 - DNA, 30 bp, Homo sapiens
  misc_feature 1..30: note = chr5:140088640-140088670
  misc_feature 1..30: note = hypo
  source 1..30: mol_type = genomic DNA
tatcttctggggcaacgcatcaaagtccca

SEQ ID NO: 92999 - DNA, 114 bp, Homo sapiens
  misc_feature 1..114: note = chr5:140174726-140174840
  misc_feature 1..114: note = hyper
  source 1..114: mol_type = genomic DNA
gtgccgcgcctgttccgggtggcgtccaaaagacacggggaccttctggaggtaaatctgcagaatggcattttgtttgtgaattctcggatcgaccgggaggagctgtgcggg

SEQ ID NO: 93000 - DNA, 198 bp, Homo sapiens
  misc_feature 1..198: note = chr5:140187083-140187281
  misc_feature 1..198: note = hyper
  source 1..198: mol_type = genomic DNA
ccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcactta

SEQ ID NO: 93001 - DNA, 55 bp, Homo sapiens
  misc_feature 1..55: note = chr5:140214378-140214433
  misc_feature 1..55: note = hyper
  source 1..55: mol_type = genomic DNA
aaggaatctgttcatcgcggaatccaggccgcttgactctcggtttccactagag

SEQ ID NO: 93002 - DNA, 116 bp, Homo sapiens
  misc_feature 1..116: note = chr5:140248756-140248872
  misc_feature 1..116: note = hyper
  source 1..116: mol_type = genomic DNA
ctgggaggtggggagcggccagctccactactccgtctcggaggaggccaaacacggcaccttcgtgggccgcatcgcgcaggacctggggctggagctggcggagctggtgcagc

SEQ ID NO: 93003 - DNA, 142 bp, Homo sapiens
  misc_feature 1..142: note = chr5:140261869-140262011
  misc_feature 1..142: note = hyper
  source 1..142: mol_type = genomic DNA
aaggaggcccaagaccgcggcaactactgctctggcttctgatcctcgcagcctgggagacgggtagtggccagctccactactccgtccccgaggaagcaaaacacggcaccttcgtgggccgcatcgctcaggacctggg

SEQ ID NO: 93004 - DNA, 770 bp, Homo sapiens
  misc_feature 1..770: note = chr5:140305402-140306172
  misc_feature 1..770: note = hyper
  source 1..770: mol_type = genomic DNA
tctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 93005 - DNA, 176 bp, Homo sapiens; identical to SEQ ID NO: 8069
  misc_feature 1..176: note = chr5:140306444-140306620
  misc_feature 1..176: note = hyper
  source 1..176: mol_type = genomic DNA

SEQ ID NO: 93006 - DNA, 113 bp, Homo sapiens; identical to SEQ ID NO: 29943
  misc_feature 1..113: note = chr5:140306674-140306787
  misc_feature 1..113: note = hyper
  source 1..113: mol_type = genomic DNA

SEQ ID NO: 93007 - DNA, 97 bp, Homo sapiens
  misc_feature 1..97: note = chr5:140307010-140307107
  misc_feature 1..97: note = hyper
  source 1..97: mol_type = genomic DNA
cggcagcgaatacccggagttggtgttggagaaagcactggatcgcgaacagcgcgccacccacctgctggtgcttacagctcgggacggcgggcta

SEQ ID NO: 93008 - DNA, 537 bp, Homo sapiens
  misc_feature 1..537: note = chr5:140345497-140346034
  misc_feature 1..537: note = hyper
  source 1..537: mol_type = genomic DNA
ttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccc

SEQ ID NO: 93009 - DNA, 307 bp, Homo sapiens
  misc_feature 1..307: note = chr5:140346506-140346813
  misc_feature 1..307: note = hyper
  source 1..307: mol_type = genomic DNA
ggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccag

SEQ ID NO: 93010 - DNA, 37 bp, Homo sapiens; identical to SEQ ID NO: 40381
  misc_feature 1..37: note = chr5:140350-140387
  misc_feature 1..37: note = hypo
  source 1..37: mol_type = genomic DNA

SEQ ID NO: 93011 - DNA, 30 bp, Homo sapiens
  misc_feature 1..30: note = chr5:140464113-140464143
  misc_feature 1..30: note = hyper
  source 1..30: mol_type = genomic DNA
gattttgacagtttccgcaggaaagcgctg

SEQ ID NO: 93012 - DNA, 30 bp, Homo sapiens
  misc_feature 1..30: note = chr5:140474232-140474262
  misc_feature 1..30: note = hyper
  source 1..30: mol_type = genomic DNA
ggaggctttctaaggcggtcgctccgggaa

SEQ ID NO: 93013 - DNA, 261 bp, Homo sapiens
  misc_feature 1..261: note = chr5:140514695-140514956
  misc_feature 1..261: note = hyper
  source 1..261: mol_type = genomic DNA
aagggtatggatacacgtcagttagaatttaggatgaaatggcaaatactatatgcaatagtaaattaggacgcctggtggcgctgcaggctaagagtgtggatagtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgc

SEQ ID NO: 93014 - DNA, 93 bp, Homo sapiens
  misc_feature 1..93: note = chr5:140581545-140581638
  misc_feature 1..93: note = hyper
  source 1..93: mol_type = genomic DNA
agggcatctggtggacgtgagcggcaccgggaccctttcccagagctaccagtacgaggtgtgtctgacgggaggttccgagacaaatgaatt

SEQ ID NO: 93015 - DNA, 182 bp, Homo sapiens; identical to SEQ ID NO: 29948
  misc_feature 1..182: note = chr5:140593316-140593498
  misc_feature 1..182: note = hyper
  source 1..182: mol_type = genomic DNA

SEQ ID NO: 93016 - DNA, 75 bp, Homo sapiens; identical to SEQ ID NO: 29949
  misc_feature 1..75: note = chr5:140604438-140604513
  misc_feature 1..75: note = hyper
  source 1..75: mol_type = genomic DNA

SEQ ID NO: 93017 - DNA, 210 bp, Homo sapiens
  misc_feature 1..210: note = chr5:140613804-140614014
  misc_feature 1..210: note = hyper
  source 1..210: mol_type = genomic DNA
atattttgtctgaaacgtattggaatttatctaaaacctgaatatctgcagagtcgcatggtggcgctgcaggataagacggtgaaatttttgtaaccgcagatgctctggttttccttaaccatgggaactgaaagcgctggaataccaggagaaaatagtctttcaaaaggtagggcaccatcaacaccttcgcgacaggattaagag

SEQ ID NO: 93018 - DNA, 15 bp, Homo sapiens
  misc_feature 1..15: note = chr5:140614314-140614329
  misc_feature 1..15: note = hyper
  source 1..15: mol_type = genomic DNA
cagagtcatctttga

SEQ ID NO: 93019 - DNA, 28 bp, Homo sapiens
  misc_feature 1..28: note = chr5:140614383-140614411
  misc_feature 1..28: note = hyper
  source 1..28: mol_type = genomic DNA
cgagcagctggaccgggaggcactttgt

SEQ ID NO: 93020 - DNA, 23 bp, Homo sapiens
  misc_feature 1..23: note = chr5:140620855-140620878
  misc_feature 1..23: note = hyper
  source 1..23: mol_type = genomic DNA
caccctgttcgtccgcgagaaca

SEQ ID NO: 93021 - DNA, 29 bp, Homo sapiens
  misc_feature 1..29: note = chr5:140624988-140625017
  misc_feature 1..29: note = hyper
  source 1..29: mol_type = genomic DNA
cctgttagcagagcacggaccagtgtctc

SEQ ID NO: 93022 - DNA, 170 bp, Homo sapiens
  misc_feature 1..170: note = chr5:1406427-1406597
  misc_feature 1..170: note = hypo
  source 1..170: mol_type = genomic DNA
tgtccatcagggcagcgcattcccccgatgctggacacgtgtgggggtcctcgctgactcccaagggccccacctaccggccccaggcttcggctgcacccagcctcctgcagaggaggccaggccacaccccagcccactgggtgcctcgctgacgggtgggagcccac

SEQ ID NO: 93023 - DNA, 120 bp, Homo sapiens
  misc_feature 1..120: note = chr5:140713966-140714086
  misc_feature 1..120: note = hyper
  source 1..120: mol_type = genomic DNA
aagatccttggagccctggagttcaagaccagccggacagggcggcctgcgactgtagtcccagctacgcggggcggggaggggcggggcggggcggggcaggagctgacgtgggaggat

SEQ ID NO: 93024 - DNA, 19 bp, Homo sapiens
  misc_feature 1..19: note = chr5:140714146-140714165
  misc_feature 1..19: note = hyper
  source 1..19: mol_type = genomic DNA
tgggcgacagagccacacc

SEQ ID NO: 93025 - DNA, 95 bp, Homo sapiens
  misc_feature 1..95: note = chr5:140767211-140767306
  misc_feature 1..95: note = hyper
  source 1..95: mol_type = genomic DNA
aagtggagagcttggcgctccagatctcctcgcgcagccgcagcgcgctttccagggcagccccagctcagactccccagcgccagcctttacac

SEQ ID NO: 93026 - DNA, 212 bp, Homo sapiens
  misc_feature 1..212: note = chr5:140777457-140777669
  misc_feature 1..212: note = hyper
  source 1..212: mol_type = genomic DNA
aagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 93027 - DNA, 85 bp, Homo sapiens; identical to SEQ ID NO: 29956
  misc_feature 1..85: note = chr5:140787848-140787933
  misc_feature 1..85: note = hyper
  source 1..85: mol_type = genomic DNA

SEQ ID NO: 93028 - DNA, 203 bp, Homo sapiens; identical to SEQ ID NO: 29957
  misc_feature 1..203: note = chr5:140797076-140797279
  misc_feature 1..203: note = hyper
  source 1..203: mol_type = genomic DNA

SEQ ID NO: 93029 - DNA, 312 bp, Homo sapiens
  misc_feature 1..312: note = chr5:140797327-140797639
  misc_feature 1..312: note = hyper
  source 1..312: mol_type = genomic DNA
cgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggag

SEQ ID NO: 93030 - DNA, 528 bp, Homo sapiens
  misc_feature 1..528: note = chr5:140800437-140800965
  misc_feature 1..528: note = hyper
  source 1..528: mol_type = genomic DNA
agtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccc

SEQ ID NO: 93031 - DNA, 228 bp, Homo sapiens; identical to SEQ ID NO: 487
  misc_feature 1..228: note = chr5:140801034-140801262
  misc_feature 1..228: note = hyper
  source 1..228: mol_type = genomic DNA

SEQ ID NO: 93032 - DNA, 10 bp, Homo sapiens
  misc_feature 1..10: note = chr5:140810974-140810984
  misc_feature 1..10: note = hyper
  source 1..10: mol_type = genomic DNA
gggggcgacc

SEQ ID NO: 93033 - DNA, 861 bp, Homo sapiens; identical to SEQ ID NO: 488
  misc_feature 1..861: note = chr5:140855598-140856459
  misc_feature 1..861: note = hyper
  source 1..861: mol_type = genomic DNA

SEQ ID NO: 93034 - DNA, 144 bp, Homo sapiens
  misc_feature 1..144: note = chr5:140856546-140856690
  misc_feature 1..144: note = hyper
  source 1..144: mol_type = genomic DNA
cgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattg

SEQ ID NO: 93035 - DNA, 89 bp, Homo sapiens; identical to SEQ ID NO: 29963
  misc_feature 1..89: note = chr5:140864611-140864700
  misc_feature 1..89: note = hyper
  source 1..89: mol_type = genomic DNA

SEQ ID NO: 93036 - DNA, 30 bp, Homo sapiens
  misc_feature 1..30: note = chr5:140892846-140892876
  misc_feature 1..30: note = hyper
  source 1..30: mol_type = genomic DNA
tgcagtctaagcttgcggctgtctccaggc

SEQ ID NO: 93037 - DNA, 77 bp, Homo sapiens
  misc_feature 1..77: note = chr5:141030807-141030884
  misc_feature 1..77: note = hyper
  source 1..77: mol_type = genomic DNA
gggtctgaccccttccgacttcccgtctcctaccacaagtcggatgcccccttagctccctccgttcccccagcccg

SEQ ID NO: 93038 - DNA, 30 bp, Homo sapiens
  misc_feature 1..30: note = chr5:141031100-141031130
  misc_feature 1..30: note = hyper
  source 1..30: mol_type = genomic DNA
aacctgttactgctgcgaatacgccggcag

SEQ ID NO: 93039 - DNA, 227 bp, Homo sapiens
  misc_feature 1..227: note = chr5:14108613-14108840
  misc_feature 1..227: note = hyper
  source 1..227: mol_type = genomic DNA
ggtagaaaacacacacgcacacgcgcacacacccctatctttattttccccaactcctgaacgagagttacagtttcaagatttcttttaccagggctccccaccgccgcccccaccaccatccgccaccttggtcagcagggaccataaaataagcagttgcagatcgtgcccagtagggggaggagtgcccataagtcttccactaaatccgaggcctttctgaa

SEQ ID NO: 93040 - DNA, 33 bp, Homo sapiens
  misc_feature 1..33: note = chr5:141255658-141255691
  misc_feature 1..33: note = hyper
  source 1..33: mol_type = genomic DNA
actcctcccagaggacgccgagtgtgtgtgtgt

SEQ ID NO: 93041 - DNA, 425 bp, Homo sapiens; identical to SEQ ID NO: 29965
  misc_feature 1..425: note = chr5:141262718-141263143
  misc_feature 1..425: note = hyper
  source 1..425: mol_type = genomic DNA

SEQ ID NO: 93042 - DNA, 63 bp, Homo sapiens
  misc_feature 1..63: note = chr5:141263260-141263323
  misc_feature 1..63: note = hyper
  source 1..63: mol_type = genomic DNA
cgcctggcccggatgagcttggatgcagctccgaacgtggggatccatcggtgctgagaactg

SEQ ID NO: 93043 - DNA, 345 bp, Homo sapiens
  misc_feature 1..345: note = chr5:141293717-141294062
  misc_feature 1..345: note = hyper
  source 1..345: mol_type = genomic DNA
ttaatcagaaatgaacgctgctttccccctcaaggctggagggaacgtgatgcaggcagtggagctgcgggctcggccccgggatcgtggggagagagagccccctgccgagcgcggaggggcgccctccctcccaggccccgggccaccgtctggggtcggttccctccagatttcacagccgcggcagcagcaggagcgcgcacacgcccgcgcccactgcactgcggcggtgctccgcagctcagcctcggggccatcacgtgggtgcggcctgaccccgggcgattctggggccgtctccgcaggcagttgagcctgccgctggggcgctcctctggtcag

SEQ ID NO: 93044 - DNA, 40 bp, Homo sapiens
  misc_feature 1..40: note = chr5:141302337-141302377
  misc_feature 1..40: note = hypo
  source 1..40: mol_type = genomic DNA
cttgaatgtaagctccgttatttcacggattcaaatgtgg

SEQ ID NO: 93045 - DNA, 118 bp, Homo sapiens
  misc_feature 1..118: note = chr5:14142698-14142816
  misc_feature 1..118: note = hyper
  source 1..118: mol_type = genomic DNA
agcgctggtttgacacggatcttccgcaaaggaacatttcttttggcctccccagaccccgtcatcttccccattcattctggcggagtaaggactgagaaaccgtgaacccgaggtt

SEQ ID NO: 93046 - DNA, 30 bp, Homo sapiens
  misc_feature 1..30: note = chr5:141477290-141477320
  misc_feature 1..30: note = hypo
  source 1..30: mol_type = genomic DNA
ttattttctggtcctcgtgtaatcttattt

SEQ ID NO: 93047 - DNA, 79 bp, Homo sapiens
  misc_feature 1..79: note = chr5:141703865-141703944
  misc_feature 1..79: note = hyper
  source 1..79: mol_type = genomic DNA
gaattcagtccgtcacggctccgaagagaaagaaaaaatctacgtcgagcataggccgctacggcgggctgggagatac

SEQ ID NO: 93048 - DNA, 49 bp, Homo sapiens
  misc_feature 1..49: note = chr5:141931306-141931355
  misc_feature 1..49: note = hyper
  source 1..49: mol_type = genomic DNA
aaatgtgctcattcccgaggaagcctcacttctccttctcgcccttaat

SEQ ID NO: 93049 - DNA, 79 bp, Homo sapiens; identical to SEQ ID NO: 29968
  misc_feature 1..79: note = chr5:141931424-141931503
  misc_feature 1..79: note = hyper
  source 1..79: mol_type = genomic DNA

SEQ ID NO: 93050 - DNA, 95 bp, Homo sapiens; identical to SEQ ID NO: 40602
  misc_feature 1..95: note = chr5:142070580-142070675
  misc_feature 1..95: note = hypo
  source 1..95: mol_type = genomic DNA

SEQ ID NO: 93051 - DNA, 68 bp, Homo sapiens
  misc_feature 1..68: note = chr5:1422073-1422141
  misc_feature 1..68: note = hypo
  source 1..68: mol_type = genomic DNA
gcggaggccccaggtcgtcgatgccatggctctggtggaggtgcagcacgccacgtctgcagagggga

SEQ ID NO: 93052 - DNA, 158 bp, Homo sapiens; identical to SEQ ID NO: 40603
  misc_feature 1..158: note = chr5:142625575-142625733
  misc_feature 1..158: note = hypo
  source 1..158: mol_type = genomic DNA

SEQ ID NO: 93053 - DNA, 30 bp, Homo sapiens
  misc_feature 1..30: note = chr5:142638926-142638956
  misc_feature 1..30: note = hypo
  source 1..30: mol_type = genomic DNA
tcagagattcctccacggtaagtacctgcc

SEQ ID NO: 93054 - DNA, 30 bp, Homo sapiens; identical to SEQ ID NO: 40604
  misc_feature 1..30: note = chr5:142689842-142689872
  misc_feature 1..30: note = hypo
  source 1..30: mol_type = genomic DNA

SEQ ID NO: 93055 - DNA, 30 bp, Homo sapiens
  misc_feature 1..30: note = chr5:142751146-142751176
  misc_feature 1..30: note = hypo
  source 1..30: mol_type = genomic DNA
aaaccgtgggcttggcgagaagagccttgg

SEQ ID NO: 93056 - DNA, 155 bp, Homo sapiens; identical to SEQ ID NO: 29969
  misc_feature 1..155: note = chr5:142781720-142781875
  misc_feature 1..155: note = hyper
  source 1..155: mol_type = genomic DNA

SEQ ID NO: 93057 - DNA, 540 bp, Homo sapiens
  misc_feature 1..540: note = chr5:142784675-142785215
  misc_feature 1..540: note = hyper
  source 1..540: mol_type = genomic DNA
tcgggaaggcttggacgatgccgggaccgagcctcctaccttgtgcggcacagattatgatttttgtgactctgggaaaggttgtgctgtgtgggtttagggtttggggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaa

SEQ ID NO: 93058 - DNA, 30 bp, Homo sapiens
  misc_feature 1..30: note = chr5:1429032-1429062
  misc_feature 1..30: note = hypo
  source 1..30: mol_type = genomic DNA
gtcaaatttatgacacgtcatgtttcgtac

SEQ ID NO: 93059 - DNA, 30 bp, Homo sapiens
  misc_feature 1..30: note = chr5:1429795-1429825
  misc_feature 1..30: note = hypo
  source 1..30: mol_type = genomic DNA
cagggcgttgggtaccgggaactctcaggc

SEQ ID NO: 93060 - DNA, 213 bp, Homo sapiens
  misc_feature 1..213: note = chr5:1431070-1431283
  misc_feature 1..213: note = hypo
  source 1..213: mol_type = genomic DNA
attttggcatataaacgtgaataagatgcgtctaaccaggcaagcgagccccccaaacaggagcgccctggctgacgggaaacactggatctggggagaatcgcgcaaacgtcctctcctcctctccaaaatgacggctgagtcgaagagtccgcctgtcagaacggcgacccggcacgaggccccaggcccggctggcgagggcaggaagat

SEQ ID NO: 93061 - DNA, 287 bp, Homo sapiens; identical to SEQ ID NO: 29971
  misc_feature 1..287: note = chr5:143584834-143585121
  misc_feature 1..287: note = hyper
  source 1..287: mol_type = genomic DNA

SEQ ID NO: 93062 - DNA, 88 bp, Homo sapiens
  misc_feature 1..88: note = chr5:1444675-1444763
  misc_feature 1..88: note = hyper
  source 1..88: mol_type = genomic DNA
tcacgagctatgccacgcacccggtgacaacctcaaccggcacgacccctccggtgggtaaaacacccgacgaaggggttccgcggcg

SEQ ID NO: 93063 - DNA, 405 bp, Homo sapiens; identical to SEQ ID NO: 29366
  misc_feature 1..405: note = chr5:1444851-1445256
  misc_feature 1..405: note = hyper
  source 1..405: mol_type = genomic DNA

SEQ ID NO: 93064 - DNA, 76 bp, Homo sapiens; identical to SEQ ID NO: 29367
  misc_feature 1..76: note = chr5:1445485-1445561
  misc_feature 1..76: note = hyper
  source 1..76: mol_type = genomic DNA

SEQ ID NO: 93065 - skipped

SEQ ID NO: 93066 - DNA, 192 bp, Homo sapiens; identical to SEQ ID NO: 29369
  misc_feature 1..192: note = chr5:1445568-1445760
  misc_feature 1..192: note = hyper
  source 1..192: mol_type = genomic DNA

SEQ ID NO: 93067 - DNA, 261 bp, Homo sapiens; identical to SEQ ID NO: 29370
  misc_feature 1..261: note = chr5:1445840-1446101
  misc_feature 1..261: note = hyper
  source 1..261: mol_type = genomic DNA

SEQ ID NO: 93068 - DNA, 134 bp, Homo sapiens
  misc_feature 1..134: note = chr5:1446236-1446370
  misc_feature 1..134: note = hyper
  source 1..134: mol_type = genomic DNA
cgcactcgcctaagaaaaccatttcccgggacgggcctggaaagccctggcggttggtatccggctccagggccgaatggactccgaggctttccttccgagatgcccgggcgggatttcttccattcagcgcg

SEQ ID NO: 93069 - DNA, 157 bp, Homo sapiens
  misc_feature 1..157: note = chr5:1446442-1446599
  misc_feature 1..157: note = hyper
  source 1..157: mol_type = genomic DNA
cgcgcccagctctgtgcgtcgcccctagggtcgcccgaaccccggcgttcctccccgtgtaccctcgatgctcccgtgagcaccctgccctgggcgtccaggcgagccctggggctctccagccattccagcctgcagcccgcgctcagcagtgagg

SEQ ID NO: 93070 - DNA, 56 bp, Homo sapiens
  misc_feature 1..56: note = chr5:14501805-14501861
  misc_feature 1..56: note = hypo
  source 1..56: mol_type = genomic DNA
aggtgaggaagcccacgtgaagatagggatgggcagatgctcggcctgggctggac

SEQ ID NO: 93071 - DNA, 289 bp, Homo sapiens
  misc_feature 1..289: note = chr5:145214863-145215152
  misc_feature 1..289: note = hyper
  source 1..289: mol_type = genomic DNA
agctgcccagggctccgcagaggcccggaggcgcccacactcggacagccacatgggcgtggcctttttcctccgcttttcaaactttcgaaactttattggccactcggagaaacgcgcagtcggccacgcccacgcccctactgccagagtccggggcctggggttacagagcgcgggaggcgctggagcgctcccagagcacccggggccccgcggtctccacgctggcggcgccagagcggccctggtgccctcccgcggccgcgcctgccgagaaaagcttctc

SEQ ID NO: 93072 - DNA, 21 bp, Homo sapiens
  misc_feature 1..21: note = chr5:145237564-145237585
  misc_feature 1..21: note = hypo
  source 1..21: mol_type = genomic DNA
acggaatattcctgtcgaaaa

SEQ ID NO: 93073 - DNA, 141 bp, Homo sapiens
  misc_feature 1..141: note = chr5:145316085-145316226
  misc_feature 1..141: note = hyper
  source 1..141: mol_type = genomic DNA
cagggctgggtaaggcgatcccttgaaatgagtaagactgagtggttaaagttttcaaagcggttggcagcagcggcgcttggaggaaaggaagccggttggagggcgcagcgcacccctgctgcgcggaggagggggctg

SEQ ID NO: 93074 - DNA, 270 bp, Homo sapiens
  misc_feature 1..270: note = chr5:145713626-145713896
  misc_feature 1..270: note = hyper
  source 1..270: mol_type = genomic DNA
ggagggctcctggcacgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 93075 - DNA, 317 bp, Homo sapiens
  misc_feature 1..317: note = chr5:145716880-145717197
  misc_feature 1..317: note = hyper
  source 1..317: mol_type = genomic DNA
attccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 93076 - DNA, 189 bp, Homo sapiens
  misc_feature 1..189: note = chr5:145717248-145717437
  misc_feature 1..189: note = hyper
  source 1..189: mol_type = genomic DNA
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaag

SEQ ID NO: 93077 - DNA, 265 bp, Homo sapiens; identical to SEQ ID NO: 29977
  misc_feature 1..265: note = chr5:145717780-145718045
  misc_feature 1..265: note = hyper
  source 1..265: mol_type = genomic DNA

SEQ ID NO: 93078 - DNA, 70 bp, Homo sapiens
  misc_feature 1..70: note = chr5:145718431-145718501
  misc_feature 1..70: note = hyper
  source 1..70: mol_type = genomic DNA
tctctcctcacctcccgggccgcccctgcgagtccccggcgcgtgagcacgcctgcgcgcgcccgggccc

SEQ ID NO: 93079 - DNA, 952 bp, Homo sapiens
  misc_feature 1..952: note = chr5:145718802-145719754
  misc_feature 1..952: note = hyper
  source 1..952: mol_type = genomic DNA
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggc

SEQ ID NO: 93080 - DNA, 103 bp, Homo sapiens
  misc_feature 1..103: note = chr5:145719834-145719937
  misc_feature 1..103: note = hyper
  source 1..103: mol_type = genomic DNA
cggcgccggagaagcgttcactcgaggcctatttcgctatccagccacgtccttcatctgagaagatcgcggccatcgctgagaaactggaccttaaaaagaa

SEQ ID NO: 93081 - DNA, 346 bp, Homo sapiens
  misc_feature 1..346: note = chr5:145720018-145720364
  misc_feature 1..346: note = hyper
  source 1..346: mol_type = genomic DNA
cgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaa

SEQ ID NO: 93082 - DNA, 30 bp, Homo sapiens; identical to SEQ ID NO: 29983
  misc_feature 1..30: note = chr5:145720837-145720867
  misc_feature 1..30: note = hyper
  source 1..30: mol_type = genomic DNA

SEQ ID NO: 93083 - DNA, 351 bp, Homo sapiens
  misc_feature 1..351: note = chr5:145722116-145722467
  misc_feature 1..351: note = hyper
  source 1..351: mol_type = genomic DNA
cacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaac

SEQ ID NO: 93084 - DNA, 467 bp, Homo sapiens; identical to SEQ ID NO: 491
  misc_feature 1..467: note = chr5:145722560-145723027
  misc_feature 1..467: note = hyper
  source 1..467: mol_type = genomic DNA

SEQ ID NO: 93085 - DNA, 169 bp, Homo sapiens; identical to SEQ ID NO: 29986
  misc_feature 1..169: note = chr5:145723301-145723470
  misc_feature 1..169: note = hyper
  source 1..169: mol_type = genomic DNA

SEQ ID NO: 93086 - DNA, 518 bp, Homo sapiens
  misc_feature 1..518: note = chr5:145724320-145724838
  misc_feature 1..518: note = hyper
  source 1..518: mol_type = genomic DNA
aagcttaaaagaaaccgctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaaggagaagcaagggtcttggactcctcctccttcccagcgaacatcccttccccgccctgttcccactttttggccccggcgccagaatgtttgagccgaaggggcagaacgcctaaaagccgtgtttgtttatttatttatttatttatttatttttattttttaaatcgaagaaggcagtgaggcctagagagcaggacggacttagctggctccttttacctaaaacagctcttctccaatcacgttatcacaccgcccgttttatttctttc

SEQ ID NO: 93087 - DNA, 15 bp, Homo sapiens
  misc_feature 1..15: note = chr5:145725173-145725188
  misc_feature 1..15: note = hyper
  source 1..15: mol_type = genomic DNA
tgcctttgcttcttc

SEQ ID NO: 93088 - DNA, 277 bp, Homo sapiens
  misc_feature 1..277: note = chr5:145725693-145725970
  misc_feature 1..277: note = hyper
  source 1..277: mol_type = genomic DNA
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctctctttt

SEQ ID NO: 93089 - DNA, 557 bp, Homo sapiens
  misc_feature 1..557: note = chr5:146256927-146257484
  misc_feature 1..557: note = hyper
  source 1..557: mol_type = genomic DNA
ttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactac

SEQ ID NO: 93090 - DNA, 997 bp, Homo sapiens
  misc_feature 1..997: note = chr5:146257485-146258482
  misc_feature 1..997: note = hyper
  source 1..997: mol_type = genomic DNA
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagc

SEQ ID NO: 93091 - DNA, 375 bp, Homo sapiens
  misc_feature 1..375: note = chr5:146614106-146614481
  misc_feature 1..375: note = hyper
  source 1..375: mol_type = genomic DNA
tccccctcaaccccccggcttttaggatccacatcgcaggggggtgaggcacccccggcgatatggagagtaatagcaccccccttctcccccccccccccccccggctattacgatccacatcgcagggggggtgaggcagttcccgtgatatggggcgtaatagtacccgctgtgcgtcctggtggctccggacccggcccaagcgcggcgggacctccatccgtagccctctcccccaacgtcgccctcccggggtccttgtctagtctcagcaggcggcaaacggaccccaggcgtctggcgctcacccaggagactgcccagcggtttctggagagagcgctaagcggagacgcccgctggcaagcagat

SEQ ID NO: 93092 - DNA, 65 bp, Homo sapiens
  misc_feature 1..65: note = chr5:146614703-146614768
  misc_feature 1..65: note = hyper
  source 1..65: mol_type = genomic DNA
cctggatgaaagcatcgctccgagcctcatgggaggaatgaaggaagaatcgagactaggtgagt

SEQ ID NO: 93093 - DNA, 36 bp, Homo sapiens; identical to SEQ ID NO: 29996
  misc_feature 1..36: note = chr5:146832654-146832690
  misc_feature 1..36: note = hyper
  source 1..36: mol_type = genomic DNA

SEQ ID NO: 93094 - DNA, 158 bp, Homo sapiens
  misc_feature 1..158: note = chr5:146833012-146833170
  misc_feature 1..158: note = hyper
  source 1..158: mol_type = genomic DNA
ccaggccagagaagccggcgggatccgagccgaccccgcccgcagcgcagcggacagggagcgagcgaggagggagggagcagcggcgcccggactcaccgtgatccgcgggatgttcttcttgccttggtaggacatggtggcggtggtggctgcag

SEQ ID NO: 93095 - DNA, 106 bp, Homo sapiens
  misc_feature 1..106: note = chr5:146833649-146833755
  misc_feature 1..106: note = hyper
  source 1..106: mol_type = genomic DNA
tgggagcatcagctacgccctcccggccgcggggccgagttgcgggcgccgccgcccccagccagctcctcgtcggatctcctaccttccccgccctagtttcaga

SEQ ID NO: 93096 - DNA, 372 bp, Homo sapiens
  misc_feature 1..372: note = chr5:146888811-146889183
  misc_feature 1..372: note = hyper
  source 1..372: mol_type = genomic DNA
cccgggcatcccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 93097 - DNA, 207 bp, Homo sapiens; identical to SEQ ID NO: 8108
  misc_feature 1..207: note = chr5:146889331-146889538
  misc_feature 1..207: note = hyper
  source 1..207: mol_type = genomic DNA

SEQ ID NO: 93098 - DNA, 303 bp, Homo sapiens
  misc_feature 1..303: note = chr5:146889539-146889842
  misc_feature 1..303: note = hyper
  source 1..303: mol_type = genomic DNA
ccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcctcacacactttcgcgcaatttagacgtc

SEQ ID NO: 93099 - DNA, 30 bp, Homo sapiens
  misc_feature 1..30: note = chr5:14726922-14726952
  misc_feature 1..30: note = hypo
  source 1..30: mol_type = genomic DNA
cccatttctggggaacggtgcttaaggtgt

SEQ ID NO: 93100 - DNA, 108 bp, Homo sapiens
  misc_feature 1..108: note = chr5:14731965-14732073
  misc_feature 1..108: note = hypo
  source 1..108: mol_type = genomic DNA
tttcagcaatgcatacggccacagctgtgtgggacagggcaacgtggggagagacgagacacacgggaggcccagggagctgcgcgagtgtcacgtgaacaggggtca

SEQ ID NO: 93101 - DNA, 30 bp, Homo sapiens
  misc_feature 1..30: note = chr5:14740939-14740969
  misc_feature 1..30: note = hypo
  source 1..30: mol_type = genomic DNA
caccttcacggcctccggtcctctttatta

SEQ ID NO: 93102 - DNA, 32 bp, Homo sapiens
  misc_feature 1..32: note = chr5:14741558-14741590
  misc_feature 1..32: note = hypo
  source 1..32: mol_type = genomic DNA
ggaacactgaagtaacgcggattaaatttgga

SEQ ID NO: 93103 - DNA, 235 bp, Homo sapiens
  misc_feature 1..235: note = chr5:14756250-14756485
  misc_feature 1..235: note = hypo
  source 1..235: mol_type = genomic DNA
gagtgaaggactgcacgcaggtatttatttagtaccaattgtatgtagactagtgcgctattaggtttgtatgcctggcaggaaagctgaaggaataccaagaatggaagaaacacaatctctgtctctcaagcgtctcagtcccaaagtagcatccttcccacgtgatgcagatcataatgagggctctcatttgggtctgagttattacagtcattaccggtgctcactgact

SEQ ID NO: 93104 - DNA, 83 bp, Homo sapiens; identical to SEQ ID NO: 40505
  misc_feature 1..83: note = chr5:14764724-14764807
  misc_feature 1..83: note = hypo
  source 1..83: mol_type = genomic DNA

SEQ ID NO: 93105 - DNA, 33 bp, Homo sapiens
  misc_feature 1..33: note = chr5:14774559-14774592
  misc_feature 1..33: note = hypo
  source 1..33: mol_type = genomic DNA
tcctcaagacacagtcgcgctctgtcgcccagt

SEQ ID NO: 93106 - DNA, 32 bp, Homo sapiens
  misc_feature 1..32: note = chr5:14774712-14774744
  misc_feature 1..32: note = hypo
  source 1..32: mol_type = genomic DNA
atcattaagttactatacgtccttcagtcacc

SEQ ID NO: 93107 - DNA, 71 bp, Homo sapiens
  misc_feature 1..71: note = chr5:148033722-148033793
  misc_feature 1..71: note = hyper
  source 1..71: mol_type = genomic DNA
cccagccgctgcctgcgccctccctgccgccccctcgggtgcgggctccagcccccgcgctggggagccgg

SEQ ID NO: 93108 - DNA, 234 bp, Homo sapiens
  misc_feature 1..234: note = chr5:148033820-148034054
  misc_feature 1..234: note = hyper
  source 1..234: mol_type = genomic DNA
cgggcgcaggaccccagccccggatcacctgggctcgccgcgcatcgtccttctccccaaccgagccggactccacgggctcaacagcccccagccccggtggtccccgctgccctgcccgctgccgcccccactgggcgccagggacagcgggggtgccgctctgccggcagggcgcacaggggagtgggcacagaggcgggctggagcgatctcacccgttccgggctggcc

SEQ ID NO: 93109 - DNA, 49 bp, Homo sapiens
  misc_feature 1..49: note = chr5:148205651-148205700
  misc_feature 1..49: note = hyper
  source 1..49: mol_type = genomic DNA
gcttctgtgtgagagcgcgcgcgagtgtgcatgtcggtgagctgggagg

SEQ ID NO: 93110 - DNA, 247 bp, Homo sapiens
  misc_feature 1..247: note = chr5:148206185-148206432
  misc_feature 1..247: note = hyper
  source 1..247: mol_type = genomic DNA
ggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggc

SEQ ID NO: 93111 - DNA, 272 bp, Homo sapiens; identical to SEQ ID NO: 30002
  misc_feature 1..272: note = chr5:148521059-148521331
  misc_feature 1..272: note = hyper
  source 1..272: mol_type = genomic DNA

SEQ ID NO: 93112 - DNA, 964 bp, Homo sapiens
  misc_feature 1..964: note = chr5:148651223-148652187
  misc_feature 1..964: note = hyper
  source 1..964: mol_type = genomic DNA
aagcccaagtgggagcgccgcggagggcgagcgagcggcagggcgcggcggggcgtgtgcggcaccacgggacagcgggctgcggcccagggggcgaggcgtgctcgggtctattccgggagcggctctgaggggcgggcgcgggcgcgggcggggcgggggctgccggcgagcatcctgtctgggggaggggaccgcagagagcgccggccgctgggctggcctgagagcgcagcgcgccggccgctaccagccgcgccggagcccctgcgccctgcggcccgctccccggggaccgggccggcgccatggaccgaggccagggtaagaggggccgcgacgcccgcacttgttgcggcgccgggcgggaaagggagactggacgatctgaagccggagaggaggagggagagaggcgggcggtggggcgggggctgaggaacgctcggaggggactgggagacgcggcgcttatgcaaaggtgccttcggctgccgggacaacccggtgcgtgtcaacgcccgtgtcctggggccaactcgcctctcgtgtgtgaaatcagagttttcataggctaacgatttgtaacttcataaaagatccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggactagatggtctccaaggcaccttgccgacccttttccagtgtatttggtagacgtttcacagaagtg

SEQ ID NO: 93113 - DNA, 33 bp, Homo sapiens
  misc_feature 1..33: note = chr5:14886060-14886093
  misc_feature 1..33: note = hypo
  source 1..33: mol_type = genomic DNA
ggcatgagccaccgcacccggccattttcctca

SEQ ID NO: 93114 - DNA, 18 bp, Homo sapiens
  misc_feature 1..18: note = chr5:148872640-148872658
  misc_feature 1..18: note = hypo
  source 1..18: mol_type = genomic DNA
ttgttgttgttgagacgg

SEQ ID NO: 93115 - DNA, 25 bp, Homo sapiens
  misc_feature 1..25: note = chr5:148928401-148928426
  misc_feature 1..25: note = hypo
  source 1..25: mol_type = genomic DNA
gcgaaaactccgtcttaaagaagag

SEQ ID NO: 93116 - DNA, 34 bp, Homo sapiens
  misc_feature 1..34: note = chr5:14895452-14895486
  misc_feature 1..34: note = hypo
  source 1..34: mol_type = genomic DNA
ctggatcacaagaatgaaacgccacctcaaaaaa

SEQ ID NO: 93117 - DNA, 63 bp, Homo sapiens
  misc_feature 1..63: note = chr5:149005075-149005138
  misc_feature 1..63: note = hypo
  source 1..63: mol_type = genomic DNA
acctggcccaagtgccgcgaacatgggagaccttcacagcctgatatccgccacaaggctgca

SEQ ID NO: 93118 - DNA, 149 bp, Homo sapiens; identical to SEQ ID NO: 40606
  misc_feature 1..149: note = chr5:149014648-149014797
  misc_feature 1..149: note = hypo
  source 1..149: mol_type = genomic DNA

SEQ ID NO: 93119 - DNA, 240 bp, Homo sapiens
  misc_feature 1..240: note = chr5:149311635-149311875
  misc_feature 1..240: note = hypo
  source 1..240: mol_type = genomic DNA
atttctcttttagcacgttctttgttctcctcgtccggaagttgtagacgtctatttagtttgattatctgtcgtcttagtgaagctgcatctacaacagtcaggtcatctgatgttccttcaattgttgtatctgtatttgaaatgccataaagagaatcatttctgaccagctgtccattttggcgaacagcagtttcactcgtagaccgctctctttttagtcggccaactgcacgg

SEQ ID NO: 93120 - DNA, 30 bp, Homo sapiens
  misc_feature 1..30: note = chr5:149546573-149546603
  misc_feature 1..30: note = hyper
  source 1..30: mol_type = genomic DNA
ctccagctactctcacgtggagccggcccc

SEQ ID NO: 93121 - skipped

SEQ ID NO: 93122 - DNA, 154 bp, Homo sapiens
  misc_feature 1..154: note = chr5:149547723-149547877
  misc_feature 1..154: note = hypo
  source 1..154: mol_type = genomic DNA
tgtccggactgtgtccggcctgtcctgacaaaggccacctagccttgggggcgggaagctggcctgcccaccctttgatgtccagcccctcctccccttaccccagctgcgaataatcctgggacttctcccacctcctcgcactcttcacccc

SEQ ID NO: 93123 - DNA, 401 bp, Homo sapiens
  misc_feature 1..401: note = chr5:149569485-149569886
  misc_feature 1..401: note = hyper
  source 1..401: mol_type = genomic DNA
ccagagagggcaggtcgcttgcccaaggtcacgcagaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctc

SEQ ID NO: 93124 - DNA, 30 bp, Homo sapiens; identical to SEQ ID NO: 40607
  misc_feature 1..30: note = chr5:149624264-149624294
  misc_feature 1..30: note = hypo
  source 1..30: mol_type = genomic DNA

SEQ ID NO: 93125 - DNA, 145 bp, Homo sapiens
  misc_feature 1..145: note = chr5:14967329-14967474
  misc_feature 1..145: note = hypo
  source 1..145: mol_type = genomic DNA
agtttgccttcatttcgtcacctttcagaggcttgttatgtttgttttatgcataacatctggggttttcaggtgtactttaacttcatttgtttagataaaaggcagtcgtgctttcctaggaatgttccggaaaagctgcata

SEQ ID NO: 93126 - DNA, 34 bp, Homo sapiens
  misc_feature 1..34: note = chr5:149681755-149681789
  misc_feature 1..34: note = hyper
  source 1..34: mol_type = genomic DNA
cgtggtagccttggtcgtccgtgaggatgaagat

SEQ ID NO: 93127 - DNA, 682 bp, Homo sapiens
  misc_feature 1..682: note = chr5:149682009-149682691
  misc_feature 1..682: note = hyper
  source 1..682: mol_type = genomic DNA
accggcccgccggctcggatgctgcgagggagttcagcgccccccggggacggtccagtgtctggtccgggactggctgccggacggctgggccggatctgctcggccgcagcggggcgctctggggaggtcaggcccgcgccgagctgcctcccgctgcctaagcgcaggccctgcgccgcctttgctccctcttccccagctcagcccggccagcctgagacgcggcgtggcagcttccaaaaagtgctctctaccatcctctgactcccctcttccttcttgccctggatttctcccgcctcctaatttctctctcctctgctttcccggcctctcgccccacccggagtccttaaaacagcccagctccctgcagggaggtgggcaggaccccagaggggaaggggagggaggcacaagttgggcgggtcgaggggacacggcgggagagaattcgaaaaagttgtaacatctgccgggccgggccgagccccaggtggaggggcgggacgcagagcagcggctccacctcccgggcgggaagccccggccctctcggcctgctggctccagcgcccgcccctgaccgggatggggaaaggagggagtggggctgcttggaattcgatggaacagctccagaatggctgggtcagacattcctcgatcatggagtctt

SEQ ID NO: 93128 - DNA, 211 bp, Homo sapiens
  misc_feature 1..211: note = chr5:149810703-149810914
  misc_feature 1..211: note = hypo
  source 1..211: mol_type = genomic DNA
gaccagtcagacaagcgcagaggaaagcccggtggacttgggcacgtgaggtcgccggcgaagctgacaagagcaggcttgtgaactgcttgaggatgggtggagcagcactgggagcagcggcaggaggtgaggcagtggctggacaagatgcagccccgggtgcgagcatgcttgtccgcagagggagtgactccgtggggagggagag

SEQ ID NO: 93129 - DNA, 734 bp, Homo sapiens; identical to SEQ ID NO: 30008
  misc_feature 1..734: note = chr5:150051058-150051792
  misc_feature 1..734: note = hyper
  source 1..734: mol_type = genomic DNA

SEQ ID NO: 93130 - DNA, 76 bp, Homo sapiens
  misc_feature 1..76: note = chr5:150052035-150052111
  misc_feature 1..76: note = hyper
  source 1..76: mol_type = genomic DNA
agccccaacgactaccgaaatttcaacaagtaaggcggggcgggcagcccgggggacagaccgggaggggcgggaa

SEQ ID NO: 93131 - DNA, 217 bp, Homo sapiens
  misc_feature 1..217: note = chr5:150158234-150158451
  misc_feature 1..217: note = hyper
  source 1..217: mol_type = genomic DNA
cgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgcca

SEQ ID NO: 93132 - DNA, 696 bp, Homo sapiens
  misc_feature 1..696: note = chr5:150399922-150400618
  misc_feature 1..696: note = hyper
  source 1..696: mol_type = genomic DNA
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaatccccaggtgcgagagacctcctgaaccccttttgccgccccctccgccgccgggaccccgcccccgaccgtcgtcgtctcgtagttccatctgttggagagccgagacctggtgcttcaggcgggcagaatgactaagggaggaaggtctctctccccgagctcgcactttctccccactgccacctcgagggtcgccttgctacatct

SEQ ID NO: 93133 - DNA, 104 bp, Homo sapiens
  misc_feature 1..104: note = chr5:150537549-150537653
  misc_feature 1..104: note = hyper
  source 1..104: mol_type = genomic DNA
ctttggccaaggtcacgcggcccttcagggctagaagtcagggctcctgactccgggttctggacactttcccgcaaattcttataagtcgccaaagctttgtt

SEQ ID NO: 93134 - DNA, 30 bp, Homo sapiens
  misc_feature 1..30: note = chr5:150577129-150577159
  misc_feature 1..30: note = hypo
  source 1..30: mol_type = genomic DNA
aaaaaagtgcctgctcggtgggtgggagtt

SEQ ID NO: 93135 - DNA, 30 bp, Homo sapiens
  misc_feature 1..30: note = chr5:150829685-150829715
  misc_feature 1..30: note = hypo
  source 1..30: mol_type = genomic DNA
tgggatggatggagccgatgtccacttact

SEQ ID NO: 93136 - DNA, 60 bp, Homo sapiens
  misc_feature 1..60: note = chr5:150901687-150901747
  misc_feature 1..60: note = hypo
  source 1..60: mol_type = genomic DNA
cagtgctcttgcgcccgactgaggctgggcctccttgtggagctacgtttctctgcccca

SEQ ID NO: 93137 - DNA, 177 bp, Homo sapiens
  misc_feature 1..177: note = chr5:150911205-150911382
  misc_feature 1..177: note = hypo
  source 1..177: mol_type = genomic DNA
ggtcttctctgcgcccgggcgagtgagggtggccagctgcagcacctccgtgccaggtggggcgtcctcgggcacctgcacgctgtgctcggtgttcaggaacacgggcaggtagtcttctaggcccaccaccgagactgtgacggtgcccagcgtggacagcggtattggggtgcc

SEQ ID NO: 93138 - DNA, 248 bp, Homo sapiens
  misc_feature 1..248: note = chr5:151066252-151066500
  misc_feature 1..248: note = hyper
  source 1..248: mol_type = genomic DNA
acaggcagacaggaccgagggccatgctcttaaggggagccgtgatggagccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggcaggcggcaggcagagcgcgctctccgggcagtctgaaggaccgcgggaatgtggaggg

SEQ ID NO: 93139 - DNA, 118 bp, Homo sapiens
  misc_feature 1..118: note = chr5:151150563-151150681
  misc_feature 1..118: note = hyper
  source 1..118: mol_type = genomic DNA
cactccactggagcacgcgcggaccaccgtgcctcagctgccacaaagggagcctcgccacacgcccgcggccgcctcgcagcgcccgccaagaagcgcctggcggaagggcgcactc

SEQ ID NO: 93140 - DNA, 28 bp, Homo sapiens
  misc_feature 1..28: note = chr5:151251400-151251428
  misc_feature 1..28: note = hypo
  source 1..28: mol_type = genomic DNA
aggcgtgaaccaccgcgcccggccgtga

SEQ ID NO: 93141 - DNA, 428 bp, Homo sapiens
  misc_feature 1..428: note = chr5:151304211-151304639
  misc_feature 1..428: note = hyper
  source 1..428: mol_type = genomic DNA
gatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 93142 - DNA, 45 bp, Homo sapiens
  misc_feature 1..45: note = chr5:151304708-151304753
  misc_feature 1..45: note = hyper
  source 1..45: mol_type = genomic DNA
cgttctcctgcctctgtgcgggtctgctgtcgccttgctattcct

SEQ ID NO: 93143 - DNA, 42 bp, Homo sapiens
  misc_feature 1..42: note = chr5:151383718-151383760
  misc_feature 1..42: note = hypo
  source 1..42: mol_type = genomic DNA
caatgctgagacagacgcgcaagtcctcgggaggagacgcat

SEQ ID NO: 93144 - DNA, 130 bp, Homo sapiens
  misc_feature 1..130: note = chr5:151784174-151784304
  misc_feature 1..130: note = hypo
  source 1..130: mol_type = genomic DNA
aggatcctgagggcccggcgccgggtgctctgcagtttggcgcggaacgggtgtaggatggccacgtagcgctccacgctgacggtggtgatgctgaggatggaggcgaagcacacggtctcaaagaggg

SEQ ID NO: 93145 - DNA, 30 bp, Homo sapiens
  misc_feature 1..30: note = chr5:152760944-152760974
  misc_feature 1..30: note = hypo
  source 1..30: mol_type = genomic DNA
atatctgaagatggccgaacaggaacagct

SEQ ID NO: 93146 - DNA, 214 bp, Homo sapiens
  misc_feature 1..214: note = chr5:152870105-152870319
  misc_feature 1..214: note = hyper
  source 1..214: mol_type = genomic DNA
gtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagc

SEQ ID NO: 93147 - DNA, 28 bp, Homo sapiens
  misc_feature 1..28: note = chr5:15292060-15292088
  misc_feature 1..28: note = hypo
  source 1..28: mol_type = genomic DNA
aaataggaaaagctccggtttacagctc

SEQ ID NO: 93148 - DNA, 33 bp, Homo sapiens
  misc_feature 1..33: note = chr5:152979673-152979706
  misc_feature 1..33: note = hypo
  source 1..33: mol_type = genomic DNA
cggcgcggtggctcacgcttgtaatcccagcac

SEQ ID NO: 93149 - DNA, 21 bp, Homo sapiens
  misc_feature 1..21: note = chr5:153118296-153118317
  misc_feature 1..21: note = hypo
  source 1..21: mol_type = genomic DNA
ttggagaaggcatttcgctct

SEQ ID NO: 93150 - DNA, 188 bp, Homo sapiens
  misc_feature 1..188: note = chr5:153131278-153131466
  misc_feature 1..188: note = hypo
  source 1..188: mol_type = genomic DNA
acaagaaatgcctatcggaaacccagagaatggtcccatcagatccttactatcttccgttagcatcaagttatgccctaaacgatacatacactattttgttaacaaaaggaaaaaagatcctttgcaaaaagagacagcctgcttccagcaccttactcccagaccatgtccgaattcatttaccc

SEQ ID NO: 93151 - DNA, 160 bp, Homo sapiens
  misc_feature 1..160: note = chr5:153558736-153558896
  misc_feature 1..160: note = hypo
  source 1..160: mol_type = genomic DNA
tggggccagaaacagcgtgtgatgtccagccctagccctgaagggtgaggaaaggggcagttattggaatctagaaagggaggactgtttcaagaagcctgcgcgatgggagccatggacttttgtggaggacacagacagcctgcggcaaagttgcagc

SEQ ID NO: 93152 - DNA, 47 bp, Homo sapiens
  misc_feature 1..47: note = chr5:153569225-153569272
  misc_feature 1..47: note = hyper
  source 1..47: mol_type = genomic DNA
ggctccacggccctccgcatcgcccagaagcccgactcctctgtcaa

SEQ ID NO: 93153 - DNA, 93 bp, Homo sapiens
  misc_feature 1..93: note = chr5:153785959-153786052
  misc_feature 1..93: note = hypo
  source 1..93: mol_type = genomic DNA
gattatgtgtgggttcgcagaaccacagagatgcctgaatcaggtgcggccttttattatggtgactaacaaccctcaattacttgcagacca

SEQ ID NO: 93154 - DNA, 896 bp, Homo sapiens
  misc_feature 1..896: note = chr5:153852408-153853304
  misc_feature 1..896: note = hyper
  source 1..896: mol_type = genomic DNA
gccgttctctgtgctcggcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 93155 - DNA, 133 bp, Homo sapiens; identical to SEQ ID NO: 2667
  misc_feature 1..133: note = chr5:153853386-153853519
  misc_feature 1..133: note = hyper
  source 1..133: mol_type = genomic DNA

SEQ ID NO: 93156 - DNA, 30 bp, Homo sapiens
  misc_feature 1..30: note = chr5:153854871-153854901
  misc_feature 1..30: note = hyper
  source 1..30: mol_type = genomic DNA
cctttcatcttcctgcgtctggttctcttt

SEQ ID NO: 93157 - DNA, 236 bp, Homo sapiens
  misc_feature 1..236: note = chr5:153855175-153855411
  misc_feature 1..236: note = hyper
  source 1..236: mol_type = genomic DNA
tcaaaggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 93158 - DNA, 270 bp, Homo sapiens; identical to SEQ ID NO: 30018
  misc_feature 1..270: note = chr5:153855657-153855927
  misc_feature 1..270: note = hyper
  source 1..270: mol_type = genomic DNA

SEQ ID NO: 93159 - DNA, 1050 bp, Homo sapiens
  misc_feature 1..1050: note = chr5:153856148-153857198
  misc_feature 1..1050: note = hyper
  source 1..1050: mol_type = genomic DNA
cgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattcaaactcaaagtaaagaactttaacacatattcttaacctggcttccaggagagcccaggaatgaatcaggacttctccaaattggaagcaaaacctgtggtgtgtgcatttttggagggtccgaggctccaaacagattattcactcagtattacaaacactctcccgtattacaaatgaattctatgacgaatctgcctccctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 93160 - DNA, 597 bp, Homo sapiens; identical to SEQ ID NO: 30021
  misc_feature 1..597: note = chr5:153857284-153857881
  misc_feature 1..597: note = hyper
  source 1..597: mol_type = genomic DNA

SEQ ID NO: 93161 - DNA, 776 bp, Homo sapiens
  misc_feature 1..776: note = chr5:153858119-153858895
  misc_feature 1..776: note = hyper
  source 1..776: mol_type = genomic DNA
tccagaatcaccaagcgaaaagaaggcctacacctagagcccgccttttgattttacagacaaggaaactgaggcccagggaaagaaaggttcttgtttctagactgtctagaagtctaaataggaattccagcagttcccagtcccgagctccaactgctctgctcggcgtcagagctagaagatgagagggcgctgctgaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 93162 - DNA, 892 bp, Homo sapiens
  misc_feature 1..892: note = chr5:153858916-153859808
  misc_feature 1..892: note = hyper
  source 1..892: mol_type = genomic DNA
cgacgtccggcatctctcacgcatcagcgcagaggcgcgactcggctgcacgaccctccgagatttcaccccgggggtagggccattccctgccagccggactctctccactgtgggctttccccaggctcgcgttggaatctgggaatcccggagtggtgacgcttcaagctggggactctcggtcttacctcccgctgtggttcctttcttggccgatgtccacctacctgggtccctcattctctcaacctttctcagctcaacgccccctccctcggtgtggtagagggagtgtgcctctcttcaaagcaaagtcgaggggagggggaaaggagaagttaatgtgagtgctctttttagaaggcaaatcattcacccattcattcaacaattatttattgatgcctactatgtgcctatcatagttactagtccaaagacagagggagaaaggcccattctctccttgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcggggagggagcgctgggggcccgctgctgcggcggctctgcggggtcccaagcctccctggcctggaggcattctagaaagagcgcaggtagagagta

SEQ ID NO: 93163 - DNA, 143 bp, Homo sapiens; identical to SEQ ID NO: 8132
  misc_feature 1..143: note = chr5:153862037-153862180
  misc_feature 1..143: note = hyper
  source 1..143: mol_type = genomic DNA

SEQ ID NO: 93164 - DNA, 359 bp, Homo sapiens
  misc_feature 1..359: note = chr5:153862218-153862577
  misc_feature 1..359: note = hyper
  source 1..359: mol_type = genomic DNA
cgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaacatttctctgccatgtctgaagaggacctaggactttccaatctggcccagcctgctcccagggatgggggacagtcggggcagggaagagataggcacggagtagattgctc

SEQ ID NO: 93165 - DNA, 44 bp, Homo sapiens; identical to SEQ ID NO: 30027
  misc_feature 1..44: note = chr5:153863373-153863417
  misc_feature 1..44: note = hyper
  source 1..44: mol_type = genomic DNA

SEQ ID NO: 93166 - DNA, 232 bp, Homo sapiens
  misc_feature 1..232: note = chr5:153863418-153863650
  misc_feature 1..232: note = hyper
  source 1..232: mol_type = genomic DNA
ttcaacctaaacagaacccggtctgattggaaaatgtatttatttgaaaaatcgtaactcacggttttggtgaaaacggcccccaaatttatgggatcgcttggggcgcagcgattgtaaatcaaaaggcactggacacctccctcccccatccccgaagcagctcggtcaggttctccagaacaccaggagtcctgtctcctcccggtccaccctgcggccctccgagacc

SEQ ID NO: 93167 - DNA, 30 bp, Homo sapiens; identical to SEQ ID NO: 30029
  misc_feature 1..30: note = chr5:153863972-153864002
  misc_feature 1..30: note = hyper
  source 1..30: mol_type = genomic DNA

SEQ ID NO: 93168 - DNA, 30 bp, Homo sapiens
  misc_feature 1..30: note = chr5:153900800-153900830
  misc_feature 1..30: note = hyper
  source 1..30: mol_type = genomic DNA
ctccctccagagcagcgcccagcattcaat

SEQ ID NO: 93169 - DNA, 530 bp, Homo sapiens
  misc_feature 1..530: note = chr5:153990744-153991274
  misc_feature 1..530: note = hyper
  source 1..530: mol_type = genomic DNA
caagcacctggcacacgactatgtgttaaataaataaaataaataaatactgtttaaaaatgaaaatgaaatgtattaaattaataaaatagaacatttctagcgacacacacaggcacgccaatctcagtcacactcgccccaggcacagacactgtcactatgatttgccatccccgcctccccacgctggagagcagcgccctcacagaagggccgagccgcggacgggccacacacccgcgtgtacacacagtccgagaacgcacacacgtacacacacacatgcgcaaggcacggcctggccttcaggcacagagagcccatccggtttcccactcagctcccacaacttcccccacactttggtactaagggctcagctgggtccttttgaagccaccaagggagggagttgggaagggccccagtgacaaacagtggggagcaagaattttacgaacttaagggctgtaaatttcggccagcaaatccccgcccctgtccgtccgccccgccttccttctcac

SEQ ID NO: 93170 - DNA, 78 bp, Homo sapiens
  misc_feature 1..78: note = chr5:154071660-154071738
  misc_feature 1..78: note = hypo
  source 1..78: mol_type = genomic DNA
cctttcgaaggaaaccttcgctggctccctagtgccctggaataacactgaaaccccttagaacggtggagaaggcct

SEQ ID NO: 93171 - DNA, 254 bp, Homo sapiens; identical to SEQ ID NO: 40613
  misc_feature 1..254: note = chr5:154209733-154209987
  misc_feature 1..254: note = hypo
  source 1..254: mol_type = genomic DNA

SEQ ID NO: 93172 - DNA, 101 bp, Homo sapiens
  misc_feature 1..101: note = chr5:154318077-154318178
  misc_feature 1..101: note = hypo
  source 1..101: mol_type = genomic DNA
cactatcccgtccaacgttttttgagcgctatgtgccagggcactttgctagttgtggaggtgttttaaagatatgcacaagaggccgggtgcggtggctc

SEQ ID NO: 93173 - DNA, 16 bp, Homo sapiens
  misc_feature 1..16: note = chr5:154376080-154376096
  misc_feature 1..16: note = hypo
  source 1..16: mol_type = genomic DNA
agaattaagactgggc

SEQ ID NO: 93174 - DNA, 30 bp, Homo sapiens
  misc_feature 1..30: note = chr5:154393651-154393681
  misc_feature 1..30: note = hypo
  source 1..30: mol_type = genomic DNA
aaggatataatgcaacggtcctggcctatg

SEQ ID NO: 93175 - DNA, 33 bp, Homo sapiens
  misc_feature 1..33: note = chr5:154398961-154398994
  misc_feature 1..33: note = hypo
  source 1..33: mol_type = genomic DNA
agctggttgtcccctcgtcgtctctctgccctc

SEQ ID NO: 93176 - DNA, 180 bp, Homo sapiens
  misc_feature 1..180: note = chr5:1549177-1549357
  misc_feature 1..180: note = hypo
  source 1..180: mol_type = genomic DNA
tgccctggagtcttccgcagccacggttgccttgagcaggcagaaaggagaaatatctgaaaatgggactccttgtgcaggaacccacatttgcaaatgggacaggtccaccccagaaggttgctgagcaagcttacatgtctgggactggcctgtcctgctgtccgaggggtccttttt

SEQ ID NO: 93177 - DNA, 109 bp, Homo sapiens
  misc_feature 1..109: note = chr5:15499838-15499947
  misc_feature 1..109: note = hyper
  source 1..109: mol_type = genomic DNA
ctgtcttccattttccgccccagtctccaaacagggaagtcacaggagaatgccaacgcatacacctgaaaggtgtcagaattagacacggatgcgtgtttattttaaa

SEQ ID NO: 93178 - DNA, 119 bp, Homo sapiens; identical to SEQ ID NO: 29484
  misc_feature 1..119: note = chr5:15500570-15500689
  misc_feature 1..119: note = hyper
  source 1..119: mol_type = genomic DNA

SEQ ID NO: 93179 - DNA, 98 bp, Homo sapiens; identical to SEQ ID NO: 29485
  misc_feature 1..98: note = chr5:15500735-15500833
  misc_feature 1..98: note = hyper
  source 1..98: mol_type = genomic DNA

SEQ ID NO: 93180 - DNA, 460 bp, Homo sapiens; identical to SEQ ID NO: 29486
  misc_feature 1..460: note = chr5:15500834-15501294
  misc_feature 1..460: note = hyper
  source 1..460: mol_type = genomic DNA

SEQ ID NO: 93181 - DNA, 22 bp, Homo sapiens
  misc_feature 1..22: note = chr5:15503235-15503257
  misc_feature 1..22: note = hypo
  source 1..22: mol_type = genomic DNA
aacaatagctgaggtcgggcgc

SEQ ID NO: 93182 - DNA, 520 bp, Homo sapiens
  misc_feature 1..520: note = chr5:155107388-155107908
  misc_feature 1..520: note = hyper
  source 1..520: mol_type = genomic DNA
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgctgccgctgccggagcccgaacccaagccccagctggagccggagtcggagccggcgagat

SEQ ID NO: 93183 - DNA, 108 bp, Homo sapiens
  misc_feature 1..108: note = chr5:155108160-155108268
  misc_feature 1..108: note = hyper
  source 1..108: mol_type = genomic DNA
cggcggccggcggaggctttccgcagccgcttggccggcgccggcccctattccgttggcaagtcccttgtctatcccggagggcgcacccggacgctcgagccggag

SEQ ID NO: 93184 - DNA, 494 bp, Homo sapiens; identical to SEQ ID NO: 30033
  misc_feature 1..494: note = chr5:155108355-155108849
  misc_feature 1..494: note = hyper
  source 1..494: mol_type = genomic DNA

SEQ ID NO: 93185 - DNA, 311 bp, Homo sapiens
  misc_feature 1..311: note = chr5:155109188-155109499
  misc_feature 1..311: note = hyper
  source 1..311: mol_type = genomic DNA
cgggcatcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtcctcggacttgagccatggccttccccacgatccctggcggcagtatcccagc

SEQ ID NO: 93186 - DNA, 35 bp, Homo sapiens
  misc_feature 1..35: note = chr5:1563387-1563422
  misc_feature 1..35: note = hypo
  source 1..35: mol_type = genomic DNA
aacagaggcagctctcgggacgagaaggaagcttt

SEQ ID NO: 93187 - DNA, 21 bp, Homo sapiens
  misc_feature 1..21: note = chr5:156384996-156385017
  misc_feature 1..21: note = hypo
  source 1..21: mol_type = genomic DNA
agatctggccgggcgcggtgg

SEQ ID NO: 93188 - DNA, 183 bp, Homo sapiens
  misc_feature 1..183: note = chr5:156472913-156473096
  misc_feature 1..183: note = hypo
  source 1..183: mol_type = genomic DNA
actgacatagtatttcggagaatgattccccactcctactttcttcctccttacactctcaaagagtggggtgcagctgctcctaccactgttacgttgtgtttttatctattttcattttgcttttgtgcctggaaacagtttgcgctgaggattacactttcaaaacgaaatgtcgccatt

SEQ ID NO: 93189 - DNA, 30 bp, Homo sapiens
  misc_feature 1..30: note = chr5:156522857-156522887
  misc_feature 1..30: note = hypo
  source 1..30: mol_type = genomic DNA
tgtcttgctatgaaacgtctatttttcaca

SEQ ID NO: 93190 - DNA, 38 bp, Homo sapiens
  misc_feature 1..38: note = chr5:156591428-156591466
  misc_feature 1..38: note = hypo
  source 1..38: mol_type = genomic DNA
ctgggttaacaagcatgagccaccgcacccggcctaag

SEQ ID NO: 93191 - DNA, 30 bp, Homo sapiens
  misc_feature 1..30: note = chr5:156672960-156672990
  misc_feature 1..30: note = hypo
  source 1..30: mol_type = genomic DNA
gttttctctttcagtcgctatagcagcaag

SEQ ID NO: 93192 - DNA, 584 bp, Homo sapiens
  misc_feature 1..584: note = chr5:156874096-156874680
  misc_feature 1..584: note = hypo
  source 1..584: mol_type = genomic DNA
gactaaaggtcagaccgctctgtcagaacaggctttctggaaatgcagaccttgagataggtaagcaccaacgtatttaatgggctggctacagaataaacagctacatttttctttggggagcaaaatgcagataattatcaccacttaagctttagtgcaactgtgtaaaaaggcgcggctttttattggcccagcgcctttgtgtgcaaccaatcctgaggtgggcggctgtgtccccgccctggtgggcggagctcttcccagcccaggggcctttgcccatcaggcggttccgcctggcactggctgggcggaggtccttggtagcagaggggcaaattaaccctctgcctcacttgacaagcctgaagaaagcttaacccacgctctggattcctctggggtcccttatccaggccaggcccgcaaaccagaatttccagtgtgaccgtgttggcagagagttaatgagcagccaaggaagctgtggctgttgctgttgtagacttgccccagagggaaggacagaagaacgccaggtccttccttagcctctctgcttggaacgaggcaggtgggaa

SEQ ID NO: 93193 - DNA, 455 bp, Homo sapiens; identical to SEQ ID NO: 30035
  misc_feature 1..455: note = chr5:156887049-156887504
  misc_feature 1..455: note = hyper
  source 1..455: mol_type = genomic DNA

SEQ ID NO: 93194 - DNA, 30 bp, Homo sapiens
  misc_feature 1..30: note = chr5:156960564-156960594
  misc_feature 1..30: note = hypo
  source 1..30: mol_type = genomic DNA
ggggagaagaggggccgggcctgtgtggag

SEQ ID NO: 93195 - DNA, 132 bp, Homo sapiens
  misc_feature 1..132: note = chr5:157001726-157001858
  misc_feature 1..132: note = hyper
  source 1..132: mol_type = genomic DNA
tctgcttatagcccccgagggatggagccggggaggggattggtgtctgggaaactagtcctgagaaacacggacatcacccggcatcttagctggaaacatcgagtcagaccccttcgcttcacagaaggg

SEQ ID NO: 93196 - DNA, 106 bp, Homo sapiens
  misc_feature 1..106: note = chr5:157002098-157002204
  misc_feature 1..106: note = hyper
  source 1..106: mol_type = genomic DNA
gctaccacagtctgccgcgggcattttatgtcctaccccaccagtgtggcaggcaccgagcctggtcccaggaagccgctcccaggccacacgggcagggcgctcg

SEQ ID NO: 93197 - DNA, 370 bp, Homo sapiens
  misc_feature 1..370: note = chr5:157002447-157002817
  misc_feature 1..370: note = hyper
  source 1..370: mol_type = genomic DNA
cgtgggaacaaagcccgggctcccaggctggggacggcgggggcgcaggccccgcggagttgcgggaggcgcaggggtcgcggtcccagcgctccggacccgcaaggctactcccaggtctccgggccacccagcctccatccccccgcgcctggccacttacttgtccatccaggctcccgcgccgcccgcggccggaggggctgcagggcaaacgccagcaagcagagccgggcggcgcctgcgccccctggcatggtggcggcggcccttagcgctcggcgctcacacgccctcagccatacctgcccactgcccggcggtggaggcgcgtctggaaccccccggctcgccccgcgcctccccaccc

SEQ ID NO: 93198 - DNA, 143 bp, Homo sapiens
  misc_feature 1..143: note = chr5:157041326-157041469
  misc_feature 1..143: note = hypo
  source 1..143: mol_type = genomic DNA
gagagttctacttgacgtggatcttaccccaggattgtttgtcagcaaagttaacgtggtagagcagaaagagtgctgagtttggaggcagacagacttgagttcaggtcttaattcttcatcacttgcggggtggtgttgga

SEQ ID NO: 93199 - DNA, 42 bp, Homo sapiens
  misc_feature 1..42: note = chr5:157078407-157078449
  misc_feature 1..42: note = hypo
  source 1..42: mol_type = genomic DNA
cgagcctgcagtcctcgaggagtctctcgggttcctccgttt

SEQ ID NO: 93200 - DNA, 469 bp, Homo sapiens
  misc_feature 1..469: note = chr5:157098271-157098740
  misc_feature 1..469: note = hyper
  source 1..469: mol_type = genomic DNA
gccccgccagcaggccggggtcactgcagtccccacgtcgaagcggaaaaggtctgctcagctcaccgcaccccacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttccagcgccacctcgggttcgaactaccagcgcg

SEQ ID NO: 93201 - DNA, 135 bp, Homo sapiens
  misc_feature 1..135: note = chr5:157852959-157853094
  misc_feature 1..135: note = hypo
  source 1..135: mol_type = genomic DNA
tgaaaataaaaaccacatttgagaaagcccagaatgagaaaagtgggaagggagaggtgcagtagcaagccatggtatagcaatccgcatgacctagccatcctgaggccggggaataaccgctgaaaagcattg

SEQ ID NO: 93202 - DNA, 18 bp, Homo sapiens
  misc_feature 1..18: note = chr5:157881508-157881526
  misc_feature 1..18: note = hypo
  source 1..18: mol_type = genomic DNA
tggagcagaaaggggcgg

SEQ ID NO: 93203 - DNA, 66 bp, Homo sapiens
  misc_feature 1..66: note = chr5:158139390-158139456
  misc_feature 1..66: note = hypo
  source 1..66: mol_type = genomic DNA
caatcctggaagactcggggaaaggaaggtctctgtttctggccccgtcgccgcaacccagaggga

SEQ ID NO: 93204 - DNA, 30 bp, Homo sapiens
  misc_feature 1..30: note = chr5:158250354-158250384
  misc_feature 1..30: note = hypo
  source 1..30: mol_type = genomic DNA
attttaatataaaagcgtggtgggtaataa

SEQ ID NO: 93205 - DNA, 30 bp, Homo sapiens
  misc_feature 1..30: note = chr5:158398433-158398463
  misc_feature 1..30: note = hypo
  source 1..30: mol_type = genomic DNA
aacgaaataacttcccggcatcaaggccct

SEQ ID NO: 93206 - DNA, 25 bp, Homo sapiens
  misc_feature 1..25: note = chr5:158478441-158478466
  misc_feature 1..25: note = hyper
  source 1..25: mol_type = genomic DNA
cccacccccccaccccgccgcccgg

SEQ ID NO: 93207 - DNA, 303 bp, Homo sapiens; identical to SEQ ID NO: 30041
  misc_feature 1..303: note = chr5:158478512-158478815
  misc_feature 1..303: note = hyper
  source 1..303: mol_type = genomic DNA

SEQ ID NO: 93208 - DNA, 108 bp, Homo sapiens
  misc_feature 1..108: note = chr5:158524640-158524748
  misc_feature 1..108: note = hyper
  source 1..108: mol_type = genomic DNA
cgagtgcccggccttgggaagccacatccccccaccaccaaaaagcatgtggagaagggtccgagggcggggctcagaactgtcgcgggtggtcgctgtgaaaaaggg

SEQ ID NO: 93209 - DNA, 289 bp, Homo sapiens; identical to SEQ ID NO: 30043
  misc_feature 1..289: note = chr5:158526129-158526418
  misc_feature 1..289: note = hyper
  source 1..289: mol_type = genomic DNA

SEQ ID NO: 93210 - DNA, 444 bp, Homo sapiens
  misc_feature 1..444: note = chr5:158527373-158527817
  misc_feature 1..444: note = hyper
  source 1..444: mol_type = genomic DNA
gcggggcccgcgcatcgaggccccgccccttcatttgcataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 93211 - DNA, 309 bp, Homo sapiens
  misc_feature 1..309: note = chr5:158527818-158528127
  misc_feature 1..309: note = hyper
  source 1..309: mol_type = genomic DNA
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcgggcagtcctcgag

SEQ ID NO: 93212 - DNA, 246 bp, Homo sapiens
  misc_feature 1..246: note = chr5:158533542-158533788
  misc_feature 1..246: note = hyper
  source 1..246: mol_type = genomic DNA
ggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcgggcctacagattacgcggactgagctgggaacggtccctgctggacagttccgtgctcttaatccttcctcgcctacggtctctgattatt

SEQ ID NO: 93213 - DNA, 141 bp, Homo sapiens
  misc_feature 1..141: note = chr5:158612852-158612993
  misc_feature 1..141: note = hypo
  source 1..141: mol_type = genomic DNA
aaactgaaaaatctacgtccctagtcctgtataacagcctcccctcttttaactcaaactggggccacaaggaatgtacaagatctatgaaaagggcctccggccatggtagctcaagcctgtaatcccagcactttggga

SEQ ID NO: 93214 - DNA, 189 bp, Homo sapiens
  misc_feature 1..189: note = chr5:158875177-158875366
  misc_feature 1..189: note = hypo
  source 1..189: mol_type = genomic DNA
tgtgtccctgtgccacgggttgcctgtagaggtgcagggcttcttgctgtctgttatggaagcagtcgggccttttcccgactcccagtgagatggccaggagatctggggctcagttttcctgaaacaaagataaggacccagagtgtgacttcagctcaccatgttgttacacgttaaagcgtggtc

SEQ ID NO: 93215 - DNA, 324 bp, Homo sapiens
  misc_feature 1..324: note = chr5:159200128-159200452
  misc_feature 1..324: note = hyper
  source 1..324: mol_type = genomic DNA
agcctgaatggctaacggtagagcaggtgactgaatgaggggtggacggacgcccagatgcctgcttcctggcttttctcccgctctgtcttcacagcctgcccttcctcggctccaaggcgcccccgaggggtgagcttcctgggcgcgctccgcagcgccctccgcccctagctcgcggggagggcgtcgcgcggctgttcagcggggcagcggcctagcggcgcggacctgggtctcctccctcgcaccgggccgagcgccgggctcgtctgcattgacgtctgcggcggcggcggcggcagcagccgggctctcgggagc

SEQ ID NO: 93216 - DNA, 30 bp, Homo sapiens
  misc_feature 1..30: note = chr5:15928261-15928291
  misc_feature 1..30: note = hypo
  source 1..30: mol_type = genomic DNA
accaaccagctgtgccgctgcgcgcgagtg

SEQ ID NO: 93217 - DNA, 261 bp, Homo sapiens
  misc_feature 1..261: note = chr5:159343387-159343648
  misc_feature 1..261: note = hyper
  source 1..261: mol_type = genomic DNA
gcggcgtcggggctgcgggcgccttggctggacccgcattgccccctagtgccgcgcggagtcagggcgccgggctcccccgcctgatgtcaccgccgtgcagtcagcccagaagcggctcattgaaagcagaccctcttcggcgctcgctgggcggaggacgcgccgcggtccgcagacccgagcgagctgggcaccgccgggcgcccccggccctgccgccccctcctccccgccgctcccccgcgagcccggccaggc

SEQ ID NO: 93218 - DNA, 34 bp, Homo sapiens
  misc_feature 1..34: note = chr5:159399066-159399100
  misc_feature 1..34: note = hyper
  source 1..34: mol_type = genomic DNA
ccgccgtcgcctgggcggctgcgcctacacctac

SEQ ID NO: 93219 - DNA, 201 bp, Homo sapiens
  misc_feature 1..201: note = chr5:159399509-159399710
  misc_feature 1..201: note = hyper
  source 1..201: mol_type = genomic DNA
cgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccgagcatgctgagag

SEQ ID NO: 93220 - DNA, 27 bp, Homo sapiens
  misc_feature 1..27: note = chr5:159437321-159437348
  misc_feature 1..27: note = hypo
  source 1..27: mol_type = genomic DNA
cagttaaaatgacgatttgacattatt

SEQ ID NO: 93221 - DNA, 376 bp, Homo sapiens
  misc_feature 1..376: note = chr5:159615222-159615598
  misc_feature 1..376: note = hyper
  source 1..376: mol_type = genomic DNA
ccaggaatgccctcccggcctctcctcccgattccttatcagctacaagctcgagtttcctcagccacacgcgatcaaatgctgcttcagagctctaggaagctgggtgtgtcttctgtgctttgtaaaaaagaaacgaaaaaaacattagcaaatccccagcccaggtagccggctggctgagggcggactcttggaactgggcggtgggaggtgggggacgggggagggattggggggcccttgctccaaagccaaagagcgggaaacaggaactgcagggaggccactccgcaggcgcctcccctttcccgctggggagaggccgccgccgcgcggcgctcggcctgcaccgaccctccggggaccccgctaa

SEQ ID NO: 93222 - DNA, 21 bp, Homo sapiens
  misc_feature 1..21: note = chr5:159660593-159660614
  misc_feature 1..21: note = hypo
  source 1..21: mol_type = genomic DNA
gaaactggccgggcacggtgg

SEQ ID NO: 93223 - DNA, 28 bp, Homo sapiens
  misc_feature 1..28: note = chr5:159672080-159672108
  misc_feature 1..28: note = hypo
  source 1..28: mol_type = genomic DNA
ggtaggggctgggtgcggtggctcacgc

SEQ ID NO: 93224 - DNA, 56 bp, Homo sapiens
  misc_feature 1..56: note = chr5:159738684-159738740
  misc_feature 1..56: note = hyper
  source 1..56: mol_type = genomic DNA
ccagtctctaacccccgccccccaattccgctcagacactccgggagaaggtaaag

SEQ ID NO: 93225 - DNA, 137 bp, Homo sapiens
  misc_feature 1..137: note = chr5:159739049-159739186
  misc_feature 1..137: note = hyper
  source 1..137: mol_type = genomic DNA
tctcgcccctggccccgggccccggcgggcgccccctcctgcgccgctcagaggagctggaggtcgcctctggtccgcggaaggctgcggtgccccctcccctctgctcgccggacacggggcgatatggagctgtg

SEQ ID NO: 93226 - DNA, 468 bp, Homo sapiens
  misc_feature 1..468: note = chr5:159739433-159739901
  misc_feature 1..468: note = hyper
  source 1..468: mol_type = genomic DNA
ccctctggtgcctgccggcggttggaccctcgtccgaggcgctccgcactcccgacggccgcctccgcagcccgactagcccccgccgtcgccgcgcccctgcgtgcgctcgggtcccgccgcggctcgcaggctcccggccgccgggggcctccctccctcgctgggggaattgggggccgggcctcgcgcatgcgctgccggcgcccccgcgccccgcggggcggggggctgggaattggagcctttctttgccagctctggctccgcttcctgcccgccctcctccctcgcttcggcggaaagcttctctctcaccttcgctgaggctagtggtagccttctgggcacccctccggcttgcgcagggagcaaagggaccgcggcgccacctgcgcgcaccacgcgtgaaacgtgcggacaggacgcccccagaaagttctgccttccgcgcgcactgctctagcc

SEQ ID NO: 93227 - DNA, 262 bp, Homo sapiens
  misc_feature 1..262: note = chr5:159776326-159776588
  misc_feature 1..262: note = hypo
  source 1..262: mol_type = genomic DNA
agcctgaggccacatcgtggttgccggtgttggcatcaaaggtccggatgcggtactggccgttgtgcaccaggccgatggccaggtgcttgttggccagcgtgatgtcgtaggtgaagtagtagatcccaggcacgccgcagacgaacttgccgctggaagcattgtagtggccaccctcgttcatcagaatcttgtcaaacttgatgggcagccgctcccgtgggtagctcttggtcactgccaccgagaaagctgactt

SEQ ID NO: 93228 - DNA, 152 bp, Homo sapiens
  misc_feature 1..152: note = chr5:16032731-16032883
  misc_feature 1..152: note = hypo
  source 1..152: mol_type = genomic DNA
actttcaaaaatagacgtcgatcacagtttcaatatcctgatattcatgtagcatctttattaccgcactctaaaccaccatctagttagtcccctcacctgatctcttccaagtttctatattctgtttctgcctttcagaatgcttcaca

SEQ ID NO: 93229 - DNA, 40 bp, Homo sapiens
  misc_feature 1..40: note = chr5:160498377-160498417
  misc_feature 1..40: note = hypo
  source 1..40: mol_type = genomic DNA
gaataggaacagctccggtctgcagtgccaagcatgagcg

SEQ ID NO: 93230 - DNA, 425 bp, Homo sapiens
  misc_feature 1..425: note = chr5:160973379-160973804
  misc_feature 1..425: note = hyper
  source 1..425: mol_type = genomic DNA
cgtctctttaaccagcgacatattactagggtcattgacactaaagaaagaaatgacaataagcaggcatcaataaggaagcaggcatagcgttttcagcatcggatccctactacatttccctgctcacagaggtatgcagacagaacccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggaccgagcagatttcctt

SEQ ID NO: 93231 - DNA, 249 bp, Homo sapiens; identical to SEQ ID NO: 30056
  misc_feature 1..249: note = chr5:160974612-160974861
  misc_feature 1..249: note = hyper
  source 1..249: mol_type = genomic DNA

SEQ ID NO: 93232 - DNA, 276 bp, Homo sapiens
  misc_feature 1..276: note = chr5:160975071-160975347
  misc_feature 1..276: note = hyper
  source 1..276: mol_type = genomic DNA
ggcactgtgttctcccgcggtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 93233 - DNA, 100 bp, Homo sapiens; identical to SEQ ID NO: 8154
  misc_feature 1..100: note = chr5:160975348-160975448
  misc_feature 1..100: note = hyper
  source 1..100: mol_type = genomic DNA

SEQ ID NO: 93234 - DNA, 266 bp, Homo sapiens
  misc_feature 1..266: note = chr5:160975668-160975934
  misc_feature 1..266: note = hyper
  source 1..266: mol_type = genomic DNA
tgaagtcaagaagctcgcccaaggtcactcagatggcatgaggtgaaaccaggattggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 93235 - DNA, 43 bp, Homo sapiens
  misc_feature 1..43: note = chr5:160975955-160975998
  misc_feature 1..43: note = hyper
  source 1..43: mol_type = genomic DNA
cggaagtagctccacaggcttgcgaccccggcagccctggggg

SEQ ID NO: 93236 - DNA, 37 bp, Homo sapiens
  misc_feature 1..37: note = chr5:161274219-161274256
  misc_feature 1..37: note = hyper
  source 1..37: mol_type = genomic DNA
ggggaaaagtagatgcggatttcgtcctgacttctaa

SEQ ID NO: 93237 - DNA, 30 bp, Homo sapiens; identical to SEQ ID NO: 8157
  misc_feature 1..30: note = chr5:161274605-161274635
  misc_feature 1..30: note = hyper
  source 1..30: mol_type = genomic DNA

SEQ ID NO: 93238 - DNA, 244 bp, Homo sapiens
  misc_feature 1..244: note = chr5:161275346-161275590
  misc_feature 1..244: note = hyper
  source 1..244: mol_type = genomic DNA
cgctggctccagtctctccacgattctctctcccagacttttccccggtcttaagagatcctgtgtccagagggggccttaggtaagtgcgactttggaccacgatacacagacagagctttgaacgtggcttttcctagctggagagacaggaatgttatagtcggggggggggggcggggggagacggggggagagagagagagagagaagaaggagagcgagcgagcgagcaagggagcga

SEQ ID NO: 93239 - DNA, 58 bp, Homo sapiens
  misc_feature 1..58: note = chr5:161275813-161275871
  misc_feature 1..58: note = hyper
  source 1..58: mol_type = genomic DNA
tgagttggggaggggcgtcgggggccatcatctaaagttaagacgctgggacggaaaa

SEQ ID NO: 93240 - DNA, 76 bp, Homo sapiens
  misc_feature 1..76: note = chr5:161495120-161495196
  misc_feature 1..76: note = hyper
  source 1..76: mol_type = genomic DNA
tgccctttttggcgtcgttttgttctgaagaggtggggggaaggtgtggggaggggtaactcgggagaccacccag

SEQ ID NO: 93241 - DNA, 157 bp, Homo sapiens
  misc_feature 1..157: note = chr5:16178996-16179153
  misc_feature 1..157: note = hyper
  source 1..157: mol_type = genomic DNA
gcatattggagccagcgctcacagggcagaaccagacgagcctcactggaggcaaactgggaggtaggcgtgcgctgtccgtggtgctgaaagcttgaccggcgcgagctggagccgccaccggctgcctcggggtctcgccgggccttacctgctc

SEQ ID NO: 93242 - DNA, 141 bp, Homo sapiens; identical to SEQ ID NO: 29488
  misc_feature 1..141: note = chr5:16179266-16179407
  misc_feature 1..141: note = hyper
  source 1..141: mol_type = genomic DNA

SEQ ID NO: 93243 - DNA, 246 bp, Homo sapiens
  misc_feature 1..246: note = chr5:16179554-16179800
  misc_feature 1..246: note = hyper
  source 1..246: mol_type = genomic DNA
cggggaccggggccggctctcccggcggcggcgtcggcggcggcggcgggggaggttgcgggggaggctcggcgtccccgctctccgccccgcgacaccgactgccgccgtggccgccctcaaagctcatggttgtgccgccgccgccctcctgccggcccggctggcgggccgggctctggctgcagggaaagagagcgcggagggggcgggagggagaggggaaaaggagggagggggcccgga

SEQ ID NO: 93244 - DNA, 139 bp, Homo sapiens; identical to SEQ ID NO: 2540
  misc_feature 1..139: note = chr5:16180182-16180321
  misc_feature 1..139: note = hyper
  source 1..139: mol_type = genomic DNA

SEQ ID NO: 93245 - DNA, 413 bp, Homo sapiens
  misc_feature 1..413: note = chr5:16180371-16180784
  misc_feature 1..413: note = hyper
  source 1..413: mol_type = genomic DNA
cgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctcggtaactccaccct

SEQ ID NO: 93246 - DNA, 97 bp, Homo sapiens
  misc_feature 1..97: note = chr5:16209234-16209331
  misc_feature 1..97: note = hypo
  source 1..97: mol_type = genomic DNA
actgcttatacctgggaggcagaagtttcagcgagctgagatcgcaccactctggtgcagcctgcatgacagggcaagactccgtctcagaaaaaaa

SEQ ID NO: 93247 - DNA, 30 bp, Homo sapiens
  misc_feature 1..30: note = chr5:162807006-162807036
  misc_feature 1..30: note = hypo
  source 1..30: mol_type = genomic DNA
ccatgaaggcacaaacgacaagagactcgg

SEQ ID NO: 93248 - DNA, 46 bp, Homo sapiens
  misc_feature 1..46: note = chr5:162930274-162930320
  misc_feature 1..46: note = hyper
  source 1..46: mol_type = genomic DNA
tgaagctgctcctcacgttttggcgtgcctgcgctctctgcaggca

SEQ ID NO: 93249 - DNA, 805 bp, Homo sapiens
  misc_feature 1..805: note = chr5:162931152-162931957
  misc_feature 1..805: note = hyper
  source 1..805: mol_type = genomic DNA
ctagaaactttaaaccgaattcccagttaagagaaaaagtagtaagatgatcttggctgctcccccggccctcttcccgccctcttctttgttgtcccctgattatgcttgtttagcgctggggcagtcctcaaggattccctaaataaagccaaactaatgaacagtaatagcctgtgtttaaaaaaaaaaaaaatcggaacataagaaacctcaggctgtcttcgattactgttctagagaaactttatgtttacacgaataaggaaatgagtttttgttgggggttgaggaggaaggaaagtcatggtgttctgacgtggaaaacttctttaaaaggctgcttagtctttagtttgaaaataaaccaaaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctgaggattttttgcggtttttaactggaagggaaataagtcggcatcagcacttagggctgcttaacttttaaaaggtggtagaacgcccagccttacacgctgctgcttaaattctcggtgctcaccaaggctgggctcgtgtggcccaatcctgcaatccccgaggcggtgtttcttaaagagtgggcttgattctggttaaacccattaagaagtcggaccccgggctcgtttcttgttctgt

SEQ ID NO: 93250 - DNA, 45 bp, Homo sapiens
  misc_feature 1..45: note = chr5:163604915-163604960
  misc_feature 1..45: note = hypo
  source 1..45: mol_type = genomic DNA
aagatgggactcggccgggcgcggtggctcacgcctgtaatccca

SEQ ID NO: 93251 - DNA, 149 bp, Homo sapiens
  misc_feature 1..149: note = chr5:164218749-164218898
  misc_feature 1..149: note = hypo
  source 1..149: mol_type = genomic DNA
gatgaattatagctccgtgtgacacggagatgaattttaaaaatctatagagttcaaaacaaagataaacattaacgtttcaaaaatgcatacccacctagcagaactataaaagggaaagtgagaaaataaaatcaaaagaatattgg

SEQ ID NO: 93252 - DNA, 24 bp, Homo sapiens
  misc_feature 1..24: note = chr5:16466772-16466796
  misc_feature 1..24: note = hypo
  source 1..24: mol_type = genomic DNA
gaacttcaggccaggcgcggtggc

SEQ ID NO: 93253 - DNA, 24 bp, Homo sapiens
  misc_feature 1..24: note = chr5:16467096-16467120
  misc_feature 1..24: note = hypo
  source 1..24: mol_type = genomic DNA
tggggaggtcgtagatttcatcca

SEQ ID NO: 93254 - DNA, 55 bp, Homo sapiens
  misc_feature 1..55: note = chr5:165029934-165029989
  misc_feature 1..55: note = hypo
  source 1..55: mol_type = genomic DNA
caaacatttatttctcgattgaacccatcaccaccacaaccgcccttgctcactg

SEQ ID NO: 93255 - DNA, 91 bp, Homo sapiens
  misc_feature 1..91: note = chr5:1654294-1654385
  misc_feature 1..91: note = hyper
  source 1..91: mol_type = genomic DNA
ctacaggtcagtgggcgatcaacagctggacgcgtagcagggggtatccgggtggcctaaaagaattcagcaaggccgactgcaggccgag

SEQ ID NO: 93256 - DNA, 330 bp, Homo sapiens
  misc_feature 1..330: note = chr5:1662561-1662891
  misc_feature 1..330: note = hypo
  source 1..330: mol_type = genomic DNA
ctctgcctgcccagccgcccctctgcgccgggcaccactcagcacgtgggtgggagtggatgccgctccatctttaggacacttttactttctgtacatagtcctgcctgtcgggatgcaaaacagcaggcccagtccttttccgcaagacagcattccagataccgggaagcagacactccgtcccagtgctagtcggctgcgtgacagagtgcacaggtggggccgagaacacagcaacgtgtcccacactcccgcaggctggggacacgcagacaaagtgtgtccctgtgtctgtgtgtatctgtctgtgtgcgtccctgtgtctgt

SEQ ID NO: 93257 - DNA, 28 bp, Homo sapiens
  misc_feature 1..28: note = chr5:166269144-166269172
  misc_feature 1..28: note = hypo
  source 1..28: mol_type = genomic DNA
atctgagtcggccagcgcggtggctcac

SEQ ID NO: 93258 - DNA, 89 bp, Homo sapiens
  misc_feature 1..89: note = chr5:166363557-166363646
  misc_feature 1..89: note = hypo
  source 1..89: mol_type = genomic DNA
ccacaagcgctgcgtgcagctgcggtttctgcccgcgcctctccacacctccctgcaagcagagggagccggctcggctgaggccttgg

SEQ ID NO: 93259 - DNA, 1007 bp, Homo sapiens
  misc_feature 1..1007: note = chr5:166405469-166406476
  misc_feature 1..1007: note = hyper
  source 1..1007: mol_type = genomic DNA
agcactggacatgctcgcgagagccagggcaggctcgggtcgtccgcaggactcgaaggcttgctgtgctctcctgtttgcagagacctgggtgtagctgtggtgcatagatgtggtgcatcgggtgccgagcggatccctcggtgcgtgcagctagggatccaagcctcctcaggctaaccctagagccgaactgaactctgagccgcccggggttcgcgcgctcagttcctggtcttggaaacgcccagctggggttctctctgcagacaaaggggtgcacgtgtccctagcgcccctctttctcagccgtgagcccctccctggctgcgtaccccgcagccacagcagctgcagccccagcgccaccacccaaccccggcggcctgggccggtgcgcgctctcggggcccagggattggctcgcactccccattcagggaccgcgagggctagcgggcggcgcacggcgctctgtgtgtgtgtgtgtgtgtgtgtgtgtgtgtgtgtgtttgtgtgtgcgcgcgcgcgcgtgtgttgtgcggcgcgcgggcgagcgcgtgtgtgcgcgcgagagctcgcgtgcaggagtcactgggtgtgcgtgcgtgtgttatgggtttgattccagagcaggttgcacattggtcctgggtggctcgcaggctcaggtcgtgcttgggcgtcctcctcctaatcgtttccgaagtagcagcagcagcaccaccaccagcagcagcagcagcagcagcagcagcagcagcagcagcagccgccgcggcaacatcgagctcagcggcacagcaggcagaactgtgcagaagcgagcaccgtttggggagtccggggggcgggtaagagggaggagggggaaagcctgtcttggtctttgggattattttttttccccttctttccctctctctctctttcttgagggtgtgtgttgccccctcgaagtgaaggaattttgctccaaagcgagctgggaccgaagactctaggct

SEQ ID NO: 93260 - DNA, 151 bp, Homo sapiens
  misc_feature 1..151: note = chr5:166461205-166461356
  misc_feature 1..151: note = hypo
  source 1..151: mol_type = genomic DNA
gaggcatgatagattcgcttatacatgttagaatgagatgataaactaattcattgtcctgcattggtatcccaatattgtactccttccaatggtcagtaacaaaagatagctaagagaaaaataggtgtacatgtgaaattattttggc

SEQ ID NO: 93261 - DNA, 43 bp, Homo sapiens
  misc_feature 1..43: note = chr5:166470722-166470765
  misc_feature 1..43: note = hypo
  source 1..43: mol_type = genomic DNA
aatactgttctaagccgggcgcggtggctcacgcctgtaatcc

SEQ ID NO: 93262 - DNA, 83 bp, Homo sapiens
  misc_feature 1..83: note = chr5:166532947-166533030
  misc_feature 1..83: note = hypo
  source 1..83: mol_type = genomic DNA
aggaatgtgtgtgcaagcagctttgagaaatgtgaagtattataatatgaatgaaaaatgatgtgaatcgacagagttttttt

SEQ ID NO: 93263 - DNA, 129 bp, Homo sapiens
  misc_feature 1..129: note = chr5:1667514-1667643
  misc_feature 1..129: note = hyper
  source 1..129: mol_type = genomic DNA
cgttgccctgggaaccggggactgcagccgcggacttcggggtctcggctccggcccctgcaggaccgcgggcgccgccggggaagcgaggcctttgggtctgagggtccgagcggctcccggaggtgc

SEQ ID NO: 93264 - DNA, 450 bp, Homo sapiens
  misc_feature 1..450: note = chr5:1667644-1668094
  misc_feature 1..450: note = hyper
  source 1..450: mol_type = genomic DNA
ggcggagataggagaccccccccgagcctggggggggcgcaggaagggggcgcgcggggcgggggcgcgcaggaagggggcgcgcggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 93265 - DNA, 146 bp, Homo sapiens
  misc_feature 1..146: note = chr5:1668306-1668452
  misc_feature 1..146: note = hyper
  source 1..146: mol_type = genomic DNA
gctctgcaggtttctcgcggccgtgggtgatccggggggttgtggcccagcctggggttgtggtgaaaatgggcttttcagtaggggttggggcagtgcctggaataacccgcagtgctcacatctgcctgcggggaccttctgca

SEQ ID NO: 93266 - DNA, 21 bp, Homo sapiens
  misc_feature 1..21: note = chr5:166865441-166865462
  misc_feature 1..21: note = hypo
  source 1..21: mol_type = genomic DNA
gctggagtgcagtggcgccat

SEQ ID NO: 93267 - DNA, 30 bp, Homo sapiens
  misc_feature 1..30: note = chr5:166920753-166920783
  misc_feature 1..30: note = hypo
  source 1..30: mol_type = genomic DNA
gtccactcatttattcggcatatatgttca

SEQ ID NO: 93268 - DNA, 239 bp, Homo sapiens
  misc_feature 1..239: note = chr5:167000910-167001149
  misc_feature 1..239: note = hyper
  source 1..239: mol_type = genomic DNA
aaagaaaaaaaaaggcggggggtggacttagcagtgtaatttgagaccggtggtaaggattggagcgagctagagatgctgcacgctgctaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtt

SEQ ID NO: 93269 - DNA, 152 bp, Homo sapiens
  misc_feature 1..152: note = chr5:16707883-16708035
  misc_feature 1..152: note = hypo
  source 1..152: mol_type = genomic DNA
aagcatccgacaggccgcttcaattcctagtaatgcttctccagtcctctaggtaagaatgcttgccttacaagaacaaatatgttttggataagtcagccagttcagacctggagccatgtctaattcgctgccttcgacactggctaaac

SEQ ID NO: 93270 - DNA, 247 bp, Homo sapiens
  misc_feature 1..247: note = chr5:16744440-16744687
  misc_feature 1..247: note = hypo
  source 1..247: mol_type = genomic DNA
ctgtcaatacacacacgttaaacacagggaaaggacgcccggccacacaaggtgtagtgatgaggcctgggcgaaacctgggtgcacacctttgatctattgtatcggtggcttcatggctcctctgcacctgggtggctgtgcgatacccttcccatgccaacgggattatggtgtatcataatgtgctagacccagagcaccccgacaccctgggtctcagcaggcgcggcgcagggcttcctgt

SEQ ID NO: 93271 - DNA, 30 bp, Homo sapiens
  misc_feature 1..30: note = chr5:167449482-167449512
  misc_feature 1..30: note = hypo
  source 1..30: mol_type = genomic DNA
cccttggccatgaggcgctgcatccggctt

SEQ ID NO: 93272 - DNA, 30 bp, Homo sapiens
  misc_feature 1..30: note = chr5:167530477-167530507
  misc_feature 1..30: note = hypo
  source 1..30: mol_type = genomic DNA
tctgtgacagttcctcgttactccttgtct

SEQ ID NO: 93273 - DNA, 99 bp, Homo sapiens
  misc_feature 1..99: note = chr5:167689244-167689343
  misc_feature 1..99: note = hypo
  source 1..99: mol_type = genomic DNA
gtccagcatcgccagcgaagatagccgcaaggtggcatctgtgctgaacaacgcctactacctggacaagatgcactacagcatcgagggcaaggacac

SEQ ID NO: 93274 - DNA, 286 bp, Homo sapiens
  misc_feature 1..286: note = chr5:167955981-167956267
  misc_feature 1..286: note = hyper
  source 1..286: mol_type = genomic DNA
gcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttc

SEQ ID NO: 93275 - DNA, 65 bp, Homo sapiens; identical to SEQ ID NO: 30072
  misc_feature 1..65: note = chr5:167956413-167956478
  misc_feature 1..65: note = hyper
  source 1..65: mol_type = genomic DNA

SEQ ID NO: 93276 - DNA, 140 bp, Homo sapiens
  misc_feature 1..140: note = chr5:167956683-167956823
  misc_feature 1..140: note = hyper
  source 1..140: mol_type = genomic DNA
gggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggca

SEQ ID NO: 93277 - DNA, 152 bp, Homo sapiens
  misc_feature 1..152: note = chr5:167956844-167956996
  misc_feature 1..152: note = hyper
  source 1..152: mol_type = genomic DNA
cggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcg

SEQ ID NO: 93278 - DNA, 182 bp, Homo sapiens; identical to SEQ ID NO: 40512
  misc_feature 1..182: note = chr5:16809241-16809423
  misc_feature 1..182: note = hypo
  source 1..182: mol_type = genomic DNA

SEQ ID NO: 93279 - DNA, 166 bp, Homo sapiens
  misc_feature 1..166: note = chr5:168192155-168192321
  misc_feature 1..166: note = hypo
  source 1..166: mol_type = genomic DNA
cctgaaggcgtgcaccggctgggctgtggctggggacagccgcctattaaatgcattttcattttaatcaaggtgagagcagcctgtagttagcaggaatcgctctcagtagtatagttagattataactggtggacctctgcaatggagccgctgacccatttta

SEQ ID NO: 93280 - DNA, 190 bp, Homo sapiens
  misc_feature 1..190: note = chr5:168195076-168195266
  misc_feature 1..190: note = hypo
  source 1..190: mol_type = genomic DNA
gcaggtggtgggctgcggtgctccagagcagaggagaggtgtccagcggtggtggcggcggtggcgggccatgctgcaggagagcacggtgctttccgcggtgcttgacagaaccatgttccgtttccatcgttccaccacatggttagatcaagcacaaaggaaagccccgcagcgactggtcagagtc

SEQ ID NO: 93281 - DNA, 57 bp, Homo sapiens
  misc_feature 1..57: note = chr5:168231749-168231806
  misc_feature 1..57: note = hypo
  source 1..57: mol_type = genomic DNA
tgaagaaagaagaagcgaagtctccactccactgtggtaagtcgtatgcttcttccc

SEQ ID NO: 93282 - DNA, 197 bp, Homo sapiens
  misc_feature 1..197: note = chr5:168233348-168233545
  misc_feature 1..197: note = hypo
  source 1..197: mol_type = genomic DNA
tccagcagccccacacgctgatggcctagtgggtgatgggctgggacagggagctgaattctccggcgacagttgttgggggtgtcagacaggtgcacttacatttcgacgatgccctccggcaagttggcaggaatctccatcaagccctttcctcgacagtccacgatgttattgctgcacgtgcagggcgaagg

SEQ ID NO: 93283 - DNA, 30 bp, Homo sapiens
  misc_feature 1..30: note = chr5:168244450-168244480
  misc_feature 1..30: note = hypo
  source 1..30: mol_type = genomic DNA
tggttggagtggaggcgcctgggagagggc

SEQ ID NO: 93284 - DNA, 30 bp, Homo sapiens
  misc_feature 1..30: note = chr5:168250255-168250285
  misc_feature 1..30: note = hypo
  source 1..30: mol_type = genomic DNA
cttactcacagagttcggatcttcggcatg

SEQ ID NO: 93285 - DNA, 74 bp, Homo sapiens
  misc_feature 1..74: note = chr5:168253292-168253366
  misc_feature 1..74: note = hypo
  source 1..74: mol_type = genomic DNA
tggggctggccagcccggggatgtcagagggttggtaacctctcagacgctgattgctacgacagctacagttt

SEQ ID NO: 93286 - DNA, 30 bp, Homo sapiens
  misc_feature 1..30: note = chr5:168258418-168258448
  misc_feature 1..30: note = hypo
  source 1..30: mol_type = genomic DNA
gatctccctgtggaccgtttaaattaaagc

SEQ ID NO: 93287 - DNA, 278 bp, Homo sapiens
  misc_feature 1..278: note = chr5:168267858-168268136
  misc_feature 1..278: note = hypo
  source 1..278: mol_type = genomic DNA
ctatggcaatggccacgagtgggaataaatcatctctggggcgacaagtgtatcagtgaaaaagcaggacgagttccttactcctgcaagtttgatttaccttcaactttgtgggcacccgttaactgggtaaagggaatggcagggccaatttcacaagcctgtgaaaggctccgacattctccccagcgggattgtgagtcattgctagtttgcctccatcagttcttgaggccagttcacaccaccctgcagcccacagccgccatgcttcaggg

SEQ ID NO: 93288 - DNA, 24 bp, Homo sapiens
  misc_feature 1..24: note = chr5:168278312-168278336
  misc_feature 1..24: note = hypo
  source 1..24: mol_type = genomic DNA
gtgagactccgtctcaaaaaaaaa

SEQ ID NO: 93289 - DNA, 43 bp, Homo sapiens
  misc_feature 1..43: note = chr5:168289177-168289220
  misc_feature 1..43: note = hypo
  source 1..43: mol_type = genomic DNA
agcataagaatgatacgttggactttggggactcgggggaaag

SEQ ID NO: 93290 - DNA, 92 bp, Homo sapiens
  misc_feature 1..92: note = chr5:168337394-168337486
  misc_feature 1..92: note = hypo
  source 1..92: mol_type = genomic DNA
gtatatttacacactcgcacacacacacatatttggccatatatcaatgatggattaaaccatcacaattgccgccgggcgtggtggctcac

SEQ ID NO: 93291 - DNA, 114 bp, Homo sapiens
  misc_feature 1..114: note = chr5:168372951-168373065
  misc_feature 1..114: note = hypo
  source 1..114: mol_type = genomic DNA
ttggaaagtttctcgcgtactgtttctaaattccttgttacaataatagccgcactctatgtactaagttttatgtgctgtattcttatttaattcttacgacaatgctagggg

SEQ ID NO: 93292 - DNA, 22 bp, Homo sapiens
  misc_feature 1..22: note = chr5:168614854-168614876
  misc_feature 1..22: note = hypo
  source 1..22: mol_type = genomic DNA
gctgcaacgataaattcttaaa

SEQ ID NO: 93293 - DNA, 573 bp, Homo sapiens
  misc_feature 1..573: note = chr5:168727355-168727928
  misc_feature 1..573: note = hyper
  source 1..573: mol_type = genomic DNA
tacagacccccagctcggagagtgagggatcgtatccaggaagggatgagaatagagactgcatccagggaggccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggc

SEQ ID NO: 93294 - DNA, 82 bp, Homo sapiens; identical to SEQ ID NO: 8166
  misc_feature 1..82: note = chr5:168727994-168728076
  misc_feature 1..82: note = hyper
  source 1..82: mol_type = genomic DNA

SEQ ID NO: 93295 - DNA, 276 bp, Homo sapiens; identical to SEQ ID NO: 30077
  misc_feature 1..276: note = chr5:168728077-168728353
  misc_feature 1..276: note = hyper
  source 1..276: mol_type = genomic DNA

SEQ ID NO: 93296 - DNA, 41 bp, Homo sapiens
  misc_feature 1..41: note = chr5:168728570-168728611
  misc_feature 1..41: note = hyper
  source 1..41: mol_type = genomic DNA
tgtcgcccacgaagccgcttccctaccgcacctagtactca

SEQ ID NO: 93297 - DNA, 30 bp, Homo sapiens
  misc_feature 1..30: note = chr5:168771979-168772009
  misc_feature 1..30: note = hypo
  source 1..30: mol_type = genomic DNA
acatatcccaggcaccggtggacagcaatc

SEQ ID NO: 93298 - DNA, 522 bp, Homo sapiens
  misc_feature 1..522: note = chr5:169064008-169064530
  misc_feature 1..522: note = hyper
  source 1..522: mol_type = genomic DNA
aactctctgcacttgcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 93299 - DNA, 274 bp, Homo sapiens; identical to SEQ ID NO: 2677
  misc_feature 1..274: note = chr5:169064531-169064805
  misc_feature 1..274: note = hyper
  source 1..274: mol_type = genomic DNA

SEQ ID NO: 93300 - DNA, 30 bp, Homo sapiens
  misc_feature 1..30: note = chr5:169127084-169127114
  misc_feature 1..30: note = hypo
  source 1..30: mol_type = genomic DNA
ggtggacaggaccaccgtggtggccaggaa

SEQ ID NO: 93301 - DNA, 102 bp, Homo sapiens
  misc_feature 1..102: note = chr5:169157436-169157538
  misc_feature 1..102: note = hypo
  source 1..102: mol_type = genomic DNA
gatgaatttggacagcgagtcagaggctaccatgcagggattattctaggcacattgcaaactgctcagaggggatttaactaaaaacgcttgtatggcagg

SEQ ID NO: 93302 - DNA, 30 bp, Homo sapiens
  misc_feature 1..30: note = chr5:169158556-169158586
  misc_feature 1..30: note = hypo
  source 1..30: mol_type = genomic DNA
tcagcaacacgaaaacggactaatacagac

SEQ ID NO: 93303 - DNA, 30 bp, Homo sapiens
  misc_feature 1..30: note = chr5:169165242-169165272
  misc_feature 1..30: note = hypo
  source 1..30: mol_type = genomic DNA
ggaaaatgctatgatcgcatctgtgttttt

SEQ ID NO: 93304 - DNA, 194 bp, Homo sapiens
  misc_feature 1..194: note = chr5:169323759-169323953
  misc_feature 1..194: note = hypo
  source 1..194: mol_type = genomic DNA
gatatagtccctacccgctgctcacagtgggtgtgggagtcgattgataatgtagaagaggataaatgtttataataaaatgcagatgccatagaactaaaagcaattagtagatgacagaagatgagaggtaaaaaataaagttaataaagaggagaaaaactgagcatcaactttgacgtgagcttcctagt

SEQ ID NO: 93305 - DNA, 30 bp, Homo sapiens; identical to SEQ ID NO: 29492
  misc_feature 1..30: note = chr5:16934552-16934582
  misc_feature 1..30: note = hyper
  source 1..30: mol_type = genomic DNA

SEQ ID NO: 93306 - DNA, 61 bp, Homo sapiens
  misc_feature 1..61: note = chr5:16935556-16935617
  misc_feature 1..61: note = hyper
  source 1..61: mol_type = genomic DNA
gggcagtcgagcgggcggatcgccccgcccgcgccccggcgcgcgccgcctcacctggcgc

SEQ ID NO: 93307 - DNA, 438 bp, Homo sapiens
  misc_feature 1..438: note = chr5:16935883-16936321
  misc_feature 1..438: note = hyper
  source 1..438: mol_type = genomic DNA
ggagcgcacttacctcggtgaagaagttatccattgttccagcgcagtcccggactcgccgagtgccgctccgactcgcggaagtcagcgccgccgcgggtccggggaaaccatgcgtgtcacggcgccactcccgaggacgcgcgcccgcggggctcccctgctgccatcgcccggtcccttcttgtccttctcaccttttgttcgcccaaacccaagtccctaactcgcccgtcccgacggcagcctttgtctcttcttcctccaagttcctcactactgggcgcagcgctcgcaagcggagaacagctggtggcacattcttcccccaggcgggggaaggcggcggggtgctggcgagcgcggccccctccctctgcgctccggccgggggccctcggggcgggcaggaggacagcgggccgcaaagtgagcagg

SEQ ID NO: 93308 - DNA, 249 bp, Homo sapiens
  misc_feature 1..249: note = chr5:16936584-16936833
  misc_feature 1..249: note = hyper
  source 1..249: mol_type = genomic DNA
ccgcaggctcgttagcggacccgggagggggccgcgtgtttccccaggtcttcccacgtaggcgtggggaggggatttaactcttccctctgcagagagagactaaacaatcacttagaggggaggagaagggactgggggcttctgtgcctttcatgtttagcagacccgggaaccggctcaacacggatctcattaatgcagcccggtagactagcaatctcgggaaggaagcgcggtcagcggagc

SEQ ID NO: 93309 - DNA, 223 bp, Homo sapiens
  misc_feature 1..223: note = chr5:169532899-169533122
  misc_feature 1..223: note = hypo
  source 1..223: mol_type = genomic DNA
tgtcaggggcagctccggggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcga

SEQ ID NO: 93310 - DNA, 175 bp, Homo sapiens
  misc_feature 1..175: note = chr5:169655548-169655723
  misc_feature 1..175: note = hypo
  source 1..175: mol_type = genomic DNA
ctgcagagtctgagacgctgtgctttaaagtgattgatgtatcatgctgagaaatcacctgacaggggttaaaattatgactaggctaaataaataatcacgaagaaataaatctcattatcattaatgttaataatccttgtaaacattttcgtagatacgcttccaaatttgc

SEQ ID NO: 93311 - DNA, 143 bp, Homo sapiens; identical to SEQ ID NO: 40633
  misc_feature 1..143: note = chr5:169658356-169658499
  misc_feature 1..143: note = hypo
  source 1..143: mol_type = genomic DNA

SEQ ID NO: 93312 - DNA, 51 bp, Homo sapiens; identical to SEQ ID NO: 40634
  misc_feature 1..51: note = chr5:169660169-169660220
  misc_feature 1..51: note = hypo
  source 1..51: mol_type = genomic DNA

SEQ ID NO: 93313 - DNA, 96 bp, Homo sapiens
  misc_feature 1..96: note = chr5:169660603-169660699
  misc_feature 1..96: note = hypo
  source 1..96: mol_type = genomic DNA
caggccttgagtcagcgacatcctggcttctgaccccccattcctatggcccctacagtctggtctccgcttccccactcccggtgaattgctgtt

SEQ ID NO: 93314 - DNA, 40 bp, Homo sapiens
  misc_feature 1..40: note = chr5:169866477-169866517
  misc_feature 1..40: note = hypo
  source 1..40: mol_type = genomic DNA
tgtgggggacgggggcgggggggtgcggagcttggcacca

SEQ ID NO: 93315 - DNA, 154 bp, Homo sapiens
  misc_feature 1..154: note = chr5:169877679-169877833
  misc_feature 1..154: note = hypo
  source 1..154: mol_type = genomic DNA
tgctccgaccacctccgccccgatccccagaaacagtttcccccttctctttctctggccaacttctatcggttttcagaatgtctcccctggccacgcaggatcccttccattttgaggctgataaaatcctgcggatcgcaagctgagcgct

SEQ ID NO: 93316 - DNA, 82 bp, Homo sapiens
  misc_feature 1..82: note = chr5:169930863-169930945
  misc_feature 1..82: note = hyper
  source 1..82: mol_type = genomic DNA
tgctcccggggctcccgcacataccccggcagatgagggtgcgcaggggtgagggcgcagggctgggcgtcccccgccccca

SEQ ID NO: 93317 - DNA, 104 bp, Homo sapiens; identical to SEQ ID NO: 30082
  misc_feature 1..104: note = chr5:169931223-169931327
  misc_feature 1..104: note = hyper
  source 1..104: mol_type = genomic DNA

SEQ ID NO: 93318 - DNA, 131 bp, Homo sapiens; identical to SEQ ID NO: 30083
  misc_feature 1..131: note = chr5:169931353-169931484
  misc_feature 1..131: note = hyper
  source 1..131: mol_type = genomic DNA

SEQ ID NO: 93319 - DNA, 30 bp, Homo sapiens; identical to SEQ ID NO: 40635
  misc_feature 1..30: note = chr5:169932029-169932059
  misc_feature 1..30: note = hypo
  source 1..30: mol_type = genomic DNA

SEQ ID NO: 93320 - DNA, 30 bp, Homo sapiens
  misc_feature 1..30: note = chr5:170028243-170028273
  misc_feature 1..30: note = hypo
  source 1..30: mol_type = genomic DNA
ggctgggagtcacagcggtgtagaggagaa

SEQ ID NO: 93321 - DNA, 483 bp, Homo sapiens; identical to SEQ ID NO: 30084
  misc_feature 1..483: note = chr5:170107959-170108442
  misc_feature 1..483: note = hyper
  source 1..483: mol_type = genomic DNA

SEQ ID NO: 93322 - DNA, 41 bp, Homo sapiens
  misc_feature 1..41: note = chr5:170171099-170171140
  misc_feature 1..41: note = hyper
  source 1..41: mol_type = genomic DNA
ctgtcagaggtgggccgggggaaacgcgggcaggagaaggg

SEQ ID NO: 93323 - DNA, 30 bp, Homo sapiens
  misc_feature 1..30: note = chr5:170171383-170171413
  misc_feature 1..30: note = hyper
  source 1..30: mol_type = genomic DNA
ggtgcctccagagaccgcaagagaacagct

SEQ ID NO: 93324 - DNA, 32 bp, Homo sapiens
  misc_feature 1..32: note = chr5:170289702-170289734
  misc_feature 1..32: note = hyper
  source 1..32: mol_type = genomic DNA
gctacgaagatgggacgcgtgcttgtatatcc

SEQ ID NO: 93325 - DNA, 42 bp, Homo sapiens
  misc_feature 1..42: note = chr5:1704607-1704649
  misc_feature 1..42: note = hypo
  source 1..42: mol_type = genomic DNA
gattgtgggccgatccggctccagccccgtgaaggtgcaatg

SEQ ID NO: 93326 - DNA, 30 bp, Homo sapiens
  misc_feature 1..30: note = chr5:170675080-170675110
  misc_feature 1..30: note = hypo
  source 1..30: mol_type = genomic DNA
cacaggaaggctgggcgcgttggctaacgc

SEQ ID NO: 93327 - DNA, 35 bp, Homo sapiens
  misc_feature 1..35: note = chr5:170687481-170687516
  misc_feature 1..35: note = hypo
  source 1..35: mol_type = genomic DNA
aaagagatagataacagagacgaaaaggtgagtgg

SEQ ID NO: 93328 - DNA, 21 bp, Homo sapiens
  misc_feature 1..21: note = chr5:170717082-170717103
  misc_feature 1..21: note = hypo
  source 1..21: mol_type = genomic DNA
atgactcgggccagacgcagt

SEQ ID NO: 93329 - DNA, 60 bp, Homo sapiens
  misc_feature 1..60: note = chr5:170733836-170733896
  misc_feature 1..60: note = hyper
  source 1..60: mol_type = genomic DNA
gcgctgtgccacccacgccttaattctgtgccacaaacctctgtgcggtgggccttgttg

SEQ ID NO: 93330 - DNA, 222 bp, Homo sapiens
  misc_feature 1..222: note = chr5:170735099-170735321
  misc_feature 1..222: note = hyper
  source 1..222: mol_type = genomic DNA
agagtttgcacctaacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcc

SEQ ID NO: 93331 - DNA, 434 bp, Homo sapiens
  misc_feature 1..434: note = chr5:170735730-170736164
  misc_feature 1..434: note = hyper
  source 1..434: mol_type = genomic DNA
cggtagcgtccaaggggcttctgcggattccgccgggtcgtcccggggttgcaactccattgtacctgaaaggatgcatttggtttggcttttgctcagatgaaaaaaaaaaaaaattggaagaaaacgaaaacccactcagcaaaagacaatttcacaagcggagcgctctacccacccagcgcggtgtctgggaagcggcccggcccggaggagcggggagcgtctgctaattgcagcttcgttagatttcgggtttgggaggctgtggttcgggctctaatatccgccgcccattatccctgctaataaatttgacctattgttcgtttgttaaaatgatgtcaccttggaacagtccctaagctcctatttccatgaattaggcctttattgaaagccgggagccaatgagaggagagaggcttgttgat

SEQ ID NO: 93332 - DNA, 116 bp, Homo sapiens; identical to SEQ ID NO: 496
  misc_feature 1..116: note = chr5:170736715-170736831
  misc_feature 1..116: note = hyper
  source 1..116: mol_type = genomic DNA

SEQ ID NO: 93333 - DNA, 437 bp, Homo sapiens
  misc_feature 1..437: note = chr5:170737281-170737718
  misc_feature 1..437: note = hyper
  source 1..437: mol_type = genomic DNA
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccaccc

SEQ ID NO: 93334 - DNA, 86 bp, Homo sapiens
  misc_feature 1..86: note = chr5:170737778-170737864
  misc_feature 1..86: note = hyper
  source 1..86: mol_type = genomic DNA
gcactctccttctcctccttcttccagcccgccctctcggattttcaacaatcctcgtggacgccggtttcctctccccccatctc

SEQ ID NO: 93335 - DNA, 755 bp, Homo sapiens; identical to SEQ ID NO: 499
  misc_feature 1..755: note = chr5:170737935-170738690
  misc_feature 1..755: note = hyper
  source 1..755: mol_type = genomic DNA

SEQ ID NO: 93336 - DNA, 1154 bp, Homo sapiens
  misc_feature 1..1154: note = chr5:170738823-170739977
  misc_feature 1..1154: note = hyper
  source 1..1154: mol_type = genomic DNA
cgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttccagtcacatctaacacacaaagcccgtgaacacttcctc

SEQ ID NO: 93337 - DNA, 139 bp, Homo sapiens
  misc_feature 1..139: note = chr5:170740191-170740330
  misc_feature 1..139: note = hyper
  source 1..139: mol_type = genomic DNA
agccttttcttgttccgtcgtctcctccttcttctctccccagttctgactcttggcctctgtgtgtctctgggtttctttgtctccctcctctccacggtcctcttgtccttttgtcttccctttcttgtttcttgaa

SEQ ID NO: 93338 - DNA, 88 bp, Homo sapiens
  misc_feature 1..88: note = chr5:170740390-170740478
  misc_feature 1..88: note = hyper
  source 1..88: mol_type = genomic DNA
tctcttctttcctttctccctgactccctctctccctcttccaggcccagctcccagtagctcctaaggcaaaacactttcggggccg

SEQ ID NO: 93339 - DNA, 99 bp, Homo sapiens; identical to SEQ ID NO: 2686
  misc_feature 1..99: note = chr5:170740574-170740673
  misc_feature 1..99: note = hyper
  source 1..99: mol_type = genomic DNA

SEQ ID NO: 93340 - DNA, 376 bp, Homo sapiens
  misc_feature 1..376: note = chr5:170740674-170741050
  misc_feature 1..376: note = hyper
  source 1..376: mol_type = genomic DNA
ctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttcttaattgtttttatttcaacgcgcttttggggaacagatggtcagg

SEQ ID NO: 93341 - DNA, 806 bp, Homo sapiens
  misc_feature 1..806: note = chr5:170741470-170742276
  misc_feature 1..806: note = hyper
  source 1..806: mol_type = genomic DNA
ggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcc

SEQ ID NO: 93342 - DNA, 214 bp, Homo sapiens; identical to SEQ ID NO: 30097
  misc_feature 1..214: note = chr5:170742386-170742600
  misc_feature 1..214: note = hyper
  source 1..214: mol_type = genomic DNA

SEQ ID NO: 93343 - DNA, 178 bp, Homo sapiens
  misc_feature 1..178: note = chr5:170742672-170742850
  misc_feature 1..178: note = hyper
  source 1..178: mol_type = genomic DNA
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggct

SEQ ID NO: 93344 - DNA, 330 bp, Homo sapiens
  misc_feature 1..330: note = chr5:170743150-170743480
  misc_feature 1..330: note = hyper
  source 1..330: mol_type = genomic DNA
caaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 93345 - DNA, 482 bp, Homo sapiens; identical to SEQ ID NO: 504
  misc_feature 1..482: note = chr5:170743646-170744128
  misc_feature 1..482: note = hyper
  source 1..482: mol_type = genomic DNA

SEQ ID NO: 93346 - DNA, 187 bp, Homo sapiens
  misc_feature 1..187: note = chr5:170744375-170744562
  misc_feature 1..187: note = hyper
  source 1..187: mol_type = genomic DNA
ttgtcctctggtcaccggtagtagagacagtcgcacagtcatctgggaaacttggcctggctccatctgcctagacttatcagtgtcctggtattaccctgaggttagtggccatcacaccagttgaaacgaatgtcgttgctctgtcagacccgctgccaattaatgagttcgttattcaacccct

SEQ ID NO: 93347 - DNA, 381 bp, Homo sapiens
  misc_feature 1..381: note = chr5:170745099-170745480
  misc_feature 1..381: note = hyper
  source 1..381: mol_type = genomic DNA
agcaccctttgcctccgtcccccatccaggaaaaatccacttcttcctccagccagcagagactcagccaacaagaggaatgcagagcactccagagaagaacagagaactgcccttccccccgcccccaccacccccagtcagggaggtagccctccattggtcctagggggcgaggtccgccctgaggcaggagaagttggtgttgagctcaggggccgatggtgattatccagcatgcgaagctgccttgcatttgcatccactgttcaggtgctacagctggggcacttttgttcctgggacgtagtgagactaagaagaaggggaggggagagcagagagggaacgcaaccccggggaagacgccaagagagggtg

SEQ ID NO: 93348 - DNA, 30 bp, Homo sapiens
  misc_feature 1..30: note = chr5:170749758-170749788
  misc_feature 1..30: note = hypo
  source 1..30: mol_type = genomic DNA
ttacgcacattaaagcgctctttaaattct

SEQ ID NO: 93349 - DNA, 30 bp, Homo sapiens
  misc_feature 1..30: note = chr5:170763990-170764020
  misc_feature 1..30: note = hyper
  source 1..30: mol_type = genomic DNA
cccagcaccatattacgcaaacaaaatgat

SEQ ID NO: 93350 - DNA, 30 bp, Homo sapiens
  misc_feature 1..30: note = chr5:170786850-170786880
  misc_feature 1..30: note = hypo
  source 1..30: mol_type = genomic DNA
tgttttcatgcatcccgtgtctggggacat

SEQ ID NO: 93351 - DNA, 41 bp, Homo sapiens; identical to SEQ ID NO: 40636
  misc_feature 1..41: note = chr5:170811632-170811673
  misc_feature 1..41: note = hypo
  source 1..41: mol_type = genomic DNA

SEQ ID NO: 93352 - DNA, 23 bp, Homo sapiens
  misc_feature 1..23: note = chr5:170813569-170813592
  misc_feature 1..23: note = hypo
  source 1..23: mol_type = genomic DNA
caacacagcgagactctgtctcc

SEQ ID NO: 93353 - DNA, 109 bp, Homo sapiens
  misc_feature 1..109: note = chr5:170847266-170847375
  misc_feature 1..109: note = hyper
  source 1..109: mol_type = genomic DNA
gcctggctgtctgtccgtatgcctgtgccctgtacctctgtctgcccgcccgtcggttcacctgactcttcgactgcgtgtctgtctgtccgtgcgcccccttcctcag

SEQ ID NO: 93354 - DNA, 27 bp, Homo sapiens
  misc_feature 1..27: note = chr5:170847717-170847744
  misc_feature 1..27: note = hyper
  source 1..27: mol_type = genomic DNA
ggcgggctcagccgcaacaatataccc

SEQ ID NO: 93355 - skipped

SEQ ID NO: 93356 - DNA, 71 bp, Homo sapiens; identical to SEQ ID NO: 40637
  misc_feature 1..71: note = chr5:170919575-170919646
  misc_feature 1..71: note = hypo
  source 1..71: mol_type = genomic DNA

SEQ ID NO: 93357 - DNA, 143 bp, Homo sapiens
  misc_feature 1..143: note = chr5:171021838-171021981
  misc_feature 1..143: note = hypo
  source 1..143: mol_type = genomic DNA
gatgataaacatcagcgttgattaaatctcagtggtagatcaatggatgtcacactattttctttacttttaagtatgtttgaaatattttataataaaaataaagcaagcaagctttggagaaatcagagatgtaagagtcc

SEQ ID NO: 93358 - DNA, 30 bp, Homo sapiens
  misc_feature 1..30: note = chr5:171239105-171239135
  misc_feature 1..30: note = hypo
  source 1..30: mol_type = genomic DNA
cagaaacctcttcctcgatttttctactgg

SEQ ID NO: 93359 - DNA, 66 bp, Homo sapiens; identical to SEQ ID NO: 40638
  misc_feature 1..66: note = chr5:171247586-171247652
  misc_feature 1..66: note = hypo
  source 1..66: mol_type = genomic DNA

SEQ ID NO: 93360 - DNA, 30 bp, Homo sapiens
  misc_feature 1..30: note = chr5:171263972-171264002
  misc_feature 1..30: note = hypo
  source 1..30: mol_type = genomic DNA
ctacactgtggcacacgtctgtggtcccag

SEQ ID NO: 93361 - DNA, 83 bp, Homo sapiens
  misc_feature 1..83: note = chr5:171382147-171382230
  misc_feature 1..83: note = hypo
  source 1..83: mol_type = genomic DNA
gatggtagaaacttccggaatgggtaaattatgcctaagggcaactactatcttccctccggctttttcgaaaggtaaactaa

SEQ ID NO: 93362 - DNA, 39 bp, Homo sapiens; identical to SEQ ID NO: 40639
  misc_feature 1..39: note = chr5:171533619-171533658
  misc_feature 1..39: note = hypo
  source 1..39: mol_type = genomic DNA

SEQ ID NO: 93363 - DNA, 76 bp, Homo sapiens
  misc_feature 1..76: note = chr5:171708301-171708377
  misc_feature 1..76: note = hypo
  source 1..76: mol_type = genomic DNA
ttcagattaaaaacacggcaaaacccacctctactaaaaattttttaaaaattagccgggtgcggtggcatgcacc

SEQ ID NO: 93364 - DNA, 151 bp, Homo sapiens
  misc_feature 1..151: note = chr5:17203026-17203177
  misc_feature 1..151: note = hypo
  source 1..151: mol_type = genomic DNA
gcgtgagccaccgcgcccggctgggagttcttttttttttactgttggtgatgacaggactgtgaagcagtgggaattggagggctcaggctatggagaaggggaagtccttttgcatatggtattaagaaggcggcggacactgggactg

SEQ ID NO: 93365 - DNA, 30 bp, Homo sapiens
  misc_feature 1..30: note = chr5:172074582-172074612
  misc_feature 1..30: note = hypo
  source 1..30: mol_type = genomic DNA
gctgccccttgtcctcgtcctgagcacctg

SEQ ID NO: 93366 - DNA, 475 bp, Homo sapiens
  misc_feature 1..475: note = chr5:17216663-17217138
  misc_feature 1..475: note = hyper
  source 1..475: mol_type = genomic DNA
gctcgcaagcagcagcgtgcgggctgcctcggccaaccccgtcttctcaatattggtggcctccattaaagcacagacatcaaaaacatcgacggcccctttcccctcttctcttccctccttcctctcccaagttccgagagcatcctccgaggggcgacgtctctcgccccaccagctggacctcggcgaccgcgcctcccccgaagctgcagccttcggggctgagccccgcgggtgcgggtgcaggtgcggagccgcccaaggtgcgcaactcgtttgcagcggcgcagcccagacgcgcctgcagctggggctcaccccaacctcgctgccagccgaggtagcggaatcgtagtcgacgtcgggagcgggctggactggggtctgagaagggtagctggtgccagggggtgtcattcatcacctcgaggcagctccctaagtctgagcgagagcccgagcacttcttatc

SEQ ID NO: 93367 - DNA, 184 bp, Homo sapiens; identical to SEQ ID NO: 29496
  misc_feature 1..184: note = chr5:17217681-17217865
  misc_feature 1..184: note = hyper
  source 1..184: mol_type = genomic DNA

SEQ ID NO: 93368 - DNA, 943 bp, Homo sapiens; identical to SEQ ID NO: 29497
  misc_feature 1..943: note = chr5:17217991-17218934
  misc_feature 1..943: note = hyper
  source 1..943: mol_type = genomic DNA

SEQ ID NO: 93369 - DNA, 30 bp, Homo sapiens
  misc_feature 1..30: note = chr5:172189170-172189200
  misc_feature 1..30: note = hypo
  source 1..30: mol_type = genomic DNA
gggattcagtctcatcgatttcatgatttt

SEQ ID NO: 93370 - DNA, 234 bp, Homo sapiens; identical to SEQ ID NO: 29498
  misc_feature 1..234: note = chr5:17218985-17219219
  misc_feature 1..234: note = hyper
  source 1..234: mol_type = genomic DNA

SEQ ID NO: 93371 - DNA, 30 bp, Homo sapiens
  misc_feature 1..30: note = chr5:172204547-172204577
  misc_feature 1..30: note = hyper
  source 1..30: mol_type = genomic DNA
gcccaggagagggaccgggaacagcagggc

SEQ ID NO: 93372 - DNA, 120 bp, Homo sapiens
  misc_feature 1..120: note = chr5:172235653-172235773
  misc_feature 1..120: note = hypo
  source 1..120: mol_type = genomic DNA
ttcatgccattctcctgcctcagccaccacgcccagcccctaaattctttttttatttgatttttgttttgttttgttttcttttcttttcccagatggggtatcgctgtgttgtccagg

SEQ ID NO: 93373 - DNA, 36 bp, Homo sapiens
  misc_feature 1..36: note = chr5:172384947-172384983
  misc_feature 1..36: note = hypo
  source 1..36: mol_type = genomic DNA
taactgtgaagggcccggaataaaacctagtattag

SEQ ID NO: 93374 - DNA, 96 bp, Homo sapiens
  misc_feature 1..96: note = chr5:172385283-172385379
  misc_feature 1..96: note = hypo
  source 1..96: mol_type = genomic DNA
aaaatctagtattagtaaacgcaggtgtttaacaatgtcaccactacatgtcagggaacactgataaactaagagagagcacgggacctgcctggg

SEQ ID NO: 93375 - DNA, 157 bp, Homo sapiens
  misc_feature 1..157: note = chr5:172386958-172387115
  misc_feature 1..157: note = hyper
  source 1..157: mol_type = genomic DNA
agatcatgtcatccccgctctccaaggagctgcggcagaagtacaatgtccgctccatgcccatccgcaaggacgacgaggtccaggtacgtctccctccggcgctagtggcgctcggacaccgttgcctaagaacgtcatgcgtggagcagtcaca

SEQ ID NO: 93376 - DNA, 736 bp, Homo sapiens; identical to SEQ ID NO: 30104
  misc_feature 1..736: note = chr5:172655825-172656561
  misc_feature 1..736: note = hyper
  source 1..736: mol_type = genomic DNA

SEQ ID NO: 93377 - DNA, 634 bp, Homo sapiens
  misc_feature 1..634: note = chr5:172659392-172660026
  misc_feature 1..634: note = hyper
  source 1..634: mol_type = genomic DNA
acaaactctcccgtgcgcaagaacaaacgcgcgtgggacagaaaaagttcctaggtctccgcaggagtgaatgcaaaatccaggggactcagggtcatgttgggagccccttctccccccgagagtcagggagctgttgaggtgggatcggtcagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 93378 - DNA, 113 bp, Homo sapiens; identical to SEQ ID NO: 30106
  misc_feature 1..113: note = chr5:172660141-172660254
  misc_feature 1..113: note = hyper
  source 1..113: mol_type = genomic DNA

SEQ ID NO: 93379 - DNA, 39 bp, Homo sapiens
  misc_feature 1..39: note = chr5:172660469-172660508
  misc_feature 1..39: note = hyper
  source 1..39: mol_type = genomic DNA
ggtgagggagacagacggtgacttaaaatttcaggctgc

SEQ ID NO: 93380 - DNA, 433 bp, Homo sapiens
  misc_feature 1..433: note = chr5:172660568-172661001
  misc_feature 1..433: note = hyper
  source 1..433: mol_type = genomic DNA
gggtgaactgaattagggctagtttggtttgagaagttaaatgaacagaggccgaggcctcactgctagggacggtcttatctcaaaattaaggaatcaagaaacagaaggccagggagtgttggtttggtgatcggaggctccagcctggccgcagcagggtttgcgcagtgtccaagaagctgcgggtgggcaggcggcctcggaacctgccttgctggcttcctcgaattggtagcgatcagttctagccgccgtgcccgcccgaatttgttcccaggcctctgctcctcaacaaacctatgaattctctcccggctggcagcggcccttcgcccagcgcttcgcccagcgcctgcggcctcccgggaatcgcccgggctcctgccttgggctggggggtctcccagaaggcccctttctgcagcggggc

SEQ ID NO: 93381 - DNA, 20 bp, Homo sapiens
  misc_feature 1..20: note = chr5:172661126-172661146
  misc_feature 1..20: note = hyper
  source 1..20: mol_type = genomic DNA
cgcgccggcaagttgtgctg

SEQ ID NO: 93382 - DNA, 856 bp, Homo sapiens; identical to SEQ ID NO: 30109
  misc_feature 1..856: note = chr5:172661471-172662327
  misc_feature 1..856: note = hyper
  source 1..856: mol_type = genomic DNA

SEQ ID NO: 93383 - DNA, 30 bp, Homo sapiens
  misc_feature 1..30: note = chr5:172663838-172663868
  misc_feature 1..30: note = hyper
  source 1..30: mol_type = genomic DNA
ttgggtgctcaaacccgacagtgtgccgtc

SEQ ID NO: 93384 - DNA, 387 bp, Homo sapiens; identical to SEQ ID NO: 30110
  misc_feature 1..387: note = chr5:172664210-172664597
  misc_feature 1..387: note = hyper
  source 1..387: mol_type = genomic DNA

SEQ ID NO: 93385 - DNA, 501 bp, Homo sapiens
  misc_feature 1..501: note = chr5:172665448-172665949
  misc_feature 1..501: note = hyper
  source 1..501: mol_type = genomic DNA
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgtttatattttgggaagaatcgcaactcgtgggagtccccggctggccccctgataaatgaacattagcactttttcggactactgtatcaacaaaggggctgcggcgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttcctggccgggagttgggggcggggggcgactctgagggccgccgacctcgcccttggctccggaagagtccaggcggcctccgcggcac

SEQ ID NO: 93386 - DNA, 30 bp, Homo sapiens
  misc_feature 1..30: note = chr5:1726678-1726708
  misc_feature 1..30: note = hypo
  source 1..30: mol_type = genomic DNA
tcattggggtggccccgatttgctaggtct

SEQ ID NO: 93387 - DNA, 408 bp, Homo sapiens
  misc_feature 1..408: note = chr5:172670755-172671163
  misc_feature 1..408: note = hyper
  source 1..408: mol_type = genomic DNA
gtatgtttcccaacccgaatttgtcctggattagtggatatgatccgctttcaaactagtgttagggtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagtgaagaggaaaatggttgtcctggggctggttcgcgcctgcccggcgggtgtgaagcccggggaac

SEQ ID NO: 93388 - DNA, 237 bp, Homo sapiens
  misc_feature 1..237: note = chr5:172671245-172671482
  misc_feature 1..237: note = hyper
  source 1..237: mol_type = genomic DNA
cgcgggggaccagccgggccgacggcagcgctgcgggtgggttgggtcgtcggccgccgctccccggagaggtgaagagtcgcacctaccaccgggcagcctccgcggctctggccgaaaccccggctggccgcagctccgggagcccccagccctgtgctgctgcggccggctcagtgctgaattgatgctggaaacggctggccagcgggcctagggtcgccgcctttccctcct

SEQ ID NO: 93389 - DNA, 198 bp, Homo sapiens
  misc_feature 1..198: note = chr5:172671639-172671837
  misc_feature 1..198: note = hyper
  source 1..198: mol_type = genomic DNA
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacacgaaacgagcgcgctagaaagggtcgtgttgacacatcc

SEQ ID NO: 93390 - DNA, 40 bp, Homo sapiens
  misc_feature 1..40: note = chr5:172672286-172672326
  misc_feature 1..40: note = hyper
  source 1..40: mol_type = genomic DNA
cgcccggcctgatgtgctttaaattcgctaaaacgacacg

SEQ ID NO: 93391 - DNA, 225 bp, Homo sapiens
  misc_feature 1..225: note = chr5:172672668-172672893
  misc_feature 1..225: note = hyper
  source 1..225: mol_type = genomic DNA
ctccgcgtttcctgtcgggagaggagtatcagcgcgcgcaccaaatctgctctggtatgtcaccttatctctcgtccccgctgttgtccccaaacgccgcctgtcaaaggagacgccacccgcattaggacctagactggggcccttccgctcggggtcaggcgcagcgccctcggcttgggccccgccgcccctttaggggtccgggagggtggagagaagggg

SEQ ID NO: 93392 - DNA, 156 bp, Homo sapiens
  misc_feature 1..156: note = chr5:172672960-172673116
  misc_feature 1..156: note = hyper
  source 1..156: mol_type = genomic DNA
cgctgaaaccggcccatctgggagaaatattagggcgcatgtctctcccggagggcttccttttttttttttttcctaaccacgaaaatagggaatctttgttacaggctagttgtgagcgaatcctcctttgtccgcgtccggaggaaaatcagg

SEQ ID NO: 93393 - DNA, 30 bp, Homo sapiens
  misc_feature 1..30: note = chr5:172695117-172695147
  misc_feature 1..30: note = hypo
  source 1..30: mol_type = genomic DNA
ttagggtcctcacgtcgtagctcagcccaa

SEQ ID NO: 93394 - DNA, 205 bp, Homo sapiens
  misc_feature 1..205: note = chr5:172704334-172704539
  misc_feature 1..205: note = hypo
  source 1..205: mol_type = genomic DNA
tcaatctctatctcacgtgagcactcgatgcctcctatttctgagccttttctggggctctgtagaacaatttgtgggccctgccacccaaccctgaagacgcttgtgtttgccttgctacttctccgctgagtcatttacatttttccagtgctttttatctttctatgttggaattaagcgttatagacgccacgcctcctgg

SEQ ID NO: 93395 - DNA, 109 bp, Homo sapiens; identical to SEQ ID NO: 30117
  misc_feature 1..109: note = chr5:172710849-172710958
  misc_feature 1..109: note = hyper
  source 1..109: mol_type = genomic DNA

SEQ ID NO: 93396 - DNA, 30 bp, Homo sapiens
  misc_feature 1..30: note = chr5:172726483-172726513
  misc_feature 1..30: note = hypo
  source 1..30: mol_type = genomic DNA
ccgtctgtcttgctccgagcgccactctga

SEQ ID NO: 93397 - DNA, 877 bp, Homo sapiens
  misc_feature 1..877: note = chr5:172754086-172754963
  misc_feature 1..877: note = hyper
  source 1..877: mol_type = genomic DNA
cccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcc

SEQ ID NO: 93398 - DNA, 393 bp, Homo sapiens
  misc_feature 1..393: note = chr5:172754985-172755378
  misc_feature 1..393: note = hyper
  source 1..393: mol_type = genomic DNA
cgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctc

SEQ ID NO: 93399 - DNA, 143 bp, Homo sapiens; identical to SEQ ID NO: 30120
  misc_feature 1..143: note = chr5:172755420-172755563
  misc_feature 1..143: note = hyper
  source 1..143: mol_type = genomic DNA

SEQ ID NO: 93400 - DNA, 69 bp, Homo sapiens; identical to SEQ ID NO: 8207
  misc_feature 1..69: note = chr5:172755594-172755663
  misc_feature 1..69: note = hyper
  source 1..69: mol_type = genomic DNA

SEQ ID NO: 93401 - DNA, 32 bp, Homo sapiens
  misc_feature 1..32: note = chr5:17275585-17275617
  misc_feature 1..32: note = hypo
  source 1..32: mol_type = genomic DNA
cgagaagacggagggcgcggcagaggccaagg

SEQ ID NO: 93402 - DNA, 845 bp, Homo sapiens; identical to SEQ ID NO: 30122
  misc_feature 1..845: note = chr5:172756377-172757222
  misc_feature 1..845: note = hyper
  source 1..845: mol_type = genomic DNA

SEQ ID NO: 93403 - DNA, 30 bp, Homo sapiens
  misc_feature 1..30: note = chr5:17276405-17276435
  misc_feature 1..30: note = hypo
  source 1..30: mol_type = genomic DNA
gagttgggagtgatgcgtttgattctgccc

SEQ ID NO: 93404 - DNA, 71 bp, Homo sapiens
  misc_feature 1..71: note = chr5:1729815-1729886
  misc_feature 1..71: note = hypo
  source 1..71: mol_type = genomic DNA
cgagtctccaagtgccgcgtgagcgagggtgggtggctggagctcccgggccagcccgggcggaggcgctg

SEQ ID NO: 93405 - DNA, 36 bp, Homo sapiens
  misc_feature 1..36: note = chr5:172997890-172997926
  misc_feature 1..36: note = hypo
  source 1..36: mol_type = genomic DNA
gtgacatgccacctgcggcctcggctctcctgcaca

SEQ ID NO: 93406 - DNA, 36 bp, Homo sapiens
  misc_feature 1..36: note = chr5:1730216-1730252
  misc_feature 1..36: note = hypo
  source 1..36: mol_type = genomic DNA
tggtggagggtgccccggctccgaagggctcctgag

SEQ ID NO: 93407 - DNA, 101 bp, Homo sapiens
  misc_feature 1..101: note = chr5:17311107-17311208
  misc_feature 1..101: note = hypo
  source 1..101: mol_type = genomic DNA
ggcgtgagccacttcgcctagcctgatgcaaacttttgaagaaactaaatactgtattcaaaaaaaattataaaggctactaggatcgtaagtgcatcgtt

SEQ ID NO: 93408 - DNA, 30 bp, Homo sapiens
  misc_feature 1..30: note = chr5:17312415-17312445
  misc_feature 1..30: note = hypo
  source 1..30: mol_type = genomic DNA
tgaggactgctagcacgctgtcacctctca

SEQ ID NO: 93409 - DNA, 30 bp, Homo sapiens
  misc_feature 1..30: note = chr5:173165886-173165916
  misc_feature 1..30: note = hypo
  source 1..30: mol_type = genomic DNA
aatcctttttgtgtccggagaaaaagtcag

SEQ ID NO: 93410 - DNA, 156 bp, Homo sapiens
  misc_feature 1..156: note = chr5:17327398-17327554
  misc_feature 1..156: note = hypo
  source 1..156: mol_type = genomic DNA
agctgaaggtgtcagcggaggcggggggggctggggtgggtggggaatcttatagaagctgaaattgcaggagcgaagagctagtgttgacaatgtgagctcggcattaacacaacccaggtcagttccccttagaggccgcgttagagcatttgg

SEQ ID NO: 93411 - DNA, 30 bp, Homo sapiens
  misc_feature 1..30: note = chr5:173397062-173397092
  misc_feature 1..30: note = hypo
  source 1..30: mol_type = genomic DNA
cagacctgggagtaacgctgtcagaatgag

SEQ ID NO: 93412 - DNA, 515 bp, Homo sapiens
  misc_feature 1..515: note = chr5:173738828-173739343
  misc_feature 1..515: note = hyper
  source 1..515: mol_type = genomic DNA
actttcaccgcagagcgggggctgctggaggggcgggtgggctgcggcccggcggcggcggatgcctgtctctgccgaagccgaaggaaggctgcgtgggcagatcttccagctaggcccagagggacggccgacattcaacccgccagtcaaaggagggaagggctggcggcaggagcagctcaggaggcagacccgggcgcgcgggggcgcgggggctcgggggcctgtgagggatccccggacgggcagctgcggggtgcgggccgggctgcaccgcgacaaaggcggcccagcggcggcatcggaggacgcacgctgccccctggtggccaggccgctccccgcaaacgcgagctcctttgttttgcggtcccggcttctgcggcccaggcttgctggagagagtctgaagccccggcttccagagcgggtggccacgatgccagggccgcgcagggaacctggtgagccgagggtcgagtcccagccctgcagctcgctggcggcaaggg

SEQ ID NO: 93413 - DNA, 30 bp, Homo sapiens
  misc_feature 1..30: note = chr5:173846564-173846594
  misc_feature 1..30: note = hyper
  source 1..30: mol_type = genomic DNA
tcactcatactattgcgcatgagacaggca

SEQ ID NO: 93414 - DNA, 39 bp, Homo sapiens
  misc_feature 1..39: note = chr5:173846846-173846885
  misc_feature 1..39: note = hyper
  source 1..39: mol_type = genomic DNA
aagcaatgcaagaaacggaagtttcgcattttctctcac

SEQ ID NO: 93415 - DNA, 30 bp, Homo sapiens; identical to SEQ ID NO: 40644
  misc_feature 1..30: note = chr5:174110957-174110987
  misc_feature 1..30: note = hypo
  source 1..30: mol_type = genomic DNA

SEQ ID NO: 93416 - DNA, 338 bp, Homo sapiens
  misc_feature 1..338: note = chr5:174115251-174115589
  misc_feature 1..338: note = hyper
  source 1..338: mol_type = genomic DNA
gttatttaagaggaacgaagactgagcctcagggtctaggagtaacttataggggcttcttgtacttatggatagaaaatacatggataaatagagatattaaaggaagggatgccctaccctcccgaaagaaataaaaatgtgatcactctcggcaccgtagtctctgatgagaacatttaatcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 93417 - DNA, 30 bp, Homo sapiens
  misc_feature 1..30: note = chr5:174115938-174115968
  misc_feature 1..30: note = hyper
  source 1..30: mol_type = genomic DNA
cacggagggtcaccacgtccgttttattga

SEQ ID NO: 93418 - DNA, 147 bp, Homo sapiens
  misc_feature 1..147: note = chr5:174119987-174120134
  misc_feature 1..147: note = hyper
  source 1..147: mol_type = genomic DNA
taattttgaaagggtcgctgtaagacactgactaatgacacgtgacctttggattctccacgaggcagcaggcgcgggccccgagcccagcggggacccctctgccagttaggggtcactctctccattcaacgctttattagcccc

SEQ ID NO: 93419 - DNA, 39 bp, Homo sapiens
  misc_feature 1..39: note = chr5:174120367-174120406
  misc_feature 1..39: note = hyper
  source 1..39: mol_type = genomic DNA
ctgcataaattatcccgtgattgacgctctttcttccag

SEQ ID NO: 93420 - DNA, 794 bp, Homo sapiens
  misc_feature 1..794: note = chr5:174147420-174148214
  misc_feature 1..794: note = hyper
  source 1..794: mol_type = genomic DNA
cctctcccctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggcgggaacaggagaacaggaaagaacaagcttgggcttgcagagcttcgcaagcaagacgtttgtacccccaaaacctccagctgtgaccctgaatatctatctacccgacttcctgggctgtgtaactcggaaagtgatctctctagacaccagaggaccgaaccttccccattctcactctgcaacaagccagtaagaaaaatgagctcagagacgagtagccttttgcccgaagtcacacagccaatgttttggggggtgggtgagcggtgttgtggaattcctggcggatgttggcgcccgcgggtctgcctgcttctgatacccgggctcggtagaataggccgctaacgagctcccattaggaggaattgtcactcctctgggagcgagcttgtcccattagggcgaattgtcattcctcctggagcgaggttgtcccggctccgcgcaggctgagtgctggggccgagagcaattaacgcggctccggcgcgggcagccgcctctgccccgggcagcgggggcggggcagggcgggggcggggcgcccggcgcggctggagccggtcacccggcgcagccccttcccccggagcccgcctttcatctccccgcgcctggcgcctgcc

SEQ ID NO: 93421 - DNA, 37 bp, Homo sapiens; identical to SEQ ID NO: 30127
  misc_feature 1..37: note = chr5:174150431-174150468
  misc_feature 1..37: note = hyper
  source 1..37: mol_type = genomic DNA

SEQ ID NO: 93422 - DNA, 72 bp, Homo sapiens; identical to SEQ ID NO: 30128
  misc_feature 1..72: note = chr5:174151125-174151197
  misc_feature 1..72: note = hyper
  source 1..72: mol_type = genomic DNA

SEQ ID NO: 93423 - DNA, 326 bp, Homo sapiens
  misc_feature 1..326: note = chr5:174151443-174151769
  misc_feature 1..326: note = hyper
  source 1..326: mol_type = genomic DNA
ggggggcagccccttcgggaagagccaatcaggggcgagcgtctctggcgtcagcgccaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcgga

SEQ ID NO: 93424 - DNA, 23 bp, Homo sapiens
  misc_feature 1..23: note = chr5:174158665-174158688
  misc_feature 1..23: note = hyper
  source 1..23: mol_type = genomic DNA
tcagatgggaggctccggtgact

SEQ ID NO: 93425 - DNA, 294 bp, Homo sapiens; identical to SEQ ID NO: 30130
  misc_feature 1..294: note = chr5:174159299-174159593
  misc_feature 1..294: note = hyper
  source 1..294: mol_type = genomic DNA

SEQ ID NO: 93426 - DNA, 30 bp, Homo sapiens; identical to SEQ ID NO: 30131
  misc_feature 1..30: note = chr5:174162217-174162247
  misc_feature 1..30: note = hyper
  source 1..30: mol_type = genomic DNA

SEQ ID NO: 93427 - DNA, 362 bp, Homo sapiens
  misc_feature 1..362: note = chr5:174162494-174162856
  misc_feature 1..362: note = hyper
  source 1..362: mol_type = genomic DNA
agggagtgacccttgcgcaggaagggggcgcgtcacccggtttccccatagaaccgtgggcgtcgcaggcgagaagggaagcgtccaggcgctcggccccttccgccccgcccgctgccggccgcccgtttgatgtcgcgggcccggcaggaatgcggccgggttatcaatcacccagctggatcccgaaggtctctgcctaatcacatttaattgctcgtggaggcccactctcgccccgggccggccgccgcgctcaattactccccaaatacctgccatcaataaatacgcactgacaccggcccggcccgctccaccggcacggaagatcgcagccgaccaggcgccctcctccctgc

SEQ ID NO: 93428 - DNA, 80 bp, Homo sapiens
  misc_feature 1..80: note = chr5:174178168-174178248
  misc_feature 1..80: note = hyper
  source 1..80: mol_type = genomic DNA
gggctcccccgaccccgccctggcagcgccccccgccgcgagctcccggggcggaggagccggctcggctttgattagca

SEQ ID NO: 93429 - DNA, 283 bp, Homo sapiens
  misc_feature 1..283: note = chr5:174178631-174178914
  misc_feature 1..283: note = hyper
  source 1..283: mol_type = genomic DNA
tgaaatccacacaatcgcgcccttctctttaaagggagggagaagaggggccgcggccgcgcgccccgccatcagctgcgcgcacagagggagagttcactccggggacaagggcggcgcgaccggcccggggctcttgggcggccgcgtttcccctcccaccggctgcagcccccttctcccgcggcactttccggcgtcttttgtggggcgagtcctggcgagggtgtccgccgtcaggtgcacaggccccgtgctcccctctgttcggcaggagatcggg

SEQ ID NO: 93430 - DNA, 86 bp, Homo sapiens; identical to SEQ ID NO: 30136
  misc_feature 1..86: note = chr5:174220856-174220942
  misc_feature 1..86: note = hyper
  source 1..86: mol_type = genomic DNA

SEQ ID NO: 93431 - DNA, 1175 bp, Homo sapiens
  misc_feature 1..1175: note = chr5:1746002-1747177
  misc_feature 1..1175: note = hypo
  source 1..1175: mol_type = genomic DNA
gacgacaaaggcacccggtgtccctgagccgagcacgccccgtccacttggtgggggcattagcctgtcggaaagctgcctggtccaggggggctttcagcccgcaggacgccgagagctgtctgtaaacctctccatggttgtgtgggcctcgggccgaggcagcctgcagtgaaggaagatgttttggagaagttgttggggggctgaatccctaaacgcaggggacacttcacgcccgtggaatttggaaaaccgaggcagggagcagggaagggtgtgggactcgggaaggggagcagctggtgctcctttaactcgcccggtggcagttcagggtgtttccatctgagatcctacactcagccgggggcccacggtgtagcgggtcgtcagccgggccccgggccttctgggcagcaagggccctggcaggaccctgagggctgggccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgaggtgtccttccgggggccctgaggg

SEQ ID NO: 93432 - DNA, 1267 bp, Homo sapiens
  misc_feature 1..1267: note = chr5:174870699-174871966
  misc_feature 1..1267: note = hyper
  source 1..1267: mol_type = genomic DNA
accttgccttggggtcgtctctctcaaagcccctggagcttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtgccctcgcgggcaccaacctcactcacaagggttccagcgaccgccagggacccgcgccccgactcgctcttcccggtccatgactgcc

SEQ ID NO: 93433 - DNA, 107 bp, Homo sapiens
  misc_feature 1..107: note = chr5:17492061-17492168
  misc_feature 1..107: note = hypo
  source 1..107: mol_type = genomic DNA
ctcaggtctgtgggtcggaggccgggctgcttagtcttcccggaaggtcttgggtttccttggtctacccagcagcagccaggagtctccctcgcaggcagtctgtt

SEQ ID NO: 93434 - DNA, 44 bp, Homo sapiens
  misc_feature 1..44: note = chr5:174921456-174921500
  misc_feature 1..44: note = hypo
  source 1..44: mol_type = genomic DNA
atatgcaagtgcagccgggcacagtgattcatgcctataatccc

SEQ ID NO: 93435 - DNA, 90 bp, Homo sapiens
  misc_feature 1..90: note = chr5:1749854-1749944
  misc_feature 1..90: note = hypo
  source 1..90: mol_type = genomic DNA
gaggcagtggaggaccggaaccatgaccacagtgctgtggacacacatatgtacatacactgtaaaaagaaacgctgggaggctaaaccc

SEQ ID NO: 93436 - DNA, 114 bp, Homo sapiens
  misc_feature 1..114: note = chr5:17502345-17502459
  misc_feature 1..114: note = hypo
  source 1..114: mol_type = genomic DNA
ttgccaggcctgtagcggtgaggcttcttgatccctcctgtaggcagtgcccttttgctggcggctttagtggccagggtcttcgtggcgcctgccaggcggtggctttgctgg

SEQ ID NO: 93437 - DNA, 37 bp, Homo sapiens
  misc_feature 1..37: note = chr5:1750588-1750625
  misc_feature 1..37: note = hypo
  source 1..37: mol_type = genomic DNA
gcatcacacggttatcgtcacacggacattgtcacac

SEQ ID NO: 93438 - DNA, 496 bp, Homo sapiens
  misc_feature 1..496: note = chr5:175084819-175085315
  misc_feature 1..496: note = hyper
  source 1..496: mol_type = genomic DNA
ggcaagtgtcagagtcggcgagatgaggagggagggtgtaggagaaaggaaaatagaaagtgggtgagaccgtgggagagggagactgggggagaaaatgtgggcgtgtgcgcgctgagagagagagagagagagagagacttggagagggaaggaagggaaggagcgttgagagcaaggaggagcgagttgggggcggagacgaggaagtgggtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 93439 - DNA, 245 bp, Homo sapiens
  misc_feature 1..245: note = chr5:175085524-175085769
  misc_feature 1..245: note = hyper
  source 1..245: mol_type = genomic DNA
cgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacaggcagcgctcagcgggtgggagtcctt

SEQ ID NO: 93440 - DNA, 30 bp, Homo sapiens; identical to SEQ ID NO: 40645
  misc_feature 1..30: note = chr5:175115079-175115109
  misc_feature 1..30: note = hypo
  source 1..30: mol_type = genomic DNA

SEQ ID NO: 93441 - DNA, 152 bp, Homo sapiens
  misc_feature 1..152: note = chr5:17511936-17512088
  misc_feature 1..152: note = hypo
  source 1..152: mol_type = genomic DNA
cctcagcaccctctccgcggaggtggcgggacagctgcatgtctctgggcatgattgtgacatgccagggatggataacccatgggttgttgtctttaaatagggggaccaggtaggcctcgctgttctcctgaagtcgccagtggccgcac

SEQ ID NO: 93442 - DNA, 267 bp, Homo sapiens
  misc_feature 1..267: note = chr5:175223481-175223748
  misc_feature 1..267: note = hyper
  source 1..267: mol_type = genomic DNA
tgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccggg

SEQ ID NO: 93443 - DNA, 115 bp, Homo sapiens
  misc_feature 1..115: note = chr5:175223835-175223950
  misc_feature 1..115: note = hyper
  source 1..115: mol_type = genomic DNA
cgggagcggttggcggagagaccccggccacaggccccgcgctcgagagcttcctagaggcggcttcctccggcctctccccctccctggagctctcagccgccggcggctcttc

SEQ ID NO: 93444 - DNA, 532 bp, Homo sapiens
  misc_feature 1..532: note = chr5:175224441-175224973
  misc_feature 1..532: note = hyper
  source 1..532: mol_type = genomic DNA
gggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagat

SEQ ID NO: 93445 - DNA, 1641 bp, Homo sapiens
  misc_feature 1..1641: note = chr5:175298500-175300141
  misc_feature 1..1641: note = hyper
  source 1..1641: mol_type = genomic DNA
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcctggagtcttcgggaacgaccccttctgtgctctcgttctcgtcggcctcaatctgcccccttccccagcaaagtttgaaaccgggccgggtcttggggttggagctatgtgtgttgggggaaggggcgctctccgtggcccaccgggagatccaggacagagctgctgggggtgtgggtctccgcgggggtccgggagaggggcgccggggttcctgtcctctcttctggccgggaaacgggaacccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 93446 - DNA, 29 bp, Homo sapiens
  misc_feature 1..29: note = chr5:175300142-175300171
  misc_feature 1..29: note = hyper
  source 1..29: mol_type = genomic DNA
cagggatagaccaaggcttcccgcagaat

SEQ ID NO: 93447 - DNA, 196 bp, Homo sapiens; identical to SEQ ID NO: 8226
  misc_feature 1..196: note = chr5:175300216-175300412
  misc_feature 1..196: note = hyper
  source 1..196: mol_type = genomic DNA

SEQ ID NO: 93448 - DNA, 151 bp, Homo sapiens
  misc_feature 1..151: note = chr5:175488087-175488238
  misc_feature 1..151: note = hyper
  source 1..151: mol_type = genomic DNA
gcggggcgggctacacggccaggcgggccctccccttaaggcggggtgggccgcgcgcctgcgattttccgtccgtggtcctggggcagcccgggccagccaggagaacccgcgagcccagcggcgcctgcacctgcggcttccgggagcc

SEQ ID NO: 93449 - DNA, 308 bp, Homo sapiens; identical to SEQ ID NO: 30150
  misc_feature 1..308: note = chr5:175560514-175560822
  misc_feature 1..308: note = hyper
  source 1..308: mol_type = genomic DNA

SEQ ID NO: 93450 - DNA, 136 bp, Homo sapiens; identical to SEQ ID NO: 40646
  misc_feature 1..136: note = chr5:175605006-175605142
  misc_feature 1..136: note = hypo
  source 1..136: mol_type = genomic DNA

SEQ ID NO: 93451 - DNA, 30 bp, Homo sapiens; identical to SEQ ID NO: 14798
  misc_feature 1..30: note = chr5:175610717-175610747
  misc_feature 1..30: note = hypo
  source 1..30: mol_type = genomic DNA

SEQ ID NO: 93452 - DNA, 230 bp, Homo sapiens
  misc_feature 1..230: note = chr5:175621329-175621559
  misc_feature 1..230: note = hyper
  source 1..230: mol_type = genomic DNA
agcccgctgccaggccggcgcctgctcccgcagacctgccatgccaatgctctccaagctgaggccgggtggcctgcgacgctcagcccgctgcccatcacaagaagaaaagcgcttatcagggcgctgtgcgcacggggccaccttcgcgctggcccgtgcgggcaccctcagccggcgggactttcacctttgccgagcagcggcggcagcaccggatgtctccttcg

SEQ ID NO: 93453 - DNA, 175 bp, Homo sapiens
  misc_feature 1..175: note = chr5:175626544-175626719
  misc_feature 1..175: note = hyper
  source 1..175: mol_type = genomic DNA
gggcacggataggagcggcgcacgcgtaggagcggggcgcgggcaggtacagaacgcgggcaggagcaggacgcggaggggagcggggcgcgggctggcagaggtcagaacaggacgcggtagcagcggggcgccactaggcagggataggagcgtggggcggtagctgccagac

SEQ ID NO: 93454 - DNA, 772 bp, Homo sapiens
  misc_feature 1..772: note = chr5:175792160-175792932
  misc_feature 1..772: note = hyper
  source 1..772: mol_type = genomic DNA
caaagcactacgatgcggcgttgggcgggttacttaactcctgggcctcggttttcccttctgcgtggtatcattgtaaggggtaacggagaaaagccgtgagctaacccctggtggatgctagcaagcaccgccgtctcccgtcctccccaggcacagcctctccttcctccaccctgcacctggcagggggaccggaggtccccgcgcgccggccagcgccccaccacccacgccgccgggtcccgggcggcctgccgtgacagcggcagtgcattgtggggcttgtagtgcgggactgggtctgggtgggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaa

SEQ ID NO: 93455 - DNA, 221 bp, Homo sapiens; identical to SEQ ID NO: 30155
  misc_feature 1..221: note = chr5:175792997-175793218
  misc_feature 1..221: note = hyper
  source 1..221: mol_type = genomic DNA

SEQ ID NO: 93456 - DNA, 30 bp, Homo sapiens
  misc_feature 1..30: note = chr5:175832567-175832597
  misc_feature 1..30: note = hypo
  source 1..30: mol_type = genomic DNA
atttgcctccatatccgtttattcactgcc

SEQ ID NO: 93457 - DNA, 30 bp, Homo sapiens
  misc_feature 1..30: note = chr5:175844227-175844257
  misc_feature 1..30: note = hypo
  source 1..30: mol_type = genomic DNA
gcaccaggacagcaacgttttataaaatcc

SEQ ID NO: 93458 - DNA, 17 bp, Homo sapiens
  misc_feature 1..17: note = chr5:175876289-175876306
  misc_feature 1..17: note = hypo
  source 1..17: mol_type = genomic DNA
cccccaggccaggagcg

SEQ ID NO: 93459 - DNA, 17 bp, Homo sapiens
  misc_feature 1..17: note = chr5:175876606-175876623
  misc_feature 1..17: note = hypo
  source 1..17: mol_type = genomic DNA
ttcgggagatcaaatgg

SEQ ID NO: 93460 - DNA, 19 bp, Homo sapiens
  misc_feature 1..19: note = chr5:175879322-175879341
  misc_feature 1..19: note = hypo
  source 1..19: mol_type = genomic DNA
tgctcggattacaggcgtg

SEQ ID NO: 93461 - DNA, 30 bp, Homo sapiens; identical to SEQ ID NO: 14801
  misc_feature 1..30: note = chr5:175924856-175924886
  misc_feature 1..30: note = hypo
  source 1..30: mol_type = genomic DNA

SEQ ID NO: 93462 - DNA, 151 bp, Homo sapiens
  misc_feature 1..151: note = chr5:175971719-175971870
  misc_feature 1..151: note = hypo
  source 1..151: mol_type = genomic DNA
tgagctaccgcgcccagccccgagttctttctagggtgggaggctgtgagtctgtgacatcacggggatattcttgggctggttccttgtctgtaagagcaacgaagggactttgtaccctgcaaagtgcaacttccggggatgattggga

SEQ ID NO: 93463 - DNA, 185 bp, Homo sapiens
  misc_feature 1..185: note = chr5:175972891-175973076
  misc_feature 1..185: note = hypo
  source 1..185: mol_type = genomic DNA
caccatctggccacacgtgcctcatcgtgatgggtccaaaggtctgggcaggccaggacacacctctgtcaaccagagcagtgactcagagctgtcggcctcagccgtaagggcagggagagggggcaggggcttgggttggggtctgccctatttggggcacagcagagcgaccaggctgactc

SEQ ID NO: 93464 - DNA, 30 bp, Homo sapiens; identical to SEQ ID NO: 14803
  misc_feature 1..30: note = chr5:175975036-175975066
  misc_feature 1..30: note = hypo
  source 1..30: mol_type = genomic DNA

SEQ ID NO: 93465 - DNA, 34 bp, Homo sapiens
  misc_feature 1..34: note = chr5:175978986-175979020
  misc_feature 1..34: note = hypo
  source 1..34: mol_type = genomic DNA
aggcgtgagtcaccgcgcccggttaatagttccc

SEQ ID NO: 93466 - DNA, 29 bp, Homo sapiens
  misc_feature 1..29: note = chr5:176023853-176023882
  misc_feature 1..29: note = hyper
  source 1..29: mol_type = genomic DNA
cacactctgcagcagcgcgcggaacaggc

SEQ ID NO: 93467 - DNA, 241 bp, Homo sapiens
  misc_feature 1..241: note = chr5:176024005-176024246
  misc_feature 1..241: note = hyper
  source 1..241: mol_type = genomic DNA
gctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtcatgggcccagtggccacggagcgcgtctcggcggcgcc

SEQ ID NO: 93468 - DNA, 108 bp, Homo sapiens
  misc_feature 1..108: note = chr5:176038513-176038621
  misc_feature 1..108: note = hyper
  source 1..108: mol_type = genomic DNA
ccggtttcagaaccacggacagcaccacaccagggctgcttcctcacatttccggtcctgaaaattgctcattcactgcccacaaggccatttcgcttcagagcttac

SEQ ID NO: 93469 - DNA, 324 bp, Homo sapiens
  misc_feature 1..324: note = chr5:176046278-176046602
  misc_feature 1..324: note = hyper
  source 1..324: mol_type = genomic DNA
gacggggcggggcctcggtgcaagcgcggagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagggtggagcaccggaggccagggctc

SEQ ID NO: 93470 - DNA, 659 bp, Homo sapiens; identical to SEQ ID NO: 30159
  misc_feature 1..659: note = chr5:176056505-176057164
  misc_feature 1..659: note = hyper
  source 1..659: mol_type = genomic DNA

SEQ ID NO: 93471 - DNA, 454 bp, Homo sapiens
  misc_feature 1..454: note = chr5:176057373-176057827
  misc_feature 1..454: note = hyper
  source 1..454: mol_type = genomic DNA
gaggggggatagggccgggatcaggcgctcgggtcgcgggtcctgagcaggagcgcagcagtgcccgggtctcgggtgcgtagccagccaccgctcgttcctcgcgccctgcgagctcgcgcgctccggctccggctccggctccggcgctgcggcagctctgagctcagcgcccccgctggcggccgcgccgccccttcggcctgactgacagggggcggggagggtgacagcgcgtagccgatgagcctcccggggcgggcccgggacgcgcccctgggggccccggccgtaagactcgcgtagtctgttgggagttgagggagggggacaacgcggcgtgtgaagagtggggaagaaatcacgcgactggatttggagttctgctgggctcgaatctcagctgtgctttttattaaccgtgggaccttgagctactcggctctcctttctg

SEQ ID NO: 93472 - DNA, 432 bp, Homo sapiens
  misc_feature 1..432: note = chr5:176107053-176107485
  misc_feature 1..432: note = hyper
  source 1..432: mol_type = genomic DNA
tgcaggctgcagtgccgctctgctccggccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 93473 - DNA, 69 bp, Homo sapiens; identical to SEQ ID NO: 2710
  misc_feature 1..69: note = chr5:176107517-176107586
  misc_feature 1..69: note = hyper
  source 1..69: mol_type = genomic DNA

SEQ ID NO: 93474 - DNA, 312 bp, Homo sapiens
  misc_feature 1..312: note = chr5:176170309-176170621
  misc_feature 1..312: note = hyper
  source 1..312: mol_type = genomic DNA
ccgggggtgcgggtgcgccgagccctcgggaggcctggctctggtgtgggctgcggggagaaggcgcgggaaggaaggaaggaggcgaagcggtgcgggagggaggcggccgttgccatggaaggagctgcaaggtactctgggaccagaattctctctgcagagggtcgggtggggggcggccggctggggaaggtgaggggaaatccagtgccattcctttgtccttggcgcttctcagcctccctgcagaccgcgagcggagcccccgcacccccggggctggcccctggcctcccgccccagcccggc

SEQ ID NO: 93475 - DNA, 30 bp, Homo sapiens
  misc_feature 1..30: note = chr5:176170885-176170915
  misc_feature 1..30: note = hyper
  source 1..30: mol_type = genomic DNA
ctaattttgaaaatccgcttatcagaatta

SEQ ID NO: 93476 - DNA, 160 bp, Homo sapiens
  misc_feature 1..160: note = chr5:176225826-176225986
  misc_feature 1..160: note = hypo
  source 1..160: mol_type = genomic DNA
gtccgcaagctcatgcgaggggggttattttactaaccagatagattaagcatctctccttctaattaccggtttaattaaccttggcacacagtatgtaccagacccgagggacagagtcagaatggctgctctgggtgaacatcgcccatctgctctg

SEQ ID NO: 93477 - DNA, 567 bp, Homo sapiens
  misc_feature 1..567: note = chr5:176236431-176236998
  misc_feature 1..567: note = hyper
  source 1..567: mol_type = genomic DNA
aggcgtttgagtttgcgaccctgccctcaccctgctcattcccctcccgacccagactaggaccctctctttttccgatcactccccccaggcacaccgcacgcggctgtcatttcctttctccttcaaggcagccctctgtttattttaacccgattagggaatgggggtggggcacaggagactccagcagcggtcactgctggaggctccaggagacgacgtgacttgaccaaggtcacagagctggaaggtgaagtcgcctggaccctacccccggtctccctagctgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcc

SEQ ID NO: 93478 - DNA, 111 bp, Homo sapiens
  misc_feature 1..111: note = chr5:176237148-176237259
  misc_feature 1..111: note = hyper
  source 1..111: mol_type = genomic DNA
cgcgccggggtcgccgcagccccgggcccctcccgggccacctgtgcgcagactggcgggcccgcgagagcccggatccggagcaccgatccactccgggtttcagactcc

SEQ ID NO: 93479 - DNA, 144 bp, Homo sapiens
  misc_feature 1..144: note = chr5:176237750-176237894
  misc_feature 1..144: note = hyper
  source 1..144: mol_type = genomic DNA
catggccgtccggcccggcctgtggccagcgctcctgggcatagtcctcgccgcttggctccgcggctcgggtgagtcacgccgcgcgcgctctggggaggcttgcgggggaccgtgcgcgcgaacgctcgctgctctgggggt

SEQ ID NO: 93480 - DNA, 30 bp, Homo sapiens
  misc_feature 1..30: note = chr5:176244317-176244347
  misc_feature 1..30: note = hyper
  source 1..30: mol_type = genomic DNA
tgacagcacctgaagcgccttggggaggga

SEQ ID NO: 93481 - DNA, 83 bp, Homo sapiens
  misc_feature 1..83: note = chr5:176244689-176244772
  misc_feature 1..83: note = hyper
  source 1..83: mol_type = genomic DNA
cgagggcccttaggccggcggatctgcggggcacgtgagctgccgtggagcgcgggtgcccgagcccacggcagccggggcag

SEQ ID NO: 93482 - DNA, 103 bp, Homo sapiens
  misc_feature 1..103: note = chr5:176249208-176249311
  misc_feature 1..103: note = hypo
  source 1..103: mol_type = genomic DNA
gcgagctgtgtggcccgcggggcgggggatgctcacttttggcccccctctgtgacacgccctggaagtatttgtgtggaggggtgtgcggagcaggatctgc

SEQ ID NO: 93483 - DNA, 105 bp, Homo sapiens
  misc_feature 1..105: note = chr5:176264795-176264900
  misc_feature 1..105: note = hyper
  source 1..105: mol_type = genomic DNA
gcgctccacagatagcggtcctggacgtggcacgctttcagcaccgtggacagccccaggcgctccacagaggctgtccctctgcggactcggcttcctaacctc

SEQ ID NO: 93484 - DNA, 45 bp, Homo sapiens
  misc_feature 1..45: note = chr5:176289688-176289733
  misc_feature 1..45: note = hypo
  source 1..45: mol_type = genomic DNA
cttcctggtggagcccgaggatgtgtacatcgtcaagaacaagcc

SEQ ID NO: 93485 - DNA, 74 bp, Homo sapiens
  misc_feature 1..74: note = chr5:176295173-176295247
  misc_feature 1..74: note = hypo
  source 1..74: mol_type = genomic DNA
ggtcgagaaggtgttcgggctggaggaatactggtgccagtgcgtggcatggagctcctcgggcaccaccaaga

SEQ ID NO: 93486 - DNA, 60 bp, Homo sapiens
  misc_feature 1..60: note = chr5:176296603-176296663
  misc_feature 1..60: note = hypo
  source 1..60: mol_type = genomic DNA
tgtccggccagtgaacggtgggtggtcgacgtggaccgagtggtccgtctgcagcgccag

SEQ ID NO: 93487 - DNA, 264 bp, Homo sapiens
  misc_feature 1..264: note = chr5:176315296-176315560
  misc_feature 1..264: note = hypo
  source 1..264: mol_type = genomic DNA
tgccaactaatcatgcggatcacgtttccacaatacctggggtgccgctcacacactcggcctccggtggccacagcaacctggagtgtttgttgctcccggctgtgctggaggcaggagagaacagcggccagggcggcagcacagagctgggcagcccgcgtgcacacggccgcacagacgtgctgcacaagctcaacatccgaagccccagggctcaggcccaagtcctgcaggatagcatggacacgggctgccccagta

SEQ ID NO: 93488 - DNA, 30 bp, Homo sapiens
  misc_feature 1..30: note = chr5:176473003-176473033
  misc_feature 1..30: note = hypo
  source 1..30: mol_type = genomic DNA
acacaggacataggccgggcatggtggctc

SEQ ID NO: 93489 - DNA, 30 bp, Homo sapiens
  misc_feature 1..30: note = chr5:1764822-1764852
  misc_feature 1..30: note = hypo
  source 1..30: mol_type = genomic DNA
ctcgctctcttcacccggtcgcctgagtgg

SEQ ID NO: 93490 - DNA, 57 bp, Homo sapiens
  misc_feature 1..57: note = chr5:176558851-176558908
  misc_feature 1..57: note = hypo
  source 1..57: mol_type = genomic DNA
gcggaatttttatggcggccggatccggctttctctgaacagcgagaaggcgcttag

SEQ ID NO: 93491 - DNA, 69 bp, Homo sapiens
  misc_feature 1..69: note = chr5:176560249-176560318
  misc_feature 1..69: note = hyper
  source 1..69: mol_type = genomic DNA
acctaagatggaggccgggactgacgcgggcccgagcagggctggcgggacgatcggacaggcctcagc

SEQ ID NO: 93492 - DNA, 138 bp, Homo sapiens
  misc_feature 1..138: note = chr5:176764100-176764238
  misc_feature 1..138: note = hypo
  source 1..138: mol_type = genomic DNA
tgggctgggaaccaacgcctggcccggcccactcaccagacaggtcgccggtgccggcggaggccccgaagtagtagccggtgggcaggcgcactcccgtgatgtcaatgcagttcttccactcgttcttgtcctcca

SEQ ID NO: 93493 - DNA, 163 bp, Homo sapiens; identical to SEQ ID NO: 40661
  misc_feature 1..163: note = chr5:176795125-176795288
  misc_feature 1..163: note = hypo
  source 1..163: mol_type = genomic DNA

SEQ ID NO: 93494 - DNA, 78 bp, Homo sapiens
  misc_feature 1..78: note = chr5:176864849-176864927
  misc_feature 1..78: note = hypo
  source 1..78: mol_type = genomic DNA
aacactggagaggcccgaaggatgggcagggcaggccaggttgatagctgtcaatgacacacacgtttattgattcag

SEQ ID NO: 93495 - DNA, 52 bp, Homo sapiens
  misc_feature 1..52: note = chr5:176884410-176884462
  misc_feature 1..52: note = hypo
  source 1..52: mol_type = genomic DNA
gtagcctagggctggcgccaccgctaatcaccaccctcgaagccctcctcct

SEQ ID NO: 93496 - DNA, 70 bp, Homo sapiens
  misc_feature 1..70: note = chr5:176911102-176911172
  misc_feature 1..70: note = hypo
  source 1..70: mol_type = genomic DNA
tagaaggccctgttccggatgggcgtcttgcaggcagcacaggtaaagcagtgcacgtgccaggtcatct

SEQ ID NO: 93497 - DNA, 154 bp, Homo sapiens
  misc_feature 1..154: note = chr5:177003236-177003390
  misc_feature 1..154: note = hypo
  source 1..154: mol_type = genomic DNA
agtgctggtattacaggtgtgagccaccgtgcccggccaggaaatagatttcttaactctcagatctccattaaattggcatgtctagacctgtatttgcagtctagttatatttgcacagtaacaagtactggagcagcgccctctctgatgg

SEQ ID NO: 93498 - DNA, 94 bp, Homo sapiens
  misc_feature 1..94: note = chr5:177019952-177020046
  misc_feature 1..94: note = hypo
  source 1..94: mol_type = genomic DNA
gtaaggatattaaaacgaacggcaaaacccttcagctctcaccttctgtcacttttcgttaaaaaactcatggcggggtgtggtggctcttgcc

SEQ ID NO: 93499 - DNA, 30 bp, Homo sapiens
  misc_feature 1..30: note = chr5:177024976-177025006
  misc_feature 1..30: note = hypo
  source 1..30: mol_type = genomic DNA
gtcaggtattttgtacgatttctcagctag

SEQ ID NO: 93500 - DNA, 462 bp, Homo sapiens
  misc_feature 1..462: note = chr5:177031103-177031565
  misc_feature 1..462: note = hypo
  source 1..462: mol_type = genomic DNA
ggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtagcgcccgcccccaccctctc

SEQ ID NO: 93501 - DNA, 30 bp, Homo sapiens
  misc_feature 1..30: note = chr5:177374034-177374064
  misc_feature 1..30: note = hypo
  source 1..30: mol_type = genomic DNA
agtggctaattttatcgtggtgctcttgta

SEQ ID NO: 93502 - DNA, 30 bp, Homo sapiens
  misc_feature 1..30: note = chr5:177385531-177385561
  misc_feature 1..30: note = hypo
  source 1..30: mol_type = genomic DNA
tgaatatgtatgccccggctgtggaggcac

SEQ ID NO: 93503 - DNA, 149 bp, Homo sapiens
  misc_feature 1..149: note = chr5:177387547-177387696
  misc_feature 1..149: note = hypo
  source 1..149: mol_type = genomic DNA
acgagaacgtactgcaggagaaaacaggcctggcctgagacggctgtgccggctttctgaggccgtgaatggcaagacctcgagactgtcaagaggagcaagaggagtcgggatttagcgtcagtgatgaggtgcgccactcactgtgt

SEQ ID NO: 93504 - DNA, 30 bp, Homo sapiens
  misc_feature 1..30: note = chr5:177408490-177408520
  misc_feature 1..30: note = hypo
  source 1..30: mol_type = genomic DNA
gagtataggaactcccgggtcttggcctgt

SEQ ID NO: 93505 - DNA, 95 bp, Homo sapiens; identical to SEQ ID NO: 2711
  misc_feature 1..95: note = chr5:177411327-177411422
  misc_feature 1..95: note = hyper
  source 1..95: mol_type = genomic DNA

SEQ ID NO: 93506 - DNA, 703 bp, Homo sapiens
  misc_feature 1..703: note = chr5:177411507-177412210
  misc_feature 1..703: note = hyper
  source 1..703: mol_type = genomic DNA
cgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcgg

SEQ ID NO: 93507 - DNA, 222 bp, Homo sapiens
  misc_feature 1..222: note = chr5:177412450-177412672
  misc_feature 1..222: note = hyper
  source 1..222: mol_type = genomic DNA
gcctgggggacagagcgagactccgtctcaaaacaacaaaaaagagcatctcctctaccgagaagggaagacaggggagtccatcgggtgcgcactccgctgtcgcccaggctgggttgctggggcgccagtctgcggtgttcaggcccaaagcctgcagcctgttcagtccagggcaccgcaggcgccagaactctggcgggcgggcgggcgggcggcgag

SEQ ID NO: 93508 - DNA, 25 bp, Homo sapiens
  misc_feature 1..25: note = chr5:177513856-177513881
  misc_feature 1..25: note = hypo
  source 1..25: mol_type = genomic DNA
tatttttttttgagacggagtctgt

SEQ ID NO: 93509 - DNA, 30 bp, Homo sapiens
  misc_feature 1..30: note = chr5:177541524-177541554
  misc_feature 1..30: note = hyper
  source 1..30: mol_type = genomic DNA
aagagaactgagacccgttgcctcccactg

SEQ ID NO: 93510 - DNA, 22 bp, Homo sapiens
  misc_feature 1..22: note = chr5:177571459-177571481
  misc_feature 1..22: note = hypo
  source 1..22: mol_type = genomic DNA
aaaaaaggccaggcacggtggc

SEQ ID NO: 93511 - DNA, 28 bp, Homo sapiens
  misc_feature 1..28: note = chr5:177580093-177580121
  misc_feature 1..28: note = hypo
  source 1..28: mol_type = genomic DNA
acaaaaacgttaacgttcagttccttaa

SEQ ID NO: 93512 - DNA, 116 bp, Homo sapiens
  misc_feature 1..116: note = chr5:177581743-177581859
  misc_feature 1..116: note = hypo
  source 1..116: mol_type = genomic DNA
tgcagagggcctagccgagaagccagccggggctgagggaaggacggctccagcgaagccgggaacagcggagggaaggctttggggactgagctccctgccgtgcagggtgagag

SEQ ID NO: 93513 - DNA, 198 bp, Homo sapiens
  misc_feature 1..198: note = chr5:177589638-177589836
  misc_feature 1..198: note = hypo
  source 1..198: mol_type = genomic DNA
gacagggagagaatccgggattatccgggttagcccactgtaatcccttgagaccttaaagcagagagctttctctgactgacggcagaggggcaatgacggagatcccaagagcaagcaggatctgaacgctgctcccggctgtgaggatggaggcaccatgtgtgaggaccaaaaagtaaccgcaggagctgagag

SEQ ID NO: 93514 - DNA, 36 bp, Homo sapiens
  misc_feature 1..36: note = chr5:177593271-177593307
  misc_feature 1..36: note = hypo
  source 1..36: mol_type = genomic DNA
ttcgagggtgatgttcgggaacgttccacagcatcc

SEQ ID NO: 93515 - DNA, 30 bp, Homo sapiens; identical to SEQ ID NO: 30171
  misc_feature 1..30: note = chr5:177666777-177666807
  misc_feature 1..30: note = hyper
  source 1..30: mol_type = genomic DNA

SEQ ID NO: 93516 - DNA, 30 bp, Homo sapiens; identical to SEQ ID NO: 40665
  misc_feature 1..30: note = chr5:177673744-177673774
  misc_feature 1..30: note = hypo
  source 1..30: mol_type = genomic DNA

SEQ ID NO: 93517 - DNA, 21 bp, Homo sapiens
  misc_feature 1..21: note = chr5:177680874-177680895
  misc_feature 1..21: note = hypo
  source 1..21: mol_type = genomic DNA
ccatctctggctgggcgtggt

SEQ ID NO: 93518 - DNA, 196 bp, Homo sapiens
  misc_feature 1..196: note = chr5:177713344-177713540
  misc_feature 1..196: note = hypo
  source 1..196: mol_type = genomic DNA
gtcaagcctgagggacgcccgcggggctccacacacatccttctctccgttcccagccccgacagtcacagcgccccttctccaggccaggcccaggtgtgagggagcccgataccacccccacactcagcttcgtctttaattcccgacagtcctgtcatggccccagggacagcagccccgggtttggcctggc

SEQ ID NO: 93519 - DNA, 30 bp, Homo sapiens
  misc_feature 1..30: note = chr5:177713980-177714010
  misc_feature 1..30: note = hypo
  source 1..30: mol_type = genomic DNA
ggttctgttagtctccggtcctcccgagcc

SEQ ID NO: 93520 - DNA, 96 bp, Homo sapiens
  misc_feature 1..96: note = chr5:177723606-177723702
  misc_feature 1..96: note = hypo
  source 1..96: mol_type = genomic DNA
ttccccagaggtccccgggagggtgtgtggtgtgtctgaatcacccggctggtgaggcggtagtccagccagaggcagtcccgtaggaccctaaac

SEQ ID NO: 93521 - DNA, 30 bp, Homo sapiens
  misc_feature 1..30: note = chr5:177750053-177750083
  misc_feature 1..30: note = hypo
  source 1..30: mol_type = genomic DNA
tggggtggcatgtggcgctgtaggagtagg

SEQ ID NO: 93522 - DNA, 29 bp, Homo sapiens
  misc_feature 1..29: note = chr5:177753998-177754027
  misc_feature 1..29: note = hypo
  source 1..29: mol_type = genomic DNA
gtgagccactgcaccgggccaaaaatgac

SEQ ID NO: 93523 - DNA, 30 bp, Homo sapiens
  misc_feature 1..30: note = chr5:177767895-177767925
  misc_feature 1..30: note = hypo
  source 1..30: mol_type = genomic DNA
ctcaaggtcagaccccgcaggggtggctgt

SEQ ID NO: 93524 - DNA, 34 bp, Homo sapiens
  misc_feature 1..34: note = chr5:177807711-177807745
  misc_feature 1..34: note = hypo
  source 1..34: mol_type = genomic DNA
aggcagggaggatcacgtccggggccaatgtcgg

SEQ ID NO: 93525 - DNA, 48 bp, Homo sapiens
  misc_feature 1..48: note = chr5:177827431-177827479
  misc_feature 1..48: note = hypo
  source 1..48: mol_type = genomic DNA
ttgtgttttgacaatcgagacacagaacagctccgtcagccccaaact

SEQ ID NO: 93526 - DNA, 22 bp, Homo sapiens
  misc_feature 1..22: note = chr5:177829100-177829122
  misc_feature 1..22: note = hypo
  source 1..22: mol_type = genomic DNA
gccaccgcgcccagctgccttt

SEQ ID NO: 93527 - DNA, 40 bp, Homo sapiens
  misc_feature 1..40: note = chr5:177850350-177850390
  misc_feature 1..40: note = hypo
  source 1..40: mol_type = genomic DNA
ggcagcaggaggacccgcagctccccgtcagccatgtgat

SEQ ID NO: 93528 - DNA, 181 bp, Homo sapiens; identical to SEQ ID NO: 40667
  misc_feature 1..181: note = chr5:177851456-177851637
  misc_feature 1..181: note = hypo
  source 1..181: mol_type = genomic DNA

SEQ ID NO: 93529 - DNA, 30 bp, Homo sapiens
  misc_feature 1..30: note = chr5:177868563-177868593
  misc_feature 1..30: note = hypo
  source 1..30: mol_type = genomic DNA
agagatggggggatgcggggctagagtttc

SEQ ID NO: 93530 - DNA, 30 bp, Homo sapiens
  misc_feature 1..30: note = chr5:177882733-177882763
  misc_feature 1..30: note = hypo
  source 1..30: mol_type = genomic DNA
tcccaccaggctccacgaggaggtcagagc

SEQ ID NO: 93531 - DNA, 344 bp, Homo sapiens
  misc_feature 1..344: note = chr5:177890891-177891235
  misc_feature 1..344: note = hypo
  source 1..344: mol_type = genomic DNA
agaaaccagcctgggcgtgcagagacctcaggctgcagaacgaacctcttgttgtgggcctcccggccgggcgtgagcacaaccacaggctcatggggagaaatctgccgcctccccaacaccagttggcaggagctgttcacctacccccttttactgccgtaacatacacataacacaaaatgtaccatcttaactacgtttaagcgtacagctcagcggcattaagtgcatccgcgataccttgtggccatcaccacgtcgactgccagagctctttcatcttcccaaactgaaatgctatacccattaaacactaactcccgattcggcactcccacagc

SEQ ID NO: 93532 - DNA, 30 bp, Homo sapiens
  misc_feature 1..30: note = chr5:1779736-1779766
  misc_feature 1..30: note = hypo
  source 1..30: mol_type = genomic DNA
ccatgtgcgccctttcggtggggcgtggaa

SEQ ID NO: 93533 - DNA, 30 bp, Homo sapiens; identical to SEQ ID NO: 14810
  misc_feature 1..30: note = chr5:177982679-177982709
  misc_feature 1..30: note = hypo
  source 1..30: mol_type = genomic DNA

SEQ ID NO: 93534 - DNA, 166 bp, Homo sapiens
  misc_feature 1..166: note = chr5:177984059-177984225
  misc_feature 1..166: note = hypo
  source 1..166: mol_type = genomic DNA
agtccaaggtgtctgcggggcgggctcctcagggagagtccctcccacacccctccatagctctggtggctgcaggcattttggtgtttcttggctggcacacgcagcacgccaatccccactccgctgtcacctagccctctggtctgtgcgtctctgcctcaaa

SEQ ID NO: 93535 - DNA, 15 bp, Homo sapiens
  misc_feature 1..15: note = chr5:178003647-178003662
  misc_feature 1..15: note = hyper
  source 1..15: mol_type = genomic DNA
ggtcgtggagggccc

SEQ ID NO: 93536 - DNA, 89 bp, Homo sapiens
  misc_feature 1..89: note = chr5:178004285-178004374
  misc_feature 1..89: note = hyper
  source 1..89: mol_type = genomic DNA
cgcgtctcccctcttctcgggacaccagccctgttggatcagggcccccccacaacgacctgtgccacctcatccgcctctttaaagac

SEQ ID NO: 93537 - DNA, 303 bp, Homo sapiens; identical to SEQ ID NO: 509
  misc_feature 1..303: note = chr5:178016681-178016984
  misc_feature 1..303: note = hyper
  source 1..303: mol_type = genomic DNA

SEQ ID NO: 93538 - DNA, 52 bp, Homo sapiens; identical to SEQ ID NO: 510
  misc_feature 1..52: note = chr5:178017519-178017571
  misc_feature 1..52: note = hyper
  source 1..52: mol_type = genomic DNA

SEQ ID NO: 93539 - DNA, 364 bp, Homo sapiens
  misc_feature 1..364: note = chr5:178017572-178017936
  misc_feature 1..364: note = hyper
  source 1..364: mol_type = genomic DNA
ggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatcttctcacgagttcttagctgc

SEQ ID NO: 93540 - DNA, 30 bp, Homo sapiens; identical to SEQ ID NO: 40438
  misc_feature 1..30: note = chr5:1780761-1780791
  misc_feature 1..30: note = hypo
  source 1..30: mol_type = genomic DNA

SEQ ID NO: 93541 - DNA, 96 bp, Homo sapiens
  misc_feature 1..96: note = chr5:178108636-178108732
  misc_feature 1..96: note = hypo
  source 1..96: mol_type = genomic DNA
ctcatctggcataaccgaaactgtacacctgctgagcagtacacctccatttacgccgccccccagcccctgacaaccgccattctaccctctgtc

SEQ ID NO: 93542 - DNA, 153 bp, Homo sapiens; identical to SEQ ID NO: 40671
  misc_feature 1..153: note = chr5:178112320-178112473
  misc_feature 1..153: note = hypo
  source 1..153: mol_type = genomic DNA

SEQ ID NO: 93543 - DNA, 22 bp, Homo sapiens
  misc_feature 1..22: note = chr5:178117247-178117269
  misc_feature 1..22: note = hypo
  source 1..22: mol_type = genomic DNA
tatttatcgcctcacatagtta

SEQ ID NO: 93544 - DNA, 176 bp, Homo sapiens
  misc_feature 1..176: note = chr5:178194091-178194267
  misc_feature 1..176: note = hypo
  source 1..176: mol_type = genomic DNA
ggtgccagttcccaccggcagcccttaagcacagcttgcctgcaagccagggactcctgcgccaggccattcaaggtttccatcctccctgtgccagccagtccgactcagaagccattcagctcagggatgtcccagtacagatgcagggcctcggggttcgagaaagcacctcg

SEQ ID NO: 93545 - DNA, 30 bp, Homo sapiens
  misc_feature 1..30: note = chr5:178195637-178195667
  misc_feature 1..30: note = hypo
  source 1..30: mol_type = genomic DNA
cgtgggcacgaataacgccaccttccacct

SEQ ID NO: 93546 - DNA, 90 bp, Homo sapiens
  misc_feature 1..90: note = chr5:178216871-178216961
  misc_feature 1..90: note = hypo
  source 1..90: mol_type = genomic DNA
atccagaatattccccgcactggagcctagcaacacacctccatgaagaataaaattcgtcttatcttgtctgggccgggcgcggtggct

SEQ ID NO: 93547 - DNA, 165 bp, Homo sapiens; identical to SEQ ID NO: 40672
  misc_feature 1..165: note = chr5:178288343-178288508
  misc_feature 1..165: note = hypo
  source 1..165: mol_type = genomic DNA

SEQ ID NO: 93548 - DNA, 66 bp, Homo sapiens
  misc_feature 1..66: note = chr5:178323183-178323249
  misc_feature 1..66: note = hyper
  source 1..66: mol_type = genomic DNA
cggcgggagcacgctggcagctgagtgtccttcggcgctgtcctgggcaggcgccgaggtggaatc

SEQ ID NO: 93549 - DNA, 241 bp, Homo sapiens
  misc_feature 1..241: note = chr5:178367881-178368122
  misc_feature 1..241: note = hyper
  source 1..241: mol_type = genomic DNA
ccatcttcagcttttcgctgatctgcatcttcctgcgccttagtgcaaggcagagacctggttctaaagcgaacggaacggaaccgattctgtaagttgcaatgagcgcgctgaggtcggcgtggaggggtctctgggaaaggtagtttccgcgcctaaagcgccggggccgggccctgttcccgcaggcgcaaggcagcactgtctccgccgattgtccctctgggaagtggagtctggc

SEQ ID NO: 93550 - DNA, 30 bp, Homo sapiens; identical to SEQ ID NO: 40673
  misc_feature 1..30: note = chr5:178373124-178373154
  misc_feature 1..30: note = hypo
  source 1..30: mol_type = genomic DNA

SEQ ID NO: 93551 - DNA, 30 bp, Homo sapiens
  misc_feature 1..30: note = chr5:178400566-178400596
  misc_feature 1..30: note = hypo
  source 1..30: mol_type = genomic DNA
gggcgcagtggctcacgcctgtaatcccag

SEQ ID NO: 93552 - DNA, 94 bp, Homo sapiens
  misc_feature 1..94: note = chr5:178409975-178410069
  misc_feature 1..94: note = hypo
  source 1..94: mol_type = genomic DNA
tgtacatggtgaagccgatgggcttggcctcgttgaaggtctcgggcacgccacgggccttgatggcgtacactgtgcacgtgaccatgagcag

SEQ ID NO: 93553 - DNA, 141 bp, Homo sapiens
  misc_feature 1..141: note = chr5:178411620-178411761
  misc_feature 1..141: note = hypo
  source 1..141: mol_type = genomic DNA
aggagcacctcaggccgggacgtagagggcaccttctcaggatgtgcggcacacggagaccctgggcctgaccaggggacactcaggccctgttacgtggaggaagacgggagcacctcctagtcacggagaactgcatga

SEQ ID NO: 93554 - DNA, 34 bp, Homo sapiens
  misc_feature 1..34: note = chr5:178414393-178414427
  misc_feature 1..34: note = hypo
  source 1..34: mol_type = genomic DNA
aagatgaaagcaacccgagcgtccactgacagaa

SEQ ID NO: 93555 - DNA, 164 bp, Homo sapiens
  misc_feature 1..164: note = chr5:178416046-178416210
  misc_feature 1..164: note = hypo
  source 1..164: mol_type = genomic DNA
gggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccgccttccccctccc

SEQ ID NO: 93556 - DNA, 43 bp, Homo sapiens; identical to SEQ ID NO: 30176
  misc_feature 1..43: note = chr5:178422264-178422307
  misc_feature 1..43: note = hyper
  source 1..43: mol_type = genomic DNA

SEQ ID NO: 93557 - DNA, 574 bp, Homo sapiens
  misc_feature 1..574: note = chr5:178450579-178451153
  misc_feature 1..574: note = hyper
  source 1..574: mol_type = genomic DNA
caatgggtggtttagcggagggagagtagttggagcccaagctgagggactcggcttcagccttctcgaactccacagcccgaccgcgttctccgctctcggcgctgtggttctctctcggacaccgtaagtggtggtgccgcagcgacgtctgggaaatgaagtccggagggacaaacgctgcggttcagccagggaaacccgtcggctctccggcgcgcaggcgcagttgcgcccggcagcgacgggaaacgtctctgaattaggtgttccgctcgcctcttgtgcggtgtggagctgcgcgccccccgccgaggcgggcccaggtacaggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgctggactcctgggccgcagcctgggccggactccgggggaaacggctc

SEQ ID NO: 93558 - DNA, 102 bp, Homo sapiens
  misc_feature 1..102: note = chr5:178478883-178478985
  misc_feature 1..102: note = hypo
  source 1..102: mol_type = genomic DNA
agtccacttgaagatcttcaaagggagctgctccacaggcttgtgtgccgggaggaacaggggaccttgctttgcattgtgcatcgccgcgctactgtttta

SEQ ID NO: 93559 - DNA, 90 bp, Homo sapiens; identical to SEQ ID NO: 40678
  misc_feature 1..90: note = chr5:178481810-178481900
  misc_feature 1..90: note = hypo
  source 1..90: mol_type = genomic DNA

SEQ ID NO: 93560 - DNA, 197 bp, Homo sapiens
  misc_feature 1..197: note = chr5:178487107-178487304
  misc_feature 1..197: note = hyper
  source 1..197: mol_type = genomic DNA
aatgaatctaatttccggttttgttttttcaaactactccgcttgcttaacaagtgcgcgggctgtaggcagcacggccagcagctggagacctcctgcctcgtgtgcggcgtgcgtactccctcgcactgcagcccctccgcgcactgtcgcctttgagagctctcgttggcggaggcggttcctctcccggagtt

SEQ ID NO: 93561 - DNA, 435 bp, Homo sapiens
  misc_feature 1..435: note = chr5:178487341-178487776
  misc_feature 1..435: note = hyper
  source 1..435: mol_type = genomic DNA
cggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtgcattttcttctgagtaacggaaataataaaag

SEQ ID NO: 93562 - DNA, 117 bp, Homo sapiens
  misc_feature 1..117: note = chr5:178488196-178488313
  misc_feature 1..117: note = hypo
  source 1..117: mol_type = genomic DNA
gggggcaccctgagtcgccgctgcagatcgcgggcctggaggccctcacacttgcccggctgccccaggcagcctcttcccttgctttctgtggggcgggcacggtttccacctctc

SEQ ID NO: 93563 - DNA, 77 bp, Homo sapiens
  misc_feature 1..77: note = chr5:178551846-178551923
  misc_feature 1..77: note = hypo
  source 1..77: mol_type = genomic DNA
agtgcttggcatgcacggagcgggtggtggtgttgtgtagcggctgaatgcagcgcacggagcgcacctgcatgcct

SEQ ID NO: 93564 - DNA, 30 bp, Homo sapiens
  misc_feature 1..30: note = chr5:178556809-178556839
  misc_feature 1..30: note = hypo
  source 1..30: mol_type = genomic DNA
aggccaaaggggccacgcagagtgtcacct

SEQ ID NO: 93565 - DNA, 164 bp, Homo sapiens
  misc_feature 1..164: note = chr5:178561609-178561773
  misc_feature 1..164: note = hypo
  source 1..164: mol_type = genomic DNA
ctgttcttgttttggcgtatttggtgtcgccatctctgagccagctgtatagcccagcctcccggccctgccgaagtcacaggagcaaatgcagagcagccctcgagcaccctcccggctccagctccagctccagctcccggctccagctccagctcccggct

SEQ ID NO: 93566 - DNA, 41 bp, Homo sapiens; identical to SEQ ID NO: 40680
  misc_feature 1..41: note = chr5:178565442-178565483
  misc_feature 1..41: note = hypo
  source 1..41: mol_type = genomic DNA

SEQ ID NO: 93567 - DNA, 152 bp, Homo sapiens
  misc_feature 1..152: note = chr5:178566307-178566459
  misc_feature 1..152: note = hypo
  source 1..152: mol_type = genomic DNA
cccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttg

SEQ ID NO: 93568 - DNA, 145 bp, Homo sapiens; identical to SEQ ID NO: 40681
  misc_feature 1..145: note = chr5:178576381-178576526
  misc_feature 1..145: note = hypo
  source 1..145: mol_type = genomic DNA

SEQ ID NO: 93569 - DNA, 30 bp, Homo sapiens
  misc_feature 1..30: note = chr5:178580513-178580543
  misc_feature 1..30: note = hypo
  source 1..30: mol_type = genomic DNA
aggccgaagtcaaagcggcattgctcgttc

SEQ ID NO: 93570 - DNA, 348 bp, Homo sapiens
  misc_feature 1..348: note = chr5:178594123-178594471
  misc_feature 1..348: note = hyper
  source 1..348: mol_type = genomic DNA
cgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgt

SEQ ID NO: 93571 - DNA, 186 bp, Homo sapiens
  misc_feature 1..186: note = chr5:178612233-178612419
  misc_feature 1..186: note = hypo
  source 1..186: mol_type = genomic DNA
actccaggtgccttacggaaagtagatggaaggggtcaagatgtgggaatgtggggttcagctttggggatgagtgcagagaagggacggatgtgagggatgatgtggattggaataggggtcatctgccccgcctgagcagggagaggctggggctctggaagggcattccggcagctcccacag

SEQ ID NO: 93572 - DNA, 45 bp, Homo sapiens
  misc_feature 1..45: note = chr5:178634584-178634629
  misc_feature 1..45: note = hypo
  source 1..45: mol_type = genomic DNA
cgcccagcaggacctcgatgttgtagtcatcgtccgcagcatgcc

SEQ ID NO: 93573 - DNA, 30 bp, Homo sapiens
  misc_feature 1..30: note = chr5:178635361-178635391
  misc_feature 1..30: note = hypo
  source 1..30: mol_type = genomic DNA
ctctgggccaggtcccgggccccctcccca

SEQ ID NO: 93574 - DNA, 210 bp, Homo sapiens; identical to SEQ ID NO: 40682
  misc_feature 1..210: note = chr5:178655698-178655908
  misc_feature 1..210: note = hypo
  source 1..210: mol_type = genomic DNA

SEQ ID NO: 93575 - DNA, 99 bp, Homo sapiens
  misc_feature 1..99: note = chr5:178665413-178665512
  misc_feature 1..99: note = hypo
  source 1..99: mol_type = genomic DNA
gtgctctgagtatgccggagggcagtgagtgctgcgggaaggggctggagggcacagggtctgcgagtgccagggcaggtggtgcggggggagctgtct

SEQ ID NO: 93576 - DNA, 128 bp, Homo sapiens
  misc_feature 1..128: note = chr5:178684538-178684666
  misc_feature 1..128: note = hypo
  source 1..128: mol_type = genomic DNA
tgggctggggccctgcgccctccccgctgctggctcccgctgatgcgctacagatgggcttcatcgctgcctccaagaacaacaggacgaccgcaggtttcgcctcacagaaacggaaccgctggaaa

SEQ ID NO: 93577 - DNA, 43 bp, Homo sapiens
  misc_feature 1..43: note = chr5:178699920-178699963
  misc_feature 1..43: note = hypo
  source 1..43: mol_type = genomic DNA
gggcctgtggccccccgagaggaggggacgtgggtggccggcg

SEQ ID NO: 93578 - DNA, 64 bp, Homo sapiens
  misc_feature 1..64: note = chr5:178737203-178737267
  misc_feature 1..64: note = hypo
  source 1..64: mol_type = genomic DNA
gtgggggcctgtggacggccctcctcccccaccaggctgcagctcccagcgggcagggatctag

SEQ ID NO: 93579 - DNA, 48 bp, Homo sapiens
  misc_feature 1..48: note = chr5:178739679-178739727
  misc_feature 1..48: note = hypo
  source 1..48: mol_type = genomic DNA
ggagatggaggatgtcggccctgaagcccagagcgaagaggccacaag

SEQ ID NO: 93580 - DNA, 74 bp, Homo sapiens
  misc_feature 1..74: note = chr5:178740136-178740210
  misc_feature 1..74: note = hypo
  source 1..74: mol_type = genomic DNA
agcctaaagccttaccggggctccctcctcaggagtggcctgtgaagaggggacgcacacgcattcacactcat

SEQ ID NO: 93581 - DNA, 162 bp, Homo sapiens
  misc_feature 1..162: note = chr5:178770743-178770905
  misc_feature 1..162: note = hyper
  source 1..162: mol_type = genomic DNA
ggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccggg

SEQ ID NO: 93582 - DNA, 433 bp, Homo sapiens; identical to SEQ ID NO: 2717
  misc_feature 1..433: note = chr5:178771198-178771631
  misc_feature 1..433: note = hyper
  source 1..433: mol_type = genomic DNA

SEQ ID NO: 93583 - DNA, 58 bp, Homo sapiens; identical to SEQ ID NO: 2718
  misc_feature 1..58: note = chr5:178771723-178771781
  misc_feature 1..58: note = hyper
  source 1..58: mol_type = genomic DNA

SEQ ID NO: 93584 - DNA, 78 bp, Homo sapiens; identical to SEQ ID NO: 2719
  misc_feature 1..78: note = chr5:178771782-178771860
  misc_feature 1..78: note = hyper
  source 1..78: mol_type = genomic DNA

SEQ ID NO: 93585 - DNA, 763 bp, Homo sapiens
  misc_feature 1..763: note = chr5:178771967-178772730
  misc_feature 1..763: note = hyper
  source 1..763: mol_type = genomic DNA
cgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggc

SEQ ID NO: 93586 - DNA, 58 bp, Homo sapiens; identical to SEQ ID NO: 2722
  misc_feature 1..58: note = chr5:178772778-178772836
  misc_feature 1..58: note = hyper
  source 1..58: mol_type = genomic DNA

SEQ ID NO: 93587 - DNA, 30 bp, Homo sapiens
  misc_feature 1..30: note = chr5:178788838-178788868
  misc_feature 1..30: note = hypo
  source 1..30: mol_type = genomic DNA
ggatgtcatggaatccgcaccaccctcatt

SEQ ID NO: 93588 - DNA, 30 bp, Homo sapiens
  misc_feature 1..30: note = chr5:178794198-178794228
  misc_feature 1..30: note = hypo
  source 1..30: mol_type = genomic DNA
gtcagcaaaagcctgcgctagcagcccctt

SEQ ID NO: 93589 - DNA, 219 bp, Homo sapiens
  misc_feature 1..219: note = chr5:178836785-178837004
  misc_feature 1..219: note = hypo
  source 1..219: mol_type = genomic DNA
aaaaagaaaaaaaaagatgcttggtcaacactgcttcctttcttggccctgctgcctaaggtggccacggctctgctgtctccagcccctgatggtaactccccgaccccctgcctgcgggttgcctcctcctgcctgcagcactgtgagtcatgcctcactcaacgccctccatctgcgccatctgagtggccctgtgtgtcccggtgggaggctgac

SEQ ID NO: 93590 - DNA, 49 bp, Homo sapiens; identical to SEQ ID NO: 40685
  misc_feature 1..49: note = chr5:178854790-178854839
  misc_feature 1..49: note = hypo
  source 1..49: mol_type = genomic DNA

SEQ ID NO: 93591 - DNA, 17 bp, Homo sapiens
  misc_feature 1..17: note = chr5:178861589-178861606
  misc_feature 1..17: note = hypo
  source 1..17: mol_type = genomic DNA
tttttttttttgagacg

SEQ ID NO: 93592 - DNA, 96 bp, Homo sapiens
  misc_feature 1..96: note = chr5:178877445-178877541
  misc_feature 1..96: note = hypo
  source 1..96: mol_type = genomic DNA
acagaaaccagaaagcgtggttaatccaggagccgcacgaggactgatgccttccatatcggtgtcctgtatgtgctctgccgtattctacctcct

SEQ ID NO: 93593 - DNA, 90 bp, Homo sapiens
  misc_feature 1..90: note = chr5:178878660-178878750
  misc_feature 1..90: note = hypo
  source 1..90: mol_type = genomic DNA
aattataacagctcccggccggcaaggctctcagtggagccgagcccagagagaaggcctgcactgccagatgggcgagctcattagaat

SEQ ID NO: 93594 - DNA, 30 bp, Homo sapiens; identical to SEQ ID NO: 40687
  misc_feature 1..30: note = chr5:178882544-178882574
  misc_feature 1..30: note = hypo
  source 1..30: mol_type = genomic DNA

SEQ ID NO: 93595 - DNA, 86 bp, Homo sapiens
  misc_feature 1..86: note = chr5:178882941-178883027
  misc_feature 1..86: note = hypo
  source 1..86: mol_type = genomic DNA
ccacacaggaagaggcggttcccaggttccacacaggaagaggcggttcccaggttccacacaggaagaggcggttcccaggttcc

SEQ ID NO: 93596 - DNA, 30 bp, Homo sapiens
  misc_feature 1..30: note = chr5:178883436-178883466
  misc_feature 1..30: note = hypo
  source 1..30: mol_type = genomic DNA
tgaccagggttgacccgaggagtaacctgc

SEQ ID NO: 93597 - DNA, 37 bp, Homo sapiens
  misc_feature 1..37: note = chr5:178907047-178907084
  misc_feature 1..37: note = hypo
  source 1..37: mol_type = genomic DNA
agcctgttttctggccgggcgcagtggcttacgcctg

SEQ ID NO: 93598 - DNA, 75 bp, Homo sapiens
  misc_feature 1..75: note = chr5:178913784-178913859
  misc_feature 1..75: note = hypo
  source 1..75: mol_type = genomic DNA
agctgagcagagcctcgggaagctgggcttctcttctcagccctgccgccccctcttcaccgtgtctggaacaag

SEQ ID NO: 93599 - DNA, 349 bp, Homo sapiens; identical to SEQ ID NO: 30188
  misc_feature 1..349: note = chr5:178957597-178957946
  misc_feature 1..349: note = hyper
  source 1..349: mol_type = genomic DNA

SEQ ID NO: 93600 - DNA, 19 bp, Homo sapiens
  misc_feature 1..19: note = chr5:178969579-178969598
  misc_feature 1..19: note = hypo
  source 1..19: mol_type = genomic DNA
agaatgggccaggtgcggt

SEQ ID NO: 93601 - DNA, 120 bp, Homo sapiens
  misc_feature 1..120: note = chr5:178978788-178978908
  misc_feature 1..120: note = hypo
  source 1..120: mol_type = genomic DNA
caggcttgagccaccgcgcccggccggattcctcaatttctaactgaatcaattgaaattcagtacttttaaattgaattaaaaattgagttcctcggccgggagcggtggctcacgcct

SEQ ID NO: 93602 - DNA, 35 bp, Homo sapiens; identical to SEQ ID NO: 40689
  misc_feature 1..35: note = chr5:178987430-178987465
  misc_feature 1..35: note = hypo
  source 1..35: mol_type = genomic DNA

SEQ ID NO: 93603 - DNA, 379 bp, Homo sapiens
  misc_feature 1..379: note = chr5:179213899-179214278
  misc_feature 1..379: note = hypo
  source 1..379: mol_type = genomic DNA
ccagtctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacgagcaattcatgtt

SEQ ID NO: 93604 - DNA, 31 bp, Homo sapiens; identical to SEQ ID NO: 30189
  misc_feature 1..31: note = chr5:179243847-179243878
  misc_feature 1..31: note = hyper
  source 1..31: mol_type = genomic DNA

SEQ ID NO: 93605 - DNA, 22 bp, Homo sapiens
  misc_feature 1..22: note = chr5:179244320-179244342
  misc_feature 1..22: note = hyper
  source 1..22: mol_type = genomic DNA
gggcgttcgtcctccatccctc

SEQ ID NO: 93606 - DNA, 30 bp, Homo sapiens
  misc_feature 1..30: note = chr5:179263484-179263514
  misc_feature 1..30: note = hypo
  source 1..30: mol_type = genomic DNA
cttctctgatgaaggcggctggctcaccag

SEQ ID NO: 93607 - DNA, 30 bp, Homo sapiens
  misc_feature 1..30: note = chr5:179401303-179401333
  misc_feature 1..30: note = hypo
  source 1..30: mol_type = genomic DNA
aaaacgtacttctaacgactacacactccg

SEQ ID NO: 93608 - DNA, 50 bp, Homo sapiens; identical to SEQ ID NO: 40691
  misc_feature 1..50: note = chr5:179401725-179401775
  misc_feature 1..50: note = hypo
  source 1..50: mol_type = genomic DNA

SEQ ID NO: 93609 - DNA, 30 bp, Homo sapiens
  misc_feature 1..30: note = chr5:179448856-179448886
  misc_feature 1..30: note = hypo
  source 1..30: mol_type = genomic DNA
cgactttcccaataacgtcctttacagcag

SEQ ID NO: 93610 - DNA, 178 bp, Homo sapiens
  misc_feature 1..178: note = chr5:1794492-1794670
  misc_feature 1..178: note = hypo
  source 1..178: mol_type = genomic DNA
tctcatgagcaggcacggaggtgctggtctgccttcgctggccgagtgcccgctgcaggctgggctggtgggagacgtacggacacaaacacggctgggaagcaggctctgcctccacgcagcatgctcatctgtccgggctgcaataacaaaattccaccaacggcttacagacaag

SEQ ID NO: 93611 - DNA, 32 bp, Homo sapiens
  misc_feature 1..32: note = chr5:1794976-1795008
  misc_feature 1..32: note = hypo
  source 1..32: mol_type = genomic DNA
gtgggagggctgggtcgcgcctgccccctttt

SEQ ID NO: 93612 - DNA, 109 bp, Homo sapiens
  misc_feature 1..109: note = chr5:179498254-179498363
  misc_feature 1..109: note = hyper
  source 1..109: mol_type = genomic DNA
ggaaaaacccagtcacgctcctggagcctggttcccacgggagcaggccgggctgtccacgacggaagcctcgaccctggctggggctgtcggccgggcagcgcgggag

SEQ ID NO: 93613 - DNA, 30 bp, Homo sapiens; identical to SEQ ID NO: 30192
  misc_feature 1..30: note = chr5:179498867-179498897
  misc_feature 1..30: note = hyper
  source 1..30: mol_type = genomic DNA

SEQ ID NO: 93614 - DNA, 30 bp, Homo sapiens
  misc_feature 1..30: note = chr5:179499226-179499256
  misc_feature 1..30: note = hyper
  source 1..30: mol_type = genomic DNA
tcccgcccgcctgcacgagggcccgggcag

SEQ ID NO: 93615 - DNA, 228 bp, Homo sapiens; identical to SEQ ID NO: 40440
  misc_feature 1..228: note = chr5:1795233-1795461
  misc_feature 1..228: note = hypo
  source 1..228: mol_type = genomic DNA

SEQ ID NO: 93616 - DNA, 34 bp, Homo sapiens
  misc_feature 1..34: note = chr5:179535480-179535514
  misc_feature 1..34: note = hypo
  source 1..34: mol_type = genomic DNA
acgagccaccgcgcccagccgtttcagtctattt

SEQ ID NO: 93617 - DNA, 30 bp, Homo sapiens
  misc_feature 1..30: note = chr5:179546275-179546305
  misc_feature 1..30: note = hypo
  source 1..30: mol_type = genomic DNA
tggctgcacccactccggcctctcggggga

SEQ ID NO: 93618 - DNA, 35 bp, Homo sapiens
  misc_feature 1..35: note = chr5:179557921-179557956
  misc_feature 1..35: note = hypo
  source 1..35: mol_type = genomic DNA
agtgttggtggatagcgcgtcggccaccagacaca

SEQ ID NO: 93619 - DNA, 333 bp, Homo sapiens
  misc_feature 1..333: note = chr5:179564509-179564842
  misc_feature 1..333: note = hypo
  source 1..333: mol_type = genomic DNA
cccgagaggctgatgcgttgagggcatggcagggcagtgctggtacactctgagaccccctggcctgccctccgcctcaccttgtccagcaccggcttgtccagctgctgctgctcgatgcacaggtggcagacccgggccaggagctcccggggctcgatgaagaggcgagagctcagcaggaaggtgaagatgtaggctttctgggggacacacgagaaagagggcacaggctcaggagggcaccaggaggggcatgcttcccagctggccctgtaccctggcccaaggtcacgcccaaccctgatgccccccgtgcgtggtggaggagag

SEQ ID NO: 93620 - DNA, 30 bp, Homo sapiens
  misc_feature 1..30: note = chr5:179621876-179621906
  misc_feature 1..30: note = hypo
  source 1..30: mol_type = genomic DNA
tgcagctcagagctgcggcttctcctggct

SEQ ID NO: 93621 - DNA, 335 bp, Homo sapiens
  misc_feature 1..335: note = chr5:179635756-179636091
  misc_feature 1..335: note = hyper
  source 1..335: mol_type = genomic DNA
cccagcaggggctggcggcgcgcggcagagctgggtctcccgccaggtggccgggggtgtgccctcagggtaccctacccgctacccccgcgcctccagtcccggcggccgcgcggaccccgcccctgctgaccccggcgcacgctcccgcgccgcgcgcagcctcccgcctcccgccgaccccgccgcgccgccggcagccctccccagcccccgcgagcccgcgcccttgcccgcaccgccaggtgtccctcggccgcgcaccactcaccggctcccggcgcgccggaactccgggcccggcccatgggcagctcccggtgcgagcctcggcg

SEQ ID NO: 93622 - skipped

SEQ ID NO: 93623 - DNA, 106 bp, Homo sapiens
  misc_feature 1..106: note = chr5:179636200-179636306
  misc_feature 1..106: note = hyper
  source 1..106: mol_type = genomic DNA
cggagcaacgcggcgctgcgccccctcgtggcactcaggcagcgcggagcgggcggggcgcgggggtggagctgcgggagcccgcgggcggcgctgcacaccaggg

SEQ ID NO: 93624 - DNA, 30 bp, Homo sapiens
  misc_feature 1..30: note = chr5:179653659-179653689
  misc_feature 1..30: note = hypo
  source 1..30: mol_type = genomic DNA
gcacatagtaggactcgtaccactgctgat

SEQ ID NO: 93625 - DNA, 157 bp, Homo sapiens
  misc_feature 1..157: note = chr5:179742465-179742622
  misc_feature 1..157: note = hypo
  source 1..157: mol_type = genomic DNA
ccgcgcccggccggttatatgtttttcttttgtcattttaatcatgcagcctgaagtatttatatggatgaatatcatgatgcccgggattggcttcaaagtaaccccatggagacgaggggttaatatgagtgtgtccgaccggcacaagatgggc

SEQ ID NO: 93626 - DNA, 54 bp, Homo sapiens
  misc_feature 1..54: note = chr5:179779378-179779432
  misc_feature 1..54: note = hyper
  source 1..54: mol_type = genomic DNA
cccagcagaagttcccggctctctcccggccagcggaggcggcccagccaggag

SEQ ID NO: 93627 - DNA, 135 bp, Homo sapiens; identical to SEQ ID NO: 8263
  misc_feature 1..135: note = chr5:179779648-179779783
  misc_feature 1..135: note = hyper
  source 1..135: mol_type = genomic DNA

SEQ ID NO: 93628 - DNA, 173 bp, Homo sapiens; identical to SEQ ID NO: 8264
  misc_feature 1..173: note = chr5:179779840-179780013
  misc_feature 1..173: note = hyper
  source 1..173: mol_type = genomic DNA

SEQ ID NO: 93629 - DNA, 1257 bp, Homo sapiens; identical to SEQ ID NO: 30197
  misc_feature 1..1257: note = chr5:179780035-179781292
  misc_feature 1..1257: note = hyper
  source 1..1257: mol_type = genomic DNA

SEQ ID NO: 93630 - DNA, 34 bp, Homo sapiens
  misc_feature 1..34: note = chr5:179824602-179824636
  misc_feature 1..34: note = hypo
  source 1..34: mol_type = genomic DNA
gtgagcccccgcgccaggccgaatttccttcatg

SEQ ID NO: 93631 - DNA, 135 bp, Homo sapiens
  misc_feature 1..135: note = chr5:179867486-179867621
  misc_feature 1..135: note = hyper
  source 1..135: mol_type = genomic DNA
aaggggatggagggtcgcattaaacaacacctcaaggcagcccagatcgggagggagggtccctctgcaggacagaaaccagctcgtgccgcaagccaaccgcgagaagggaagagggggcgctctaggttacaa

SEQ ID NO: 93632 - DNA, 43 bp, Homo sapiens
  misc_feature 1..43: note = chr5:180011938-180011981
  misc_feature 1..43: note = hypo
  source 1..43: mol_type = genomic DNA
gagatcgcaccactgcactccatcctggcgagagagggacact

SEQ ID NO: 93633 - DNA, 571 bp, Homo sapiens
  misc_feature 1..571: note = chr5:180017118-180017689
  misc_feature 1..571: note = hyper
  source 1..571: mol_type = genomic DNA
tttattgagaggggccgggggaaggggatggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 93634 - DNA, 442 bp, Homo sapiens; identical to SEQ ID NO: 2726
  misc_feature 1..442: note = chr5:180017690-180018132
  misc_feature 1..442: note = hyper
  source 1..442: mol_type = genomic DNA

SEQ ID NO: 93635 - DNA, 195 bp, Homo sapiens; identical to SEQ ID NO: 30201
  misc_feature 1..195: note = chr5:180018484-180018679
  misc_feature 1..195: note = hyper
  source 1..195: mol_type = genomic DNA

SEQ ID NO: 93636 - DNA, 30 bp, Homo sapiens
  misc_feature 1..30: note = chr5:180019434-180019464
  misc_feature 1..30: note = hypo
  source 1..30: mol_type = genomic DNA
tactgcggcctcctccgcacctgcagacac

SEQ ID NO: 93637 - DNA, 30 bp, Homo sapiens; identical to SEQ ID NO: 40693
  misc_feature 1..30: note = chr5:180021394-180021424
  misc_feature 1..30: note = hypo
  source 1..30: mol_type = genomic DNA

SEQ ID NO: 93638 - DNA, 82 bp, Homo sapiens
  misc_feature 1..82: note = chr5:180028458-180028540
  misc_feature 1..82: note = hypo
  source 1..82: mol_type = genomic DNA
catttagatttattacggaagcaaaaacaataaaagcaacactcccgtccgcaacacacacaaagaccggcatcagatttat

SEQ ID NO: 93639 - DNA, 289 bp, Homo sapiens
  misc_feature 1..289: note = chr5:180033320-180033609
  misc_feature 1..289: note = hypo
  source 1..289: mol_type = genomic DNA
ggctgcccagtgcctcgggcttggcaagggagctctcctcgcagccccatctcctccgtcacccctgggtctgtgttgccacatccccaaggacctcgtcacactctcctctcacgggacggccctatctgactctcccaccatggtgcaggctcagccgtgcgggtcctggcgttgagtccccaactcacgtttccacggagtctgtctcctagctgagccacaggcctgggctgagcggccttctttgatctcaaggagctgtgctgtttctcgaaggtgtgtagag

SEQ ID NO: 93640 - DNA, 85 bp, Homo sapiens
  misc_feature 1..85: note = chr5:180041104-180041189
  misc_feature 1..85: note = hypo
  source 1..85: mol_type = genomic DNA
ccacacgtcactctgcgtggtgtacaccttgtcgaagatgctttcaggggccatccacttcaggggcagccgggcctggggagac

SEQ ID NO: 93641 - DNA, 36 bp, Homo sapiens
  misc_feature 1..36: note = chr5:180042128-180042164
  misc_feature 1..36: note = hypo
  source 1..36: mol_type = genomic DNA
ccaatcggagcactgcggccccgctggtcacctccc

SEQ ID NO: 93642 - DNA, 247 bp, Homo sapiens
  misc_feature 1..247: note = chr5:180046700-180046947
  misc_feature 1..247: note = hypo
  source 1..247: mol_type = genomic DNA
tgcccttgtggatgccgaaagcggaggcttccaccaccttcccgaaggcgccgtagccgagcactctccctgtcggggcagggggccagttgcaggtgagctgtacggggtgagcgtggagacaggtgggcggcgggggagccccgtgcagaggtccaggaggacaggcctggcagcaggaggagcgtggggagccacagcgggaagacaaggagaggtggacaggaggccgcgcatcctcccgggt

SEQ ID NO: 93643 - DNA, 30 bp, Homo sapiens
  misc_feature 1..30: note = chr5:180047720-180047750
  misc_feature 1..30: note = hypo
  source 1..30: mol_type = genomic DNA
tgggcagaaaggggccggcgtgtgtgtgtg

SEQ ID NO: 93644 - DNA, 252 bp, Homo sapiens
  misc_feature 1..252: note = chr5:180052859-180053111
  misc_feature 1..252: note = hypo
  source 1..252: mol_type = genomic DNA
tgtactcacagactacgctgggcaaacatcttgcagggtgtccagggccgccagtgccactggatgctgagaggcaggggcaccccgtaggccgtgcaggtgagggcctggcggctgtgacgcgagtagatgctgggggaggaggcctccttctcatgtatctgggggggcactgtgggcacacagatggccggtcagctggcctccaatgccaggccgcccacccgtgcgctctcccgtccctgacctacc

SEQ ID NO: 93645 - DNA, 252 bp, Homo sapiens
  misc_feature 1..252: note = chr5:180057419-180057671
  misc_feature 1..252: note = hypo
  source 1..252: mol_type = genomic DNA
cctgaaccagccacccgctggagcaggtagggccccgttctctcctcctgccagcccagggtccacaggctgggggcggtgtgggccccagctgcccgggaccctgctccagcctggcccgcctccaagtctcacctctcacgaacacgtaggagctggcggccgtggtgccctcgatgcgtgccttgatgtacttgtagtagcagacgtagctgcctgtgtcgttggcatgtacctcgtgcagcagcaaca

SEQ ID NO: 93646 - DNA, 67 bp, Homo sapiens; identical to SEQ ID NO: 30202
  misc_feature 1..67: note = chr5:180075791-180075858
  misc_feature 1..67: note = hyper
  source 1..67: mol_type = genomic DNA

SEQ ID NO: 93647 - DNA, 405 bp, Homo sapiens; identical to SEQ ID NO: 513
  misc_feature 1..405: note = chr5:180076053-180076458
  misc_feature 1..405: note = hyper
  source 1..405: mol_type = genomic DNA

SEQ ID NO: 93648 - DNA, 552 bp, Homo sapiens; identical to SEQ ID NO: 30204
  misc_feature 1..552: note = chr5:180076532-180077084
  misc_feature 1..552: note = hyper
  source 1..552: mol_type = genomic DNA

SEQ ID NO: 93649 - DNA, 258 bp, Homo sapiens; identical to SEQ ID NO: 30205
  misc_feature 1..258: note = chr5:180100616-180100874
  misc_feature 1..258: note = hyper
  source 1..258: mol_type = genomic DNA

SEQ ID NO: 93650 - DNA, 153 bp, Homo sapiens; identical to SEQ ID NO: 2731
  misc_feature 1..153: note = chr5:180101015-180101168
  misc_feature 1..153: note = hyper
  source 1..153: mol_type = genomic DNA

SEQ ID NO: 93651 - DNA, 81 bp, Homo sapiens
  misc_feature 1..81: note = chr5:180101251-180101332
  misc_feature 1..81: note = hyper
  source 1..81: mol_type = genomic DNA
cgggaggaaaaacggaggctcccagggcccggttaactcgctctcttgacaaagaacctcctggaccggactccagccagg

SEQ ID NO: 93652 - DNA, 196 bp, Homo sapiens
  misc_feature 1..196: note = chr5:180111784-180111980
  misc_feature 1..196: note = hypo
  source 1..196: mol_type = genomic DNA
catcttgctgacggccgacctgagcagctacctgagagctggcagcgctcgctcgatgaaggccgccgaatgacctggaagccaccctgatgggcagggccctcgaggttaatgagacacaggtaaagtgtgccccaggccatgagcaggggccctgaggaggaggactgtgagcaggaagcgagctccctcacct

SEQ ID NO: 93653 - DNA, 30 bp, Homo sapiens
  misc_feature 1..30: note = chr5:180159486-180159516
  misc_feature 1..30: note = hypo
  source 1..30: mol_type = genomic DNA
ggagaccttcccttccggaagggggcgact

SEQ ID NO: 93654 - DNA, 23 bp, Homo sapiens
  misc_feature 1..23: note = chr5:180169497-180169520
  misc_feature 1..23: note = hypo
  source 1..23: mol_type = genomic DNA
cggaagtgcggggatgacaggcg

SEQ ID NO: 93655 - DNA, 225 bp, Homo sapiens
  misc_feature 1..225: note = chr5:180294196-180294421
  misc_feature 1..225: note = hypo
  source 1..225: mol_type = genomic DNA
ctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttc

SEQ ID NO: 93656 - DNA, 30 bp, Homo sapiens; identical to SEQ ID NO: 40699
  misc_feature 1..30: note = chr5:180326126-180326156
  misc_feature 1..30: note = hypo
  source 1..30: mol_type = genomic DNA

SEQ ID NO: 93657 - DNA, 64 bp, Homo sapiens
  misc_feature 1..64: note = chr5:180480238-180480302
  misc_feature 1..64: note = hyper
  source 1..64: mol_type = genomic DNA
tcgtcgcgaccctgccgctgctgttggtcctcgcggcgctggcgctgggcgtcctccggaagca

SEQ ID NO: 93658 - DNA, 21 bp, Homo sapiens
  misc_feature 1..21: note = chr5:180486864-180486885
  misc_feature 1..21: note = hyper
  source 1..21: mol_type = genomic DNA
cgccctcgtggccgcgggact

SEQ ID NO: 93659 - DNA, 346 bp, Homo sapiens; identical to SEQ ID NO: 30207
  misc_feature 1..346: note = chr5:180527353-180527699
  misc_feature 1..346: note = hyper
  source 1..346: mol_type = genomic DNA

SEQ ID NO: 93660 - DNA, 56 bp, Homo sapiens
  misc_feature 1..56: note = chr5:180527793-180527849
  misc_feature 1..56: note = hyper
  source 1..56: mol_type = genomic DNA
cgactggaaatccgggtgcacctccgccccccggggcgcttcggccttggggtccc

SEQ ID NO: 93661 - DNA, 34 bp, Homo sapiens
  misc_feature 1..34: note = chr5:180530753-180530787
  misc_feature 1..34: note = hyper
  source 1..34: mol_type = genomic DNA
gattacaggcgtgagcccccgcgcccggccggga

SEQ ID NO: 93662 - DNA, 138 bp, Homo sapiens
  misc_feature 1..138: note = chr5:180531150-180531288
  misc_feature 1..138: note = hyper
  source 1..138: mol_type = genomic DNA
tcctctccctgcggtcgctgccacaccctctcgtccggtctcccatgcccccttatgctaccgcgtcgggcatgaaaacttccttttctttcttctccttctttccttccttttgagacagggtcttgctctgtctcc

SEQ ID NO: 93663 - DNA, 15 bp, Homo sapiens
  misc_feature 1..15: note = chr5:180597086-180597101
  misc_feature 1..15: note = hyper
  source 1..15: mol_type = genomic DNA
cgcagtgccgtccac

SEQ ID NO: 93664 - DNA, 256 bp, Homo sapiens
  misc_feature 1..256: note = chr5:180600774-180601030
  misc_feature 1..256: note = hyper
  source 1..256: mol_type = genomic DNA
cctacaacactccaccgctatctccacctggttaaggaaaaaaggctatcaagggtatttatacctttgcctttccgcctcaaccattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggca

SEQ ID NO: 93665 - DNA, 315 bp, Homo sapiens
  misc_feature 1..315: note = chr5:180601090-180601405
  misc_feature 1..315: note = hyper
  source 1..315: mol_type = genomic DNA
taatccagcgccttagaccgctcggccacgctaccttcctccgggggttcacctgcatcttttccttccttataaaacatccccagggttcccgggccaacaaggcgttggggcgaatccacagggcatcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagggga

SEQ ID NO: 93666 - DNA, 30 bp, Homo sapiens
  misc_feature 1..30: note = chr5:180631588-180631618
  misc_feature 1..30: note = hyper
  source 1..30: mol_type = genomic DNA
cttggcctcctgcaccgcctcgtccagcgg

SEQ ID NO: 93667 - DNA, 366 bp, Homo sapiens
  misc_feature 1..366: note = chr5:180632859-180633225
  misc_feature 1..366: note = hyper
  source 1..366: mol_type = genomic DNA
cacaccctctctcctcgctcactctggaggccacttggatcaagctttcgcccgcaccctcctcagaaaccgcccttgccaatgtcaccgggaacttcagcaattctcacccaaaggcgaagacctcgcctcacctcatctgcccccggatgctccctccttcccgacttcccttctcagggccttccaggacccagtgtccccgatcttcttgctgttcctgaaccccgtggcctctgcgctggctgttccccttgcgtggacctcttttctcccaccacctgcatgctccctcccacctcattcaggtcttgtttcaaacgtctctgcccacgaagcccgccccgaacgcgcacactgtgtaaa

SEQ ID NO: 93668 - DNA, 30 bp, Homo sapiens
  misc_feature 1..30: note = chr5:180644604-180644634
  misc_feature 1..30: note = hyper
  source 1..30: mol_type = genomic DNA
gatggtcctcttgaccgccctccaccgcca

SEQ ID NO: 93669 - DNA, 51 bp, Homo sapiens
  misc_feature 1..51: note = chr5:180659766-180659817
  misc_feature 1..51: note = hypo
  source 1..51: mol_type = genomic DNA
gaagcccagctggggcgtgcgggagccgcggctagtcgccttgcagaacag

SEQ ID NO: 93670 - DNA, 97 bp, Homo sapiens
  misc_feature 1..97: note = chr5:180661531-180661628
  misc_feature 1..97: note = hypo
  source 1..97: mol_type = genomic DNA
gtgcgtgggcaccaacggcaaacgctatcaggcccagagctccacagaacagacgctgctgagccccagtgagaaaccaaggcgctttggtgtgtac

SEQ ID NO: 93671 - DNA, 37 bp, Homo sapiens; identical to SEQ ID NO: 40701
  misc_feature 1..37: note = chr5:180708092-180708129
  misc_feature 1..37: note = hypo
  source 1..37: mol_type = genomic DNA

SEQ ID NO: 93672 - DNA, 432 bp, Homo sapiens
  misc_feature 1..432: note = chr5:180708603-180709035
  misc_feature 1..432: note = hypo
  source 1..432: mol_type = genomic DNA
ggcctgagcggtaggcgggagctggagcagtaagagggcggcctgagcggtaggaggggggctggagcagtaagagggcggccggggcggtaggcgggggctggagcagtaagagggcggcctgagcggtaggcgggggctggagcactaagagggcggccggggcggtaggagggggctggagcagtaagagggcggcctgagcggtaggcgggggctggagcagtaagagggcggcctgagcggtaggaggggggctggagcagtaagagggcggcctgagccgtaggagggtgggtggcagctggagatgctcttgaccggctagaggtctaggagaaggtggggaccgtgtccaacactcgtggctggagccttggccaccgcggttctcctggctgtggttggtggtggcgacggagactgcatctc

SEQ ID NO: 93673 - DNA, 30 bp, Homo sapiens
  misc_feature 1..30: note = chr5:180710021-180710051
  misc_feature 1..30: note = hypo
  source 1..30: mol_type = genomic DNA
tctgggggccccaggcgtggagtagtgggc

SEQ ID NO: 93674 - DNA, 16 bp, Homo sapiens
  misc_feature 1..16: note = chr5:18111782-18111798
  misc_feature 1..16: note = hypo
  source 1..16: mol_type = genomic DNA
gcgagactctgtctca

SEQ ID NO: 93675 - DNA, 105 bp, Homo sapiens
  misc_feature 1..105: note = chr5:1827709-1827814
  misc_feature 1..105: note = hypo
  source 1..105: mol_type = genomic DNA
gctggtagcacactgcggctcctcttatggaaacatgctcctggccctgtggcctgtggggccccccctccccggatgttcgcatcatctcgccaggtcagctca

SEQ ID NO: 93676 - DNA, 211 bp, Homo sapiens
  misc_feature 1..211: note = chr5:18393745-18393956
  misc_feature 1..211: note = hypo
  source 1..211: mol_type = genomic DNA
ctgtgtcattgaacacggctccatgtgttagtaatctaaccttccagctcctcaggagccttgcctgaggcaaggacttctaactcatcccgctgtgctcactggctttaggcacaggcagccttccagagctattgctggggctggattgctgctaccacccgcatgacaccagcagctcttggcataacaagagcggatcttcttggtg

SEQ ID NO: 93677 - DNA, 30 bp, Homo sapiens
  misc_feature 1..30: note = chr5:1839565-1839595
  misc_feature 1..30: note = hypo
  source 1..30: mol_type = genomic DNA
tcataaccctgcttccgaaagcattgatcg

SEQ ID NO: 93678 - DNA, 62 bp, Homo sapiens
  misc_feature 1..62: note = chr5:1844450-1844512
  misc_feature 1..62: note = hypo
  source 1..62: mol_type = genomic DNA
gaaaagactaagacacgggaacagatttctccacaaaacagtagcatcgctctagtgcatta

SEQ ID NO: 93679 - DNA, 51 bp, Homo sapiens
  misc_feature 1..51: note = chr5:1851149-1851200
  misc_feature 1..51: note = hyper
  source 1..51: mol_type = genomic DNA
cggacttgggagggccgcccagagagaagtgggtttcggtgaggggagggg

SEQ ID NO: 93680 - DNA, 46 bp, Homo sapiens
  misc_feature 1..46: note = chr5:1851402-1851448
  misc_feature 1..46: note = hyper
  source 1..46: mol_type = genomic DNA
tgctactccaggggccgcgccagcagcattttcccaggcagccggt

SEQ ID NO: 93681 - DNA, 467 bp, Homo sapiens; identical to SEQ ID NO: 29374
  misc_feature 1..467: note = chr5:1851534-1852001
  misc_feature 1..467: note = hyper
  source 1..467: mol_type = genomic DNA

SEQ ID NO: 93682 - DNA, 220 bp, Homo sapiens
  misc_feature 1..220: note = chr5:1865538-1865758
  misc_feature 1..220: note = hypo
  source 1..220: mol_type = genomic DNA
gttcagtcagaaaaacgaagccaccgcgattatgattatgggaacatagggtttacacgggggagttgctggggagggcatttcaggacagccttgatcaaagggctggggagatggtccaggcgatgccaaccggaagccccagaggaggagaggaaagccatccactaggggaccatcgctggccccgagctctgggtgggcccggtgtccggagtct

SEQ ID NO: 93683 - DNA, 34 bp, Homo sapiens; identical to SEQ ID NO: 40442
  misc_feature 1..34: note = chr5:1869209-1869243
  misc_feature 1..34: note = hypo
  source 1..34: mol_type = genomic DNA

SEQ ID NO: 93684 - DNA, 1415 bp, Homo sapiens
  misc_feature 1..1415: note = chr5:1874892-1876307
  misc_feature 1..1415: note = hyper
  source 1..1415: mol_type = genomic DNA
aatggaatcatcagccgcggtttgagaggtcgataaagcttttagatttggagacgttttccgggagcccatttcctgcggctaagagttgttaatggagcttaaggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 93685 - DNA, 284 bp, Homo sapiens; identical to SEQ ID NO: 29376
  misc_feature 1..284: note = chr5:1876637-1876921
  misc_feature 1..284: note = hyper
  source 1..284: mol_type = genomic DNA

SEQ ID NO: 93686 - DNA, 14 bp, Homo sapiens
  misc_feature 1..14: note = chr5:1877089-1877103
  misc_feature 1..14: note = hyper
  source 1..14: mol_type = genomic DNA
ggaaataggagagc

SEQ ID NO: 93687 - DNA, 38 bp, Homo sapiens; identical to SEQ ID NO: 29378
  misc_feature 1..38: note = chr5:1877194-1877232
  misc_feature 1..38: note = hyper
  source 1..38: mol_type = genomic DNA

SEQ ID NO: 93688 - DNA, 275 bp, Homo sapiens
  misc_feature 1..275: note = chr5:1877754-1878029
  misc_feature 1..275: note = hyper
  source 1..275: mol_type = genomic DNA
gcttcagaacggaaccgccttctccatgtaaacttttgacgtaaactttatgcttcagggtatctggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagt

SEQ ID NO: 93689 - DNA, 354 bp, Homo sapiens; identical to SEQ ID NO: 2508
  misc_feature 1..354: note = chr5:1878223-1878577
  misc_feature 1..354: note = hyper
  source 1..354: mol_type = genomic DNA

SEQ ID NO: 93690 - DNA, 215 bp, Homo sapiens; identical to SEQ ID NO: 29381
  misc_feature 1..215: note = chr5:1878830-1879045
  misc_feature 1..215: note = hyper
  source 1..215: mol_type = genomic DNA

SEQ ID NO: 93691 - DNA, 156 bp, Homo sapiens
  misc_feature 1..156: note = chr5:1879506-1879662
  misc_feature 1..156: note = hyper
  source 1..156: mol_type = genomic DNA
cctaggcatggggctcggcgtttgggacccccaagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 93692 - DNA, 58 bp, Homo sapiens
  misc_feature 1..58: note = chr5:1879689-1879747
  misc_feature 1..58: note = hyper
  source 1..58: mol_type = genomic DNA
cgtagggccgcttctcgtctgcgcacttgttccgcggcggccacgtcatcttgttctc

SEQ ID NO: 93693 - DNA, 503 bp, Homo sapiens; identical to SEQ ID NO: 2510
  misc_feature 1..503: note = chr5:1882419-1882922
  misc_feature 1..503: note = hyper
  source 1..503: mol_type = genomic DNA

SEQ ID NO: 93694 - DNA, 83 bp, Homo sapiens; identical to SEQ ID NO: 29385
  misc_feature 1..83: note = chr5:1883131-1883214
  misc_feature 1..83: note = hyper
  source 1..83: mol_type = genomic DNA

SEQ ID NO: 93695 - DNA, 402 bp, Homo sapiens; identical to SEQ ID NO: 29386
  misc_feature 1..402: note = chr5:1883215-1883617
  misc_feature 1..402: note = hyper
  source 1..402: mol_type = genomic DNA

SEQ ID NO: 93696 - DNA, 1851 bp, Homo sapiens
  misc_feature 1..1851: note = chr5:1883879-1885730
  misc_feature 1..1851: note = hyper
  source 1..1851: mol_type = genomic DNA
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggc

SEQ ID NO: 93697 - DNA, 143 bp, Homo sapiens
  misc_feature 1..143: note = chr5:1885934-1886077
  misc_feature 1..143: note = hyper
  source 1..143: mol_type = genomic DNA
tgtccctttcaccaacgataggacgctcagcatctcaggtatcagctgaacgcgtctgcatagactcggagtgctgagccttcctccctctagggacccccggtactaaatacacccgtgagcaggtgggccagaagtcagcc

SEQ ID NO: 93698 - DNA, 463 bp, Homo sapiens; identical to SEQ ID NO: 29391
  misc_feature 1..463: note = chr5:1886379-1886842
  misc_feature 1..463: note = hyper
  source 1..463: mol_type = genomic DNA

SEQ ID NO: 93699 - DNA, 149 bp, Homo sapiens; identical to SEQ ID NO: 419
  misc_feature 1..149: note = chr5:1886997-1887146
  misc_feature 1..149: note = hyper
  source 1..149: mol_type = genomic DNA

SEQ ID NO: 93700 - DNA, 36 bp, Homo sapiens; identical to SEQ ID NO: 420
  misc_feature 1..36: note = chr5:1887546-1887582
  misc_feature 1..36: note = hyper
  source 1..36: mol_type = genomic DNA

SEQ ID NO: 93701 - DNA, 392 bp, Homo sapiens
  misc_feature 1..392: note = chr5:1887655-1888047
  misc_feature 1..392: note = hyper
  source 1..392: mol_type = genomic DNA
cgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggtgataagccgcccgaggaccaat

SEQ ID NO: 93702 - DNA, 35 bp, Homo sapiens
  misc_feature 1..35: note = chr5:1892071-1892106
  misc_feature 1..35: note = hypo
  source 1..35: mol_type = genomic DNA
ccctgagggaggagacggagcgcagagcctgactt

SEQ ID NO: 93703 - DNA, 135 bp, Homo sapiens
  misc_feature 1..135: note = chr5:1913952-1914087
  misc_feature 1..135: note = hypo
  source 1..135: mol_type = genomic DNA
ccacagctacacggacgcggtcttccagctcgcgagaggaaagttttcctcatgccggtggtttttcacttattaaatctcatatttcaggcaacccattgagtagagcctggagagatgcgattaaactgctag

SEQ ID NO: 93704 - DNA, 134 bp, Homo sapiens
  misc_feature 1..134: note = chr5:192173-192307
  misc_feature 1..134: note = hypo
  source 1..134: mol_type = genomic DNA
aggctctgaggccagcgggcccggcccctctgcgggtgcactgcccctcgttccgggcggacagcctgagccccagccagctcctgcacgtgctgcgtctggctggcccgggtgccctgcgcaagctggaggtg

SEQ ID NO: 93705 - DNA, 87 bp, Homo sapiens
  misc_feature 1..87: note = chr5:1922987-1923074
  misc_feature 1..87: note = hypo
  source 1..87: mol_type = genomic DNA
ggcaaccaggcatcacgaggcgccttctccttccactcggtggagcagggtctccagtgaatgcggcgtccacgcctgatcggggct

SEQ ID NO: 93706 - DNA, 210 bp, Homo sapiens
  misc_feature 1..210: note = chr5:1930795-1931005
  misc_feature 1..210: note = hyper
  source 1..210: mol_type = genomic DNA
ctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggat

SEQ ID NO: 93707 - DNA, 223 bp, Homo sapiens; identical to SEQ ID NO: 423
  misc_feature 1..223: note = chr5:1931064-1931287
  misc_feature 1..223: note = hyper
  source 1..223: mol_type = genomic DNA

SEQ ID NO: 93708 - DNA, 133 bp, Homo sapiens; identical to SEQ ID NO: 424
  misc_feature 1..133: note = chr5:1931444-1931577
  misc_feature 1..133: note = hyper
  source 1..133: mol_type = genomic DNA

SEQ ID NO: 93709 - DNA, 411 bp, Homo sapiens
  misc_feature 1..411: note = chr5:1931617-1932028
  misc_feature 1..411: note = hyper
  source 1..411: mol_type = genomic DNA
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctgggaaaccaggtgctcgccaggtgtccctc

SEQ ID NO: 93710 - DNA, 205 bp, Homo sapiens
  misc_feature 1..205: note = chr5:1949464-1949669
  misc_feature 1..205: note = hypo
  source 1..205: mol_type = genomic DNA
tgcgggggctcagaccggctggaccgtagcgtagtttctggccccggctagctggcgaccgtgggcctcagtaccctgtctgcggggtggggcgatgcgaacctacaccctgggatgggggtgcccgcccagggcagtgctgtctgtgatcttgccatgcccagggcacccactccatgacgctggctgtcggtgctttccaggg

SEQ ID NO: 93711 - DNA, 492 bp, Homo sapiens
  misc_feature 1..492: note = chr5:1950766-1951258
  misc_feature 1..492: note = hypo
  source 1..492: mol_type = genomic DNA
tctgaaacagcccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgcgtgcgccgtctgctgtgcgtg

SEQ ID NO: 93712 - DNA, 199 bp, Homo sapiens
  misc_feature 1..199: note = chr5:1951511-1951710
  misc_feature 1..199: note = hypo
  source 1..199: mol_type = genomic DNA
catcttctgtgtgtgcgtgccgtctgctgtgcatgtgtgcattgtccattgtctgctgtgcatgcatcgtctgctctgcgtgcgtgcgtcatctgctgtgcgtgtgtcatctgctgtgcgtgtgccatctgctgcgggtgcatcatctgctgtgcgtgcgtgtgccatctgtgcctgtgtgcatcgtctgctgtgtgtg

SEQ ID NO: 93713 - DNA, 15 bp, Homo sapiens
  misc_feature 1..15: note = chr5:1952624-1952639
  misc_feature 1..15: note = hyper
  source 1..15: mol_type = genomic DNA
tggggcctggcaggc

SEQ ID NO: 93714 - DNA, 138 bp, Homo sapiens; identical to SEQ ID NO: 29400
  misc_feature 1..138: note = chr5:1952723-1952861
  misc_feature 1..138: note = hyper
  source 1..138: mol_type = genomic DNA

SEQ ID NO: 93715 - DNA, 68 bp, Homo sapiens
  misc_feature 1..68: note = chr5:1959631-1959699
  misc_feature 1..68: note = hypo
  source 1..68: mol_type = genomic DNA
tcatctgcattctaccgagggcatccccagtcccaggtttcatcctggtgtcccgctcatatgttccc

SEQ ID NO: 93716 - DNA, 152 bp, Homo sapiens
  misc_feature 1..152: note = chr5:1983598-1983750
  misc_feature 1..152: note = hypo
  source 1..152: mol_type = genomic DNA
gaagttctttcccctcggctgtcggcggagtctttgggtgtggtggatggaagaggagccgtctgctgagagaagaggaggaactccgctgtctgagtcagcacaggtccaccgaagaccaggagctcagccctccgcgcggtgctctgaat

SEQ ID NO: 93717 - DNA, 62 bp, Homo sapiens
  misc_feature 1..62: note = chr5:2007735-2007797
  misc_feature 1..62: note = hypo
  source 1..62: mol_type = genomic DNA
ggcaacagcctcgatcgggggccgggggaagcggccgagatgtggctcggaggtggcagctg

SEQ ID NO: 93718 - DNA, 188 bp, Homo sapiens
  misc_feature 1..188: note = chr5:2024999-2025187
  misc_feature 1..188: note = hypo
  source 1..188: mol_type = genomic DNA
aactctaagttaaaccgtactttaagttaaaccttaagtctccccataaaggtgtcctagagcagatgtccaccgatccaggcattgcaatgcctgggaatcaatggtgtaatcagcaaggtggaattggatatgtggtgatagctatcgatgtttatgacaggtgggtgcaccgtcaagttggagtc

SEQ ID NO: 93719 - DNA, 439 bp, Homo sapiens; identical to SEQ ID NO: 29401
  misc_feature 1..439: note = chr5:2038424-2038863
  misc_feature 1..439: note = hyper
  source 1..439: mol_type = genomic DNA

SEQ ID NO: 93720 - DNA, 42 bp, Homo sapiens
  misc_feature 1..42: note = chr5:2038947-2038989
  misc_feature 1..42: note = hyper
  source 1..42: mol_type = genomic DNA
cgctggctccagccagtgctgcactcctggcagacaggggcc

SEQ ID NO: 93721 - DNA, 35 bp, Homo sapiens; identical to SEQ ID NO: 40447
  misc_feature 1..35: note = chr5:2112239-2112274
  misc_feature 1..35: note = hypo
  source 1..35: mol_type = genomic DNA

SEQ ID NO: 93722 - DNA, 30 bp, Homo sapiens
  misc_feature 1..30: note = chr5:21291802-21291832
  misc_feature 1..30: note = hypo
  source 1..30: mol_type = genomic DNA
ttacgtaaagggcagcgggataactccaga

SEQ ID NO: 93723 - DNA, 504 bp, Homo sapiens
  misc_feature 1..504: note = chr5:2136910-2137414
  misc_feature 1..504: note = hypo
  source 1..504: mol_type = genomic DNA
agaggtgactgggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagaggtgaccgggcgtgcgtgggtggacagaggtgactaggcattgcttgcgtgggtgggcagaggtgaccgggcttgcgtgcgtgggtggacagaggtgaccaggcgtgcgtgcgtgggcagaggtgactgggcattgcgtgcgtgggtggacagacgtgactaggcgcgagtgcgtgggtggacagaagtgagtaggcgtgcatgcgtgggtggacagaagtgactaggcacgtgcgtgggtggacagaactgactaggcgtgcatgcgtgggtggacagaagtgacttcatggctcattgcagcgagggaggaggcatgctggagaaacacgggcatcaccgtga

SEQ ID NO: 93724 - DNA, 30 bp, Homo sapiens
  misc_feature 1..30: note = chr5:2155918-2155948
  misc_feature 1..30: note = hypo
  source 1..30: mol_type = genomic DNA
agtcatctgcatactcgaacacggatagta

SEQ ID NO: 93725 - DNA, 331 bp, Homo sapiens
  misc_feature 1..331: note = chr5:2180344-2180675
  misc_feature 1..331: note = hypo
  source 1..331: mol_type = genomic DNA
ggcaggagagctccacgcggccccccaccaccttcacggcaggagagctccacgcggccccccaccaccttcacggcaggagagctccacgcggccccccaccaccttcacggcaacactccgggaggagaggggagagagcatctccctcggccttctccgtgaagtctgggacctggagactgtccccccggccaaatgaaggaaaacggtgtttttgggagctcgatttcccttgacaagtcagattttctgttttcagattccattcagctctgcaggctgcagacctgggctcgcgtcctctcacgagatacggggctgctctccc

SEQ ID NO: 93726 - DNA, 230 bp, Homo sapiens
  misc_feature 1..230: note = chr5:2199933-2200163
  misc_feature 1..230: note = hypo
  source 1..230: mol_type = genomic DNA
ccctggtcagtcctgcgtggggtggccatgccagccggggggctcggaatagggctctgagcgggacggcagtgcagtcatgggtaatagagactagagccgagaaatctccatctgctccgctgaacagctccatctccttcaagtaggctccagccaaacaaccctgctccccgcgtggatgcaattccgactggaagctggagaatcccacacgctggcaaggaagg

SEQ ID NO: 93727 - DNA, 180 bp, Homo sapiens
  misc_feature 1..180: note = chr5:2250142-2250322
  misc_feature 1..180: note = hypo
  source 1..180: mol_type = genomic DNA
gctgctgcatctcctcgacgccaccggaggcttcctggtctccgaggttcctttcacaggcacacctgaaagagggttgcagagtagcaacacgtgccgcatgtttaagtaaaatagggttccttttccttaaatatttaacaaacccttcaggatatacgtggacgtaattgaagcatc

SEQ ID NO: 93728 - DNA, 82 bp, Homo sapiens
  misc_feature 1..82: note = chr5:2261231-2261313
  misc_feature 1..82: note = hypo
  source 1..82: mol_type = genomic DNA
gctctgtggctgagacgggcaacacctctcaaatggaaacacctgacgttgcaccagatctcagatgcgaagggcgggggtc

SEQ ID NO: 93729 - DNA, 150 bp, Homo sapiens
  misc_feature 1..150: note = chr5:2261610-2261760
  misc_feature 1..150: note = hypo
  source 1..150: mol_type = genomic DNA
accctcacaggaccacgaggccctggtcggacacaggctgcccgcagccccttcccacaggagcaccaccagtaaggcctttactgtccccttatcccttgctgtttccccaccgacaccctgacgctgagcagccggagagagtggagg

SEQ ID NO: 93730 - DNA, 32 bp, Homo sapiens
  misc_feature 1..32: note = chr5:2268219-2268251
  misc_feature 1..32: note = hypo
  source 1..32: mol_type = genomic DNA
tggtgtaaatattcccgcggggatgctgacct

SEQ ID NO: 93731 - DNA, 288 bp, Homo sapiens
  misc_feature 1..288: note = chr5:22852968-22853256
  misc_feature 1..288: note = hyper
  source 1..288: mol_type = genomic DNA
ttgtttagaacttaccgaagtttcccaaagcaaaaccacgcacaagctcctaattcagctgccagatctgtgtgcagcttcgttcagcttctcactacgctaggcatcactttattaatcatgtatgaatttctgtgcatgcaccctgaagcgatcacacacacgcggtgcaatcccaatcaaaaacggaagccttacctgatggcagaaaaggcagctgcaggagcagcagcaccgacggccgcagcagggtgccaacagctcagccttgcgcggaaggtgagaccc

SEQ ID NO: 93732 - DNA, 51 bp, Homo sapiens
  misc_feature 1..51: note = chr5:22853518-22853569
  misc_feature 1..51: note = hyper
  source 1..51: mol_type = genomic DNA
ctcctgtcatctccccgccctcaaaacaaaacacagcgtgcctttgacaca

SEQ ID NO: 93733 - DNA, 30 bp, Homo sapiens
  misc_feature 1..30: note = chr5:2301052-2301082
  misc_feature 1..30: note = hypo
  source 1..30: mol_type = genomic DNA
ccgtcattcgccatgcgtctcagaaggcag

SEQ ID NO: 93734 - DNA, 30 bp, Homo sapiens; identical to SEQ ID NO: 40452
  misc_feature 1..30: note = chr5:2324383-2324413
  misc_feature 1..30: note = hypo
  source 1..30: mol_type = genomic DNA

SEQ ID NO: 93735 - DNA, 30 bp, Homo sapiens
  misc_feature 1..30: note = chr5:23530297-23530327
  misc_feature 1..30: note = hypo
  source 1..30: mol_type = genomic DNA
cgagatgcagacgaacggagagagaatggg

SEQ ID NO: 93736 - DNA, 39 bp, Homo sapiens
  misc_feature 1..39: note = chr5:2367627-2367666
  misc_feature 1..39: note = hypo
  source 1..39: mol_type = genomic DNA
aaaacaggcctggtgcggtggctcatgcctgtaatccca

SEQ ID NO: 93737 - DNA, 30 bp, Homo sapiens
  misc_feature 1..30: note = chr5:2368819-2368849
  misc_feature 1..30: note = hypo
  source 1..30: mol_type = genomic DNA
aacatctcacacatccgtcaagtggaaacg

SEQ ID NO: 93738 - DNA, 68 bp, Homo sapiens; identical to SEQ ID NO: 14739
  misc_feature 1..68: note = chr5:2369614-2369682
  misc_feature 1..68: note = hypo
  source 1..68: mol_type = genomic DNA

SEQ ID NO: 93739 - DNA, 164 bp, Homo sapiens; identical to SEQ ID NO: 40454
  misc_feature 1..164: note = chr5:2374826-2374990
  misc_feature 1..164: note = hypo
  source 1..164: mol_type = genomic DNA

SEQ ID NO: 93740 - DNA, 195 bp, Homo sapiens
  misc_feature 1..195: note = chr5:2376679-2376874
  misc_feature 1..195: note = hypo
  source 1..195: mol_type = genomic DNA
tctcagagggttgaccgttccctcaatgtgtcccttcttagtaggataagccattggccctgtggcttctcttgggcgccaagggtcaccaggccttccgcactggggtgggacacccaggaagcccagcaggatgggggcccttggtgcccaagaacagccacagggccaacggcttatcgggtgtcttgcccc

SEQ ID NO: 93741 - DNA, 30 bp, Homo sapiens
  misc_feature 1..30: note = chr5:2412208-2412238
  misc_feature 1..30: note = hypo
  source 1..30: mol_type = genomic DNA
cggccacctcatccccggaaaggacgtacc

SEQ ID NO: 93742 - DNA, 30 bp, Homo sapiens
  misc_feature 1..30: note = chr5:24314566-24314596
  misc_feature 1..30: note = hypo
  source 1..30: mol_type = genomic DNA
ctgcctttccctcttcgcaggatcattggc

SEQ ID NO: 93743 - DNA, 166 bp, Homo sapiens
  misc_feature 1..166: note = chr5:2493697-2493863
  misc_feature 1..166: note = hypo
  source 1..166: mol_type = genomic DNA
gggtatagatgtcagcgcctgactgtgcattcaaatacatccatacacacttgagtgggtgtgcgcatgttagtgcctgtgtgcactcatgtgcttgtgtgcgtacttgcacttgcatacatgtgtgctcatgcatgtatgcaagcacctgcgtgagtatgtgcac

SEQ ID NO: 93744 - DNA, 190 bp, Homo sapiens
  misc_feature 1..190: note = chr5:2523561-2523751
  misc_feature 1..190: note = hypo
  source 1..190: mol_type = genomic DNA
ccaggcggccacatgcgtgcccgaaagggaaagcataggctgtctccgcggcctcacttgtttctacttccctgacctgtttgtcccactgacttaccgcctctggaatgaacacccgacagcatggaagggagattcctgtccagtgcctgggctgtactctgcatgccgctctcggttccactttcag

SEQ ID NO: 93745 - DNA, 162 bp, Homo sapiens; identical to SEQ ID NO: 40457
  misc_feature 1..162: note = chr5:2541481-2541643
  misc_feature 1..162: note = hypo
  source 1..162: mol_type = genomic DNA

SEQ ID NO: 93746 - DNA, 30 bp, Homo sapiens; identical to SEQ ID NO: 40458
  misc_feature 1..30: note = chr5:2547162-2547192
  misc_feature 1..30: note = hypo
  source 1..30: mol_type = genomic DNA

SEQ ID NO: 93747 - DNA, 30 bp, Homo sapiens
  misc_feature 1..30: note = chr5:2562122-2562152
  misc_feature 1..30: note = hypo
  source 1..30: mol_type = genomic DNA
caaaatgtgagtatccgaatttcattcatg

SEQ ID NO: 93748 - DNA, 40 bp, Homo sapiens
  misc_feature 1..40: note = chr5:25656060-25656100
  misc_feature 1..40: note = hypo
  source 1..40: mol_type = genomic DNA
ctgttcctattcagccatcttggaacggacccccattaca

SEQ ID NO: 93749 - DNA, 25 bp, Homo sapiens
  misc_feature 1..25: note = chr5:26029110-26029135
  misc_feature 1..25: note = hypo
  source 1..25: mol_type = genomic DNA
gcgcccggcccgaagtaaggcattt

SEQ ID NO: 93750 - DNA, 42 bp, Homo sapiens
  misc_feature 1..42: note = chr5:2642066-2642108
  misc_feature 1..42: note = hypo
  source 1..42: mol_type = genomic DNA
tggctgtgattctctcggagagagcggcgtggccaaaggtgc

SEQ ID NO: 93751 - DNA, 17 bp, Homo sapiens
  misc_feature 1..17: note = chr5:27086133-27086150
  misc_feature 1..17: note = hypo
  source 1..17: mol_type = genomic DNA
tccgtctcaaaaaaaaa

SEQ ID NO: 93752 - DNA, 101 bp, Homo sapiens
  misc_feature 1..101: note = chr5:27267415-27267516
  misc_feature 1..101: note = hypo
  source 1..101: mol_type = genomic DNA
cctgtcggggatgctcgggccgtaagggagcccatggtgggggcagctgagtcctggtgagaattcaagcatggtgcgggtgggccggcagtgcaggggga

SEQ ID NO: 93753 - DNA, 314 bp, Homo sapiens; identical to SEQ ID NO: 29403
  misc_feature 1..314: note = chr5:2738816-2739130
  misc_feature 1..314: note = hyper
  source 1..314: mol_type = genomic DNA

SEQ ID NO: 93754 - DNA, 145 bp, Homo sapiens; identical to SEQ ID NO: 29404
  misc_feature 1..145: note = chr5:2739210-2739355
  misc_feature 1..145: note = hyper
  source 1..145: mol_type = genomic DNA

SEQ ID NO: 93755 - DNA, 252 bp, Homo sapiens; identical to SEQ ID NO: 29405
  misc_feature 1..252: note = chr5:2739551-2739803
  misc_feature 1..252: note = hyper
  source 1..252: mol_type = genomic DNA

SEQ ID NO: 93756 - DNA, 441 bp, Homo sapiens
  misc_feature 1..441: note = chr5:2739860-2740301
  misc_feature 1..441: note = hyper
  source 1..441: mol_type = genomic DNA
cgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtaggaccaggaaggggactgaagcccgggaccagagctgggggtgccaggagcggggcctccagtgggagctcgggggtcctcgcgggttcttctgggtcggttggtggctacccatccccagaagcctggctgcattcccctataaggaggcttcggagggcccgactgggtttcccctccagggcaccgggtcgcaaaagcggcgtcgaaaactcatgaacaggcggccgggtctggggccgccggggcagtcgtggcgtgcggggg

SEQ ID NO: 93757 - DNA, 235 bp, Homo sapiens; identical to SEQ ID NO: 7705
  misc_feature 1..235: note = chr5:2740430-2740665
  misc_feature 1..235: note = hyper
  source 1..235: mol_type = genomic DNA

SEQ ID NO: 93758 - DNA, 155 bp, Homo sapiens
  misc_feature 1..155: note = chr5:2743505-2743660
  misc_feature 1..155: note = hyper
  source 1..155: mol_type = genomic DNA
gcgccccggtgctctcggcagcccccggcccccggggcccacctgagattaaagcgcgaattccgataaatcagctctaaggaaaccctgggccgcggagagcagaagggctgtcgcggatccaccacgcgggcgccgggccgcggagccgggag

SEQ ID NO: 93759 - DNA, 46 bp, Homo sapiens; identical to SEQ ID NO: 2526
  misc_feature 1..46: note = chr5:2743698-2743744
  misc_feature 1..46: note = hyper
  source 1..46: mol_type = genomic DNA

SEQ ID NO: 93760 - DNA, 110 bp, Homo sapiens
  misc_feature 1..110: note = chr5:2747745-2747855
  misc_feature 1..110: note = hyper
  source 1..110: mol_type = genomic DNA
gcagttagtcagaaccgaccccacagcctgctggctgcgcagaccaccgtgcacccaccatcctccactcccaggcaaacagcagtttgggaaaccgactgtctccaggg

SEQ ID NO: 93761 - DNA, 407 bp, Homo sapiens
  misc_feature 1..407: note = chr5:2748083-2748490
  misc_feature 1..407: note = hyper
  source 1..407: mol_type = genomic DNA
ccaacggcagaaaagcggattcaactctgactccttaacaagacaccgaaacacacccaggctcattagggcgacacgctgtaatttgaatttcgtggcaatctgggtttgccgaaactaagacagccacgatagtaatagtcaaaataacagtaaattaagtaaaaataaataataacagggcaagtctaaaaagagggccacaccttctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggac

SEQ ID NO: 93762 - DNA, 231 bp, Homo sapiens; identical to SEQ ID NO: 29413
  misc_feature 1..231: note = chr5:2748549-2748780
  misc_feature 1..231: note = hyper
  source 1..231: mol_type = genomic DNA

SEQ ID NO: 93763 - DNA, 342 bp, Homo sapiens
  misc_feature 1..342: note = chr5:2749065-2749407
  misc_feature 1..342: note = hyper
  source 1..342: mol_type = genomic DNA
cgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 93764 - DNA, 125 bp, Homo sapiens
  misc_feature 1..125: note = chr5:2749604-2749729
  misc_feature 1..125: note = hyper
  source 1..125: mol_type = genomic DNA
cggggcccaggtcatcttgttctccttcttgaggcgccggcgcgcgttggcgaaccaggtggagacctgggtgagggtcatcttggtgatgatggctagcatgatcttctcgcccttggtggggt

SEQ ID NO: 93765 - DNA, 114 bp, Homo sapiens
  misc_feature 1..114: note = chr5:2750008-2750122
  misc_feature 1..114: note = hyper
  source 1..114: mol_type = genomic DNA
ctggctctggggctgcgcttcccgccgcaaaagagcaggaaaaacgcagtgtgattcgggaccagctgttgatcacaaaaagtaccggagttttattctcgaatttctgaacta

SEQ ID NO: 93766 - DNA, 67 bp, Homo sapiens
  misc_feature 1..67: note = chr5:2750703-2750770
  misc_feature 1..67: note = hyper
  source 1..67: mol_type = genomic DNA
tttgaaagcatggtccgctggacagagtaaggccgaaacctgggcgcctcgggccggactccggagc

SEQ ID NO: 93767 - DNA, 128 bp, Homo sapiens; identical to SEQ ID NO: 29416
  misc_feature 1..128: note = chr5:2751854-2751982
  misc_feature 1..128: note = hyper
  source 1..128: mol_type = genomic DNA

SEQ ID NO: 93768 - DNA, 322 bp, Homo sapiens; identical to SEQ ID NO: 29417
  misc_feature 1..322: note = chr5:2752120-2752442
  misc_feature 1..322: note = hyper
  source 1..322: mol_type = genomic DNA

SEQ ID NO: 93769 - DNA, 62 bp, Homo sapiens
  misc_feature 1..62: note = chr5:27523953-27524015
  misc_feature 1..62: note = hypo
  source 1..62: mol_type = genomic DNA
ccaggtgcctgcacacgtgccggctgcgtgcaaggctcctgctgaaccggatgtactgcaca

SEQ ID NO: 93770 - DNA, 1064 bp, Homo sapiens
  misc_feature 1..1064: note = chr5:2752508-2753572
  misc_feature 1..1064: note = hyper
  source 1..1064: mol_type = genomic DNA
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcc

SEQ ID NO: 93771 - DNA, 255 bp, Homo sapiens
  misc_feature 1..255: note = chr5:2754365-2754620
  misc_feature 1..255: note = hyper
  source 1..255: mol_type = genomic DNA
aagatggcctcttcccgtcctgtgtgtattttccccttagcaattatactcctccactgaaatctatatgttccataccgctgctgcctgttactaataaaaaccgtctaccttgcactattaaacagtcgactcttactacatgccgtttttattggtagtgactgtagcaaattaaaatgcctacgcagggacattaaaaacttaacactcgtcattgttattgaaatatataaactacgttttgctttaaag

SEQ ID NO: 93772 - DNA, 30 bp, Homo sapiens
  misc_feature 1..30: note = chr5:2754878-2754908
  misc_feature 1..30: note = hyper
  source 1..30: mol_type = genomic DNA
tcaggcctgtggggtcgctggggagagccc

SEQ ID NO: 93773 - DNA, 1461 bp, Homo sapiens
  misc_feature 1..1461: note = chr5:2755142-2756603
  misc_feature 1..1461: note = hyper
  source 1..1461: mol_type = genomic DNA
ccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 93774 - DNA, 1057 bp, Homo sapiens
  misc_feature 1..1057: note = chr5:2756673-2757730
  misc_feature 1..1057: note = hyper
  source 1..1057: mol_type = genomic DNA
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggttgggttttgctttctttgctttttatttttattttttaatatggctgggaatgcagaaattttaaaaatggatacatttgagtgtgttaaaagtaaaaacttctcttggacaaaacataaactgctaaccgcaacgggggagaagatat

SEQ ID NO: 93775 - DNA, 39 bp, Homo sapiens
  misc_feature 1..39: note = chr5:2865625-2865664
  misc_feature 1..39: note = hypo
  source 1..39: mol_type = genomic DNA
gttgctattggtgtacgccattttgtttgtttgtttgtt

SEQ ID NO: 93776 - DNA, 30 bp, Homo sapiens
  misc_feature 1..30: note = chr5:2889717-2889747
  misc_feature 1..30: note = hypo
  source 1..30: mol_type = genomic DNA
tggaaagactctgagcgggcagggaagagc

SEQ ID NO: 93777 - DNA, 196 bp, Homo sapiens
  misc_feature 1..196: note = chr5:2890721-2890917
  misc_feature 1..196: note = hypo
  source 1..196: mol_type = genomic DNA
ataaacagccggcagcgcattatggaacataaaatttaaaacgctttctgggcctcagcttcctaaagcttctttgattgtcaaacgtcgttactaagtccaagtttaagacatctgccgctctaccttacacaccacgcacaggccgcaaggccaccgggaaatgatgaaaacatgaatgcgggcagcattgctg

SEQ ID NO: 93778 - DNA, 171 bp, Homo sapiens
  misc_feature 1..171: note = chr5:29478680-29478851
  misc_feature 1..171: note = hypo
  source 1..171: mol_type = genomic DNA
gagaaagccaaatgccgcccaggtcattgtgcacagggggcttgcttaagcatgcccgttgtgaaaaattcaatctcttaacacatgtgcggtaagggaaagcaatcaatgtggagtggctcagactaaaagcccacctgtgcagtgggagaagggcgtggagccaccggg

SEQ ID NO: 93779 - DNA, 100 bp, Homo sapiens
  misc_feature 1..100: note = chr5:3000087-3000187
  misc_feature 1..100: note = hypo
  source 1..100: mol_type = genomic DNA
aaaaaacttcattcccttccagaattcaatgttttagcctagtgaacaaagcacaggacagccaggaaaggataaaagaaagaaacgggaggacggaggt

SEQ ID NO: 93780 - DNA, 167 bp, Homo sapiens
  misc_feature 1..167: note = chr5:3027341-3027508
  misc_feature 1..167: note = hypo
  source 1..167: mol_type = genomic DNA
cacgtctcagtccaccggtgaggggcagtgcccccagcgacatgcggtgttttaagcaggtctgacccctggccgcctccacatgtgcacacccatgtaaagtcagtttcctcccaggacatgtagaaggtttggaaggtgatgccaagcgacgtgccttcctcagc

SEQ ID NO: 93781 - DNA, 63 bp, Homo sapiens
  misc_feature 1..63: note = chr5:3028232-3028295
  misc_feature 1..63: note = hypo
  source 1..63: mol_type = genomic DNA
gctctcctctttgtgcggagccgcctcaccttgctgtgcgctcgtggccgtggctcttctctc

SEQ ID NO: 93782 - DNA, 322 bp, Homo sapiens
  misc_feature 1..322: note = chr5:3031752-3032074
  misc_feature 1..322: note = hypo
  source 1..322: mol_type = genomic DNA
gttctatttctctggcgcaccctgactcatacaccaactttatgactttccaacaaaggcagaacaatggaaatggaaaagagatctttggctgccaggggttcagcggggaggcagtgagcaggccaagcaccgagggtttcgagggtggtgaaactgttccaagcgacaggtaatgggggacacatgtcatgatacatttgtccaaaccatagaatgcacagcaccaagagggacccgcatgtgcactgcggcctttgggtgacaatcacccgtcactgtggctcatcccttgtgaccaagctgccgcacagagcagggt

SEQ ID NO: 93783 - DNA, 37 bp, Homo sapiens
  misc_feature 1..37: note = chr5:3051179-3051216
  misc_feature 1..37: note = hypo
  source 1..37: mol_type = genomic DNA
cacacacagtcaagccgccggccgtgtttactgcagc

SEQ ID NO: 93784 - DNA, 99 bp, Homo sapiens
  misc_feature 1..99: note = chr5:30694338-30694437
  misc_feature 1..99: note = hypo
  source 1..99: mol_type = genomic DNA
gtataatttttataacgttgccctctaatttataattatcagaaatgtattatttgagtgattttaaaatatactgcaattgcacgtgaccaatcgcat

SEQ ID NO: 93785 - DNA, 41 bp, Homo sapiens
  misc_feature 1..41: note = chr5:3078657-3078698
  misc_feature 1..41: note = hypo
  source 1..41: mol_type = genomic DNA
atccacaggggactccgccgcgtgtccggagggatccacag

SEQ ID NO: 93786 - DNA, 16 bp, Homo sapiens
  misc_feature 1..16: note = chr5:31035761-31035777
  misc_feature 1..16: note = hypo
  source 1..16: mol_type = genomic DNA
ccgtctaaaaaaaaaa

SEQ ID NO: 93787 - DNA, 147 bp, Homo sapiens; identical to SEQ ID NO: 40519
  misc_feature 1..147: note = chr5:31111601-31111748
  misc_feature 1..147: note = hypo
  source 1..147: mol_type = genomic DNA

SEQ ID NO: 93788 - DNA, 23 bp, Homo sapiens
  misc_feature 1..23: note = chr5:31134444-31134467
  misc_feature 1..23: note = hypo
  source 1..23: mol_type = genomic DNA
ttggccaggcaggtgcggtggct

SEQ ID NO: 93789 - DNA, 36 bp, Homo sapiens
  misc_feature 1..36: note = chr5:3114736-3114772
  misc_feature 1..36: note = hypo
  source 1..36: mol_type = genomic DNA
actcagagtccagcgcggccacgtggtggaagatgt

SEQ ID NO: 93790 - DNA, 30 bp, Homo sapiens
  misc_feature 1..30: note = chr5:31182513-31182543
  misc_feature 1..30: note = hypo
  source 1..30: mol_type = genomic DNA
ggcaaaccgcaaacccggaaatcggctcta

SEQ ID NO: 93791 - DNA, 422 bp, Homo sapiens
  misc_feature 1..422: note = chr5:31193869-31194291
  misc_feature 1..422: note = hyper
  source 1..422: mol_type = genomic DNA
agctgcagtttcagccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagccaatcagagagagagccctctccgcccggtgggtgccgcgccggagttgggagggatgctctcagcctgcgagcccgggtcggggcgggcgcgcgggtccggctgcgcgggcggcgctgctgccgctgctcaggaccgacgccgcttcccggggagcctgggcaccgctcctccgcctcctggtaagaccgatccgccgtggggctgggtgggggcaccgggaag

SEQ ID NO: 93792 - DNA, 121 bp, Homo sapiens
  misc_feature 1..121: note = chr5:31194311-31194432
  misc_feature 1..121: note = hyper
  source 1..121: mol_type = genomic DNA
cgctgcctttctctacgccggcagaggctgccaggggagctctggcatttgcaaagttggctggtcaattaccaaagggcgctggtgcgtgcaggtcccgccgagccgtttggggcttgat

SEQ ID NO: 93793 - DNA, 112 bp, Homo sapiens
  misc_feature 1..112: note = chr5:3122092-3122204
  misc_feature 1..112: note = hyper
  source 1..112: mol_type = genomic DNA
ccagatccatggcagcgcggtttctctctgccatagtctcggctgtgtcatggctgcatcccacgtgggcgacacacagtgccccagcgccaggcagcggggacaatggtcc

SEQ ID NO: 93794 - DNA, 40 bp, Homo sapiens
  misc_feature 1..40: note = chr5:3142468-3142508
  misc_feature 1..40: note = hypo
  source 1..40: mol_type = genomic DNA
gttctgatacaactgcgcacaaaaccggcattgaagtgtc

SEQ ID NO: 93795 - DNA, 84 bp, Homo sapiens
  misc_feature 1..84: note = chr5:31572153-31572237
  misc_feature 1..84: note = hypo
  source 1..84: mol_type = genomic DNA
agtattttgcacagccgacacagagcatgtgaccgaaatgagcaaacaggaagaagagggtgtgaaaaaatgcaaagtatgaaa

SEQ ID NO: 93796 - DNA, 29 bp, Homo sapiens
  misc_feature 1..29: note = chr5:31621855-31621884
  misc_feature 1..29: note = hypo
  source 1..29: mol_type = genomic DNA
ttgatatcacagggccgggcgtggtggct

SEQ ID NO: 93797 - DNA, 78 bp, Homo sapiens
  misc_feature 1..78: note = chr5:31629209-31629287
  misc_feature 1..78: note = hypo
  source 1..78: mol_type = genomic DNA
cactgcattttatcccgagcgtgatgtttgtgctctgatgagtttccgaggatggtgataagacgttttaaaaagatg

SEQ ID NO: 93798 - DNA, 235 bp, Homo sapiens
  misc_feature 1..235: note = chr5:31634979-31635214
  misc_feature 1..235: note = hypo
  source 1..235: mol_type = genomic DNA
gtataaaaaaattaccgtggcaaccaatgcttcaatagtacaaatggaaggctgagagacaaagatataaaataatgggttggcttgtaaggggaagcccaggagaaaattacaaattcttcacgtgcagtattattagaccacactggaaacaataaaacacatttgcataaaatccaacgtcacgctcatggatacagtgaaactcattttcaatgtacgtggatgaaaagtg

SEQ ID NO: 93799 - DNA, 329 bp, Homo sapiens
  misc_feature 1..329: note = chr5:31639603-31639932
  misc_feature 1..329: note = hyper
  source 1..329: mol_type = genomic DNA
gaggcccggcacccccgagaccgtgtgtgcccaggaaagtttagctacaaatccgggtgcgggaatcccagccctggcagggcggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaagacagggccgggacctcctgctcgggcgcgcatcccgggtccccatccctgggccgtcttctggtcccttcctccgacaggagtggagg

SEQ ID NO: 93800 - DNA, 24 bp, Homo sapiens
  misc_feature 1..24: note = chr5:31662743-31662767
  misc_feature 1..24: note = hypo
  source 1..24: mol_type = genomic DNA
tttctttttttgagacggagtctg

SEQ ID NO: 93801 - DNA, 36 bp, Homo sapiens
  misc_feature 1..36: note = chr5:31664530-31664566
  misc_feature 1..36: note = hypo
  source 1..36: mol_type = genomic DNA
atacacagacacatgcgcatgcatgcatacacacac

SEQ ID NO: 93802 - DNA, 101 bp, Homo sapiens
  misc_feature 1..101: note = chr5:31691579-31691680
  misc_feature 1..101: note = hypo
  source 1..101: mol_type = genomic DNA
ggcgccacctgcttttattctcttatctggcgccacctgcttttattctcttatctggcgccacctgcttttattctcttatctggcgccacctgctttta

SEQ ID NO: 93803 - DNA, 191 bp, Homo sapiens
  misc_feature 1..191: note = chr5:31738160-31738351
  misc_feature 1..191: note = hypo
  source 1..191: mol_type = genomic DNA
catttttggaatgttcgagagatcacaagatatgaaatctacaatgtattcagatcatgggaatttttcccagaatcgtttcgttccagagagctgagaaaatgatagcgcacctcaccacacatggagtcctcagctttaacctcagactttctcacaactgcccagtctgataacggaaattcttcacc

SEQ ID NO: 93804 - DNA, 182 bp, Homo sapiens
  misc_feature 1..182: note = chr5:31750531-31750713
  misc_feature 1..182: note = hypo
  source 1..182: mol_type = genomic DNA
caccagatgcaggaacgctacagcgaacaaaacaaacaggaaccctgtccccgtggaggtagaggagaggagacaaagcatgaacacaatgtgcaagtgcatgtgtaacacgagggtccgccaaggatgggtgccgcgagggtgaggagtgtggtcctgaggggcgccgctccagggaggat

SEQ ID NO: 93805 - DNA, 30 bp, Homo sapiens
  misc_feature 1..30: note = chr5:31769285-31769315
  misc_feature 1..30: note = hypo
  source 1..30: mol_type = genomic DNA
gcttgtgtgtaggtccgtactgaccagata

SEQ ID NO: 93806 - DNA, 30 bp, Homo sapiens
  misc_feature 1..30: note = chr5:31784008-31784038
  misc_feature 1..30: note = hypo
  source 1..30: mol_type = genomic DNA
gcagggagtttttgccgagtgacgtcatgg

SEQ ID NO: 93807 - DNA, 30 bp, Homo sapiens
  misc_feature 1..30: note = chr5:31796388-31796418
  misc_feature 1..30: note = hypo
  source 1..30: mol_type = genomic DNA
tctttctggttagggcgagggcagcaatgc

SEQ ID NO: 93808 - DNA, 30 bp, Homo sapiens
  misc_feature 1..30: note = chr5:31832893-31832923
  misc_feature 1..30: note = hypo
  source 1..30: mol_type = genomic DNA
gcctgggtgacagagcgagactctgtctca

SEQ ID NO: 93809 - DNA, 838 bp, Homo sapiens
  misc_feature 1..838: note = chr5:31854940-31855778
  misc_feature 1..838: note = hyper
  source 1..838: mol_type = genomic DNA
tgagcaggggagtggcgagccgagtttaggattgcattacaggcttttcctaacctcctccaccgcggcgcggagggaggaggggggggtcctcccacagacctggagccggcggagagcagccttcgggaagtcctgcaggagccgcgttccaggagggcagctggcagccgccccaggcccccgggccgcctgcaggtgattaggctaatgagctgccccgggggcgcggagaccggcctggcgagcggattacccggcgcccagctgctgccggcggagactcccaggagctccggagaggaaccctccgaaggtgacttcagaactggaggtaggaaatcggcttctcaggcgaaagcctcaggttttctgatctgatccaggtcgggtgcagactggggctgaatccacaaatgtggagatttagccacagcctcggaggcgcggagcggccacctaagcgtctgcccttctcgtctcccggatcactggggtgtgttgtttttaaagtgggggatttgcgtgttgagagacggtttgtgttcctcgggaggagtaagtgacttggagctggtttgtcaatggctggacggaaggaggcgccccggctgtgtgtgacgggcagggaaggggtgcccagaggggacaggtaatagggggttccggagccacggcggtttcagaaccttggggcctgtgccgttgaagccccggtaggggcggggggcatggcagcagcccgggaaatctgtcatactgtcccccatccctcgctagcagcagaatgactgagacggagcaaagctgctttctctacccgcgggaactgtggatg

SEQ ID NO: 93810 - DNA, 39 bp, Homo sapiens
  misc_feature 1..39: note = chr5:31863261-31863300
  misc_feature 1..39: note = hypo
  source 1..39: mol_type = genomic DNA
cttacagccatgagccactgcgcccggccatgagacctt

SEQ ID NO: 93811 - DNA, 49 bp, Homo sapiens
  misc_feature 1..49: note = chr5:31889103-31889152
  misc_feature 1..49: note = hypo
  source 1..49: mol_type = genomic DNA
cttgatgctcctccccgagccccctcccctatcacgtatgttttgcggg

SEQ ID NO: 93812 - DNA, 28 bp, Homo sapiens
  misc_feature 1..28: note = chr5:31920417-31920445
  misc_feature 1..28: note = hypo
  source 1..28: mol_type = genomic DNA
aattttttctgagcgaaagatagagatt

SEQ ID NO: 93813 - DNA, 29 bp, Homo sapiens
  misc_feature 1..29: note = chr5:31921511-31921540
  misc_feature 1..29: note = hypo
  source 1..29: mol_type = genomic DNA
gggtgcagtggctcacgcctgtaatccca

SEQ ID NO: 93814 - DNA, 30 bp, Homo sapiens
  misc_feature 1..30: note = chr5:31924663-31924693
  misc_feature 1..30: note = hypo
  source 1..30: mol_type = genomic DNA
tggcgtgtgttgcctcgtagtggtgggaat

SEQ ID NO: 93815 - DNA, 180 bp, Homo sapiens
  misc_feature 1..180: note = chr5:3197714-3197894
  misc_feature 1..180: note = hyper
  source 1..180: mol_type = genomic DNA
ttgcacatccgttatcgtggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccc

SEQ ID NO: 93816 - DNA, 24 bp, Homo sapiens
  misc_feature 1..24: note = chr5:3197991-3198015
  misc_feature 1..24: note = hyper
  source 1..24: mol_type = genomic DNA
cgcccggcacgagctccgtgacga

SEQ ID NO: 93817 - DNA, 30 bp, Homo sapiens; identical to SEQ ID NO: 40523
  misc_feature 1..30: note = chr5:31982994-31983024
  misc_feature 1..30: note = hypo
  source 1..30: mol_type = genomic DNA

SEQ ID NO: 93818 - DNA, 55 bp, Homo sapiens
  misc_feature 1..55: note = chr5:32048718-32048773
  misc_feature 1..55: note = hypo
  source 1..55: mol_type = genomic DNA
atgttggaggtctcccgagatggccggaaacactccctcccgcagctgctggact

SEQ ID NO: 93819 - DNA, 1394 bp, Homo sapiens
  misc_feature 1..1394: note = chr5:320654-322048
  misc_feature 1..1394: note = hyper
  source 1..1394: mol_type = genomic DNA
agacttttcctgagccgacagcagacagcgagtgcaaaggccccaaggcccgcacgccttattcagagaacagcaggaggcgcggggcgggttgggggcgtcagggagacggggtttgactgagaacctgggggcgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagctcaggatccaaaagcatcttaatattctctataattcgccaaaaaccatgactccttttacattttcgaaacgacctcatggggcaggcgagggggcacacgctctcctcactttacctgttcgggtctacaccgcccggctctagggccggcagctcagcacagccggccgcgagcgctggggaggggacgggggcgcagggagaaccgggggaccctgggcgcacacagaccccagggggaacgcagggcctggaggggctcagcgcgcgacccccgcctcggggcacggagactccgggggatcactgggacgcgaagggcgcagggcggaccccaggggaaccggatggcgtctccggttcgccagggcagctggggcagccggacccgagacagccggacccgcgggcgccctctgccgcctcccggccctggatgctgcggggcggggcgggcggctcgcgtgccggggtggggcagtccctggagccgccgcgggttcccgggatgcgagcgccggcacccgccgccacagctcctggccagggcgcgctgccccgcgggtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctca

SEQ ID NO: 93820 - DNA, 191 bp, Homo sapiens; identical to SEQ ID NO: 29354
  misc_feature 1..191: note = chr5:322061-322252
  misc_feature 1..191: note = hyper
  source 1..191: mol_type = genomic DNA

SEQ ID NO: 93821 - DNA, 134 bp, Homo sapiens; identical to SEQ ID NO: 40464
  misc_feature 1..134: note = chr5:3221047-3221181
  misc_feature 1..134: note = hypo
  source 1..134: mol_type = genomic DNA

SEQ ID NO: 93822 - DNA, 138 bp, Homo sapiens; identical to SEQ ID NO: 29355
  misc_feature 1..138: note = chr5:322265-322403
  misc_feature 1..138: note = hyper
  source 1..138: mol_type = genomic DNA

SEQ ID NO: 93823 - DNA, 30 bp, Homo sapiens
  misc_feature 1..30: note = chr5:32331996-32332026
  misc_feature 1..30: note = hypo
  source 1..30: mol_type = genomic DNA
tcacctcatgtgagacgacatcaactgaaa

SEQ ID NO: 93824 - DNA, 24 bp, Homo sapiens
  misc_feature 1..24: note = chr5:32526558-32526582
  misc_feature 1..24: note = hypo
  source 1..24: mol_type = genomic DNA
tgaaatccttctccacgccgggcg

SEQ ID NO: 93825 - DNA, 30 bp, Homo sapiens
  misc_feature 1..30: note = chr5:32616284-32616314
  misc_feature 1..30: note = hypo
  source 1..30: mol_type = genomic DNA
tcaagcagtctgtggcgcttgcttgctttc

SEQ ID NO: 93826 - DNA, 30 bp, Homo sapiens; identical to SEQ ID NO: 40465
  misc_feature 1..30: note = chr5:3269777-3269807
  misc_feature 1..30: note = hypo
  source 1..30: mol_type = genomic DNA

SEQ ID NO: 93827 - DNA, 40 bp, Homo sapiens
  misc_feature 1..40: note = chr5:32709839-32709879
  misc_feature 1..40: note = hyper
  source 1..40: mol_type = genomic DNA
tgctgttaagggaggcgagcgctgacgccagaagttgcca

SEQ ID NO: 93828 - DNA, 870 bp, Homo sapiens
  misc_feature 1..870: note = chr5:32710093-32710963
  misc_feature 1..870: note = hyper
  source 1..870: mol_type = genomic DNA
atgtatttaaatgtgcgggacttaattgtcagaattctcccgcccagtgtagcccgttcacattgcaaatgacttggctgcagtaggcacagaaggtccagttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaaggtgagagcaagcggcacctaaggatttttgcaccgaaaccacaatttctagaaccatccctttcccccagtcct

SEQ ID NO: 93829 - DNA, 406 bp, Homo sapiens
  misc_feature 1..406: note = chr5:32711023-32711429
  misc_feature 1..406: note = hyper
  source 1..406: mol_type = genomic DNA
atgtgtgcgtgcgcgcgcgcatttctctactttaaagcacgtttccttttttgaagccaggagctggagagcgtggaaagggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggc

SEQ ID NO: 93830 - DNA, 672 bp, Homo sapiens
  misc_feature 1..672: note = chr5:32711430-32712102
  misc_feature 1..672: note = hyper
  source 1..672: mol_type = genomic DNA
cgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggc

SEQ ID NO: 93831 - DNA, 563 bp, Homo sapiens; identical to SEQ ID NO: 2546
  misc_feature 1..563: note = chr5:32712289-32712852
  misc_feature 1..563: note = hyper
  source 1..563: mol_type = genomic DNA

SEQ ID NO: 93832 - DNA, 191 bp, Homo sapiens
  misc_feature 1..191: note = chr5:3273116-3273307
  misc_feature 1..191: note = hypo
  source 1..191: mol_type = genomic DNA
tgctgagttgtgtggcgcccatgtggcaagacctcacagaatactttttttggttcaatttctgaaaacgaaaaacaaaaaccaaaaaaaccgataaaccagtccctccaaaaacacagtaataaaactacactaagcatggatataaatggctcctgaacctcagagggtaggagcgcactcaggtttgc

SEQ ID NO: 93833 - DNA, 79 bp, Homo sapiens; identical to SEQ ID NO: 40525
  misc_feature 1..79: note = chr5:32750220-32750299
  misc_feature 1..79: note = hypo
  source 1..79: mol_type = genomic DNA

SEQ ID NO: 93834 - DNA, 17 bp, Homo sapiens
  misc_feature 1..17: note = chr5:3283330-3283347
  misc_feature 1..17: note = hypo
  source 1..17: mol_type = genomic DNA
ggcgcacacacatgaac

SEQ ID NO: 93835 - DNA, 45 bp, Homo sapiens
  misc_feature 1..45: note = chr5:32835693-32835738
  misc_feature 1..45: note = hypo
  source 1..45: mol_type = genomic DNA
catgcagtaggcaatcggtaaatatttctttttctctcttttttt

SEQ ID NO: 93836 - DNA, 113 bp, Homo sapiens
  misc_feature 1..113: note = chr5:32855659-32855772
  misc_feature 1..113: note = hypo
  source 1..113: mol_type = genomic DNA
ctttaagtatgttttcgttattgtgagcaaatacccacaacgttttcgtcttgcagatctgaaactctatacccattaaacaaaaccttcgctttacacgccccctgcccccg

SEQ ID NO: 93837 - DNA, 21 bp, Homo sapiens
  misc_feature 1..21: note = chr5:32937597-32937618
  misc_feature 1..21: note = hypo
  source 1..21: mol_type = genomic DNA
ccatcacgtccagcctgtgaa

SEQ ID NO: 93838 - DNA, 30 bp, Homo sapiens
  misc_feature 1..30: note = chr5:33138834-33138864
  misc_feature 1..30: note = hypo
  source 1..30: mol_type = genomic DNA
tatcatttaattccacggaccacatgggtg

SEQ ID NO: 93839 - DNA, 96 bp, Homo sapiens
  misc_feature 1..96: note = chr5:33162506-33162602
  misc_feature 1..96: note = hypo
  source 1..96: mol_type = genomic DNA
taaaacaaggatcatcgatgttgtctacaatgcatctaataatgagctggttcgtaccaagaccctggtgaagaattgcatcgtgctcatcgacag

SEQ ID NO: 93840 - DNA, 22 bp, Homo sapiens
  misc_feature 1..22: note = chr5:33201158-33201180
  misc_feature 1..22: note = hypo
  source 1..22: mol_type = genomic DNA
ccgcgcccggccccagtgtctt

SEQ ID NO: 93841 - DNA, 25 bp, Homo sapiens
  misc_feature 1..25: note = chr5:33234426-33234451
  misc_feature 1..25: note = hypo
  source 1..25: mol_type = genomic DNA
tgagctgacacgcctggctgaattt

SEQ ID NO: 93842 - DNA, 580 bp, Homo sapiens
  misc_feature 1..580: note = chr5:3324753-3325333
  misc_feature 1..580: note = hypo
  source 1..580: mol_type = genomic DNA
tgatcccaggaccctcggccaccgcccttcctgcccaggcccgtcctgggacccgggtggccctcgtcatagaaggctgtgttgcccccagcaagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccctcaaggggagagggccgcatccctgttccccgccttcctcgccatgactggacgcagcggggcgccctgtccctgcctggagctcttccagctcagggccccatcagcgccaccaccttggactgccgccatccagggcgcagggcccgctgccccacacctgagggacacagccaggctttctgcttggcctgctgttctctacgtctcacaggcgtcttgctttccaccatgcaacttcacaatctgcccaaatgtccttttattaaaactagtcgacaaagtcccaaa

SEQ ID NO: 93843 - DNA, 79 bp, Homo sapiens
  misc_feature 1..79: note = chr5:33272980-33273059
  misc_feature 1..79: note = hypo
  source 1..79: mol_type = genomic DNA
aacaagagcaaaactccgtcaaaaaaaaaaagaattgcatcttacccatggggcagatctaaaccgctattgttcaccc

SEQ ID NO: 93844 - DNA, 36 bp, Homo sapiens
  misc_feature 1..36: note = chr5:33286168-33286204
  misc_feature 1..36: note = hypo
  source 1..36: mol_type = genomic DNA
cactatgaattacctagtctgcggtattctgtgata

SEQ ID NO: 93845 - DNA, 81 bp, Homo sapiens
  misc_feature 1..81: note = chr5:33298096-33298177
  misc_feature 1..81: note = hypo
  source 1..81: mol_type = genomic DNA
tgcttctgctatcgcgcaccctgctggcgcaccctgctggcgcaccctgctggcgcaccctgctggcgcaccctgctggcg

SEQ ID NO: 93846 - DNA, 35 bp, Homo sapiens
  misc_feature 1..35: note = chr5:3339624-3339659
  misc_feature 1..35: note = hypo
  source 1..35: mol_type = genomic DNA
caccttgaaaccacacggaacgttctaaattgtgc

SEQ ID NO: 93847 - DNA, 65 bp, Homo sapiens
  misc_feature 1..65: note = chr5:33442966-33443031
  misc_feature 1..65: note = hypo
  source 1..65: mol_type = genomic DNA
agatgagaaagcaggcgtaggaacagtaacttgctcaaacccagtatccccgtttttttccttcc

SEQ ID NO: 93848 - DNA, 97 bp, Homo sapiens
  misc_feature 1..97: note = chr5:33509494-33509591
  misc_feature 1..97: note = hypo
  source 1..97: mol_type = genomic DNA
aaggctgaatagtaccgtattctattgtatgtatgtataccaccttttaaaaatctattcattcaggctgggcgcggtgactcaagcctgtaatccc

SEQ ID NO: 93849 - DNA, 197 bp, Homo sapiens; identical to SEQ ID NO: 40531
  misc_feature 1..197: note = chr5:33550087-33550284
  misc_feature 1..197: note = hypo
  source 1..197: mol_type = genomic DNA

SEQ ID NO: 93850 - DNA, 157 bp, Homo sapiens
  misc_feature 1..157: note = chr5:33596013-33596170
  misc_feature 1..157: note = hypo
  source 1..157: mol_type = genomic DNA
agctccagctgttagcgatggttacctgggtggacaagccttttcatggcacttcttctgtctcccattgggctgtgtttctgggtcacagaatgtagctttcaccatcccgcggcccttctttatgcaatgggcagtttggcggcggatacctggg

SEQ ID NO: 93851 - DNA, 190 bp, Homo sapiens; identical to SEQ ID NO: 40532
  misc_feature 1..190: note = chr5:33880065-33880255
  misc_feature 1..190: note = hypo
  source 1..190: mol_type = genomic DNA

SEQ ID NO: 93852 - DNA, 502 bp, Homo sapiens; identical to SEQ ID NO: 29513
  misc_feature 1..502: note = chr5:33892054-33892556
  misc_feature 1..502: note = hyper
  source 1..502: mol_type = genomic DNA

SEQ ID NO: 93853 - DNA, 79 bp, Homo sapiens
  misc_feature 1..79: note = chr5:33936153-33936232
  misc_feature 1..79: note = hyper
  source 1..79: mol_type = genomic DNA
agctcaactctccctcgcggcgcgggcgcggctgggttcagcacctcggaaagcgcccctcgcggcgccccgggattac

SEQ ID NO: 93854 - DNA, 129 bp, Homo sapiens; identical to SEQ ID NO: 29515
  misc_feature 1..129: note = chr5:33936233-33936362
  misc_feature 1..129: note = hyper
  source 1..129: mol_type = genomic DNA

SEQ ID NO: 93855 - DNA, 547 bp, Homo sapiens
  misc_feature 1..547: note = chr5:33936363-33936910
  misc_feature 1..547: note = hyper
  source 1..547: mol_type = genomic DNA
tggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagc

SEQ ID NO: 93856 - DNA, 30 bp, Homo sapiens; identical to SEQ ID NO: 40467
  misc_feature 1..30: note = chr5:3422389-3422419
  misc_feature 1..30: note = hypo
  source 1..30: mol_type = genomic DNA

SEQ ID NO: 93857 - DNA, 262 bp, Homo sapiens
  misc_feature 1..262: note = chr5:344035-344297
  misc_feature 1..262: note = hyper
  source 1..262: mol_type = genomic DNA
tgcacgtacgcgggccggaagcggaggaggcccctgcagaaacagtaaagtatcccgccttctgcttgtgtgggttgttgcacccatggaaggggagggttggggtttgccttgaaaacggagttttaggaacagggcgagcgaggaaggcttcgggagccgggcgggccggggctgagctccggcgcgggcggcgcaggagtcgtctccccgcagcgccccggtgcccggagcccccggcgaggctcgtccctgcgccctc

SEQ ID NO: 93858 - DNA, 30 bp, Homo sapiens
  misc_feature 1..30: note = chr5:3452425-3452455
  misc_feature 1..30: note = hypo
  source 1..30: mol_type = genomic DNA
acactgtgcaggggacgaagaatgcagaga

SEQ ID NO: 93859 - DNA, 263 bp, Homo sapiens
  misc_feature 1..263: note = chr5:3454166-3454429
  misc_feature 1..263: note = hypo
  source 1..263: mol_type = genomic DNA
cagataaaaaagccacgctgacaggcccctgtctgctgtcctcacccagtgaggcctctgcaacgccgcccctaacactcacactagcacagtggacatcacccactaacacacgctcccgctagcacggcaggcgtcacccactaacacacgctcccgctagcacggcgggcgtcacccactaacacacgctcccgctagcacggcgggcgtcacccactaacacacgctcccgctagcacggtgggcgtcacccactaaca

SEQ ID NO: 93860 - DNA, 209 bp, Homo sapiens
  misc_feature 1..209: note = chr5:34555944-34556153
  misc_feature 1..209: note = hypo
  source 1..209: mol_type = genomic DNA
acctggcctatccttggagattttaatagccatagttatcatttgtttatcaccaactacgtgcctggcattttgcacacagtaatttgcacttcacattaatcctgtgaggcaagtattatcacttctatttggtggaagaggaagctgagagtcagagcagttaagtaacttgccctaacttgcaaagctagcgacagtagagaagc

SEQ ID NO: 93861 - DNA, 37 bp, Homo sapiens; identical to SEQ ID NO: 29517
  misc_feature 1..37: note = chr5:34655873-34655910
  misc_feature 1..37: note = hyper
  source 1..37: mol_type = genomic DNA

SEQ ID NO: 93862 - DNA, 70 bp, Homo sapiens
  misc_feature 1..70: note = chr5:34656351-34656421
  misc_feature 1..70: note = hyper
  source 1..70: mol_type = genomic DNA
gcgggggccggcgcccggcggccacgtggtggtgctgccgctgcccccgccccgccggcctagcccggga

SEQ ID NO: 93863 - DNA, 320 bp, Homo sapiens
  misc_feature 1..320: note = chr5:34656642-34656962
  misc_feature 1..320: note = hyper
  source 1..320: mol_type = genomic DNA
tttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtggagatgagggtagagcgggaagacccggccaagttaggagaagggttcttcccgggtcctccgcgactcgcaggccggctggggcggggcgcggggcaggggccgcggcggagggagcgcgggtgggaatgaatgagcagacccggagatgcaccctg

SEQ ID NO: 93864 - DNA, 105 bp, Homo sapiens
  misc_feature 1..105: note = chr5:34839926-34840031
  misc_feature 1..105: note = hypo
  source 1..105: mol_type = genomic DNA
agaaatcacatttttcgttttgtgcttccgaggtttctcctatcatctaacagcaacaactaaaacagacacatgaatttcattttattgttttattttattttg

SEQ ID NO: 93865 - DNA, 184 bp, Homo sapiens
  misc_feature 1..184: note = chr5:3487829-3488013
  misc_feature 1..184: note = hypo
  source 1..184: mol_type = genomic DNA
tcaggctacaacttccgaaaatgcagcttagcaagagacagctcgatgaacaggcatccagaacatggcaccttcttgcaaagaaaggctgaccttgaggaactgctgagatacgcacttgtttctgcaaagagtcactgtgtttcccacccaatacccagagtgaacgcgctcagtgcgcggg

SEQ ID NO: 93866 - DNA, 397 bp, Homo sapiens
  misc_feature 1..397: note = chr5:35229693-35230090
  misc_feature 1..397: note = hyper
  source 1..397: mol_type = genomic DNA
cttccagcttcctcccgggctgcaattcctctgcctaggtgcctccgtccagctccggcttctggcccggaggctgctcatctgcccctacccccgctgacttttgggaggagcaacacctttcaggtcagcattgctaaccctaaactttccccgccggatgcccgcgaggctgctgcggcggcggctgctgctgatgggagagtctcgagtccggctttcatcacatcacctgtctgcgccccttccccctccccgctctttttttcttttctttttattttgacgcaaataatttgcattctgagaatcccacaatcaacgccgaaactcatgctcaaggatacaggtgaagatgcctttgacaaaggcgaatgcgagccgagtgcagtttgta

SEQ ID NO: 93867 - DNA, 158 bp, Homo sapiens
  misc_feature 1..158: note = chr5:3535627-3535785
  misc_feature 1..158: note = hypo
  source 1..158: mol_type = genomic DNA
cagcgacttctctcccgcgagcttatgggaaacgccctgcgcagctgaccagtcatccgacgttgcggagagcagcgtgggtccgagggaaggctgcggccggggacgcccagactggaggccttgtctgccccacccagcctcggacttctcaggct

SEQ ID NO: 93868 - DNA, 30 bp, Homo sapiens
  misc_feature 1..30: note = chr5:3536520-3536550
  misc_feature 1..30: note = hypo
  source 1..30: mol_type = genomic DNA
ggtccgagtataatacgcccggcatacact

SEQ ID NO: 93869 - DNA, 33 bp, Homo sapiens
  misc_feature 1..33: note = chr5:353889-353922
  misc_feature 1..33: note = hypo
  source 1..33: mol_type = genomic DNA
ccgggaccgcctcaacgccgagttggaccacct

SEQ ID NO: 93870 - DNA, 327 bp, Homo sapiens
  misc_feature 1..327: note = chr5:3590331-3590658
  misc_feature 1..327: note = hyper
  source 1..327: mol_type = genomic DNA
gtcatttcaagaaggcggagatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 93871 - DNA, 100 bp, Homo sapiens; identical to SEQ ID NO: 29426
  misc_feature 1..100: note = chr5:3590803-3590903
  misc_feature 1..100: note = hyper
  source 1..100: mol_type = genomic DNA

SEQ ID NO: 93872 - DNA, 347 bp, Homo sapiens
  misc_feature 1..347: note = chr5:3591111-3591458
  misc_feature 1..347: note = hyper
  source 1..347: mol_type = genomic DNA
tttataaaatatttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggcactccccgcagcctgcgaccgtcctgcgtccttcgcttctgggcgtttccttctggggtttccttggagcggctcgagtcgactcctcccgcctgcccaactca

SEQ ID NO: 93873 - DNA, 180 bp, Homo sapiens
  misc_feature 1..180: note = chr5:3591857-3592037
  misc_feature 1..180: note = hyper
  source 1..180: mol_type = genomic DNA
gcaggaggccagggccgcgccacccgttgcatcccgcggcaggtctgtgtcgcctggttctcggcgccaaaggctggtcccacagacggcttccgggagtgatgcgtccccacgagcatcctcctcttccttagcgacccccggactgcagagcttcaagaccagcgaactgtttcccaa

SEQ ID NO: 93874 - DNA, 239 bp, Homo sapiens
  misc_feature 1..239: note = chr5:3592642-3592881
  misc_feature 1..239: note = hyper
  source 1..239: mol_type = genomic DNA
cgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggccaagcaga

SEQ ID NO: 93875 - DNA, 473 bp, Homo sapiens; identical to SEQ ID NO: 29430
  misc_feature 1..473: note = chr5:3594047-3594520
  misc_feature 1..473: note = hyper
  source 1..473: mol_type = genomic DNA

SEQ ID NO: 93876 - DNA, 100 bp, Homo sapiens
  misc_feature 1..100: note = chr5:3594777-3594877
  misc_feature 1..100: note = hyper
  source 1..100: mol_type = genomic DNA
cggagctctccagccacgaggcgcagaagtggcctgccagcgccttcccaggctcagggaggcgaggaggcccgtgcacttggcatcttctcccgggagc

SEQ ID NO: 93877 - DNA, 314 bp, Homo sapiens
  misc_feature 1..314: note = chr5:3595055-3595369
  misc_feature 1..314: note = hyper
  source 1..314: mol_type = genomic DNA
cgcgttccacacaagtttcctgtctgcctctgcacacctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 93878 - DNA, 253 bp, Homo sapiens
  misc_feature 1..253: note = chr5:3595849-3596102
  misc_feature 1..253: note = hyper
  source 1..253: mol_type = genomic DNA
ggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccgcgaccggcctccatctcccggcccgcccgagcgcgcccggccggc

SEQ ID NO: 93879 - DNA, 170 bp, Homo sapiens; identical to SEQ ID NO: 29434
  misc_feature 1..170: note = chr5:3596555-3596725
  misc_feature 1..170: note = hyper
  source 1..170: mol_type = genomic DNA

SEQ ID NO: 93880 - DNA, 186 bp, Homo sapiens
  misc_feature 1..186: note = chr5:3596824-3597010
  misc_feature 1..186: note = hyper
  source 1..186: mol_type = genomic DNA
cggccagggcgcccgggcaggcccacggggttcctgcaggtcggcccggcgtagcgtagcaggacttcccttcctggccgcgggttccactcgcgcggcctctttagttttcgaaccgagtctggaaaacttggttttctccctctttagcagctccgagatagttgtatccgagtttgccagaca

SEQ ID NO: 93881 - DNA, 510 bp, Homo sapiens
  misc_feature 1..510: note = chr5:3597357-3597867
  misc_feature 1..510: note = hyper
  source 1..510: mol_type = genomic DNA
cattggcctgtctgccggtccaaatcatccattttccttggtctgactgcaaggtcggtgcttaaacttcggacggctggtgaattgtgcggcgggcgcggggccctgggaggcagccccctcctgggtcgctgcccgcgggataaagcaatttccaagcacccgcgatatctccccgctccccgcaggagaagcggggagtaaacgcccctcaagtgtgcacaagcaaagagcgggtttccctgtaacttttcttgtagttttgaaagaaagcggcccggctgcctttcaggtctcttactatcgaaaaagatcagcccccattttgttcaggcggcggggaggccgggacgcgatgagagatttacaaggtgtcctttcaaaaagaattcccagtggagacgaggctgaaacgtcttctttacaattacaaccaaaataattagaaaagcgcaaagtacattttggaacgattgggcaaaaacgaaatctagccgcagaaatgttttc

SEQ ID NO: 93882 - DNA, 30 bp, Homo sapiens
  misc_feature 1..30: note = chr5:359746-359776
  misc_feature 1..30: note = hypo
  source 1..30: mol_type = genomic DNA
cacccgcagcagcatcggagtcctcttgtt

SEQ ID NO: 93883 - DNA, 30 bp, Homo sapiens
  misc_feature 1..30: note = chr5:3598863-3598893
  misc_feature 1..30: note = hyper
  source 1..30: mol_type = genomic DNA
gctctgggccctttacgtttggagaaatgg

SEQ ID NO: 93884 - DNA, 81 bp, Homo sapiens; identical to SEQ ID NO: 29437
  misc_feature 1..81: note = chr5:3599364-3599445
  misc_feature 1..81: note = hyper
  source 1..81: mol_type = genomic DNA

SEQ ID NO: 93885 - DNA, 106 bp, Homo sapiens; identical to SEQ ID NO: 29438
  misc_feature 1..106: note = chr5:3599502-3599608
  misc_feature 1..106: note = hyper
  source 1..106: mol_type = genomic DNA

SEQ ID NO: 93886 - DNA, 246 bp, Homo sapiens
  misc_feature 1..246: note = chr5:3600074-3600320
  misc_feature 1..246: note = hyper
  source 1..246: mol_type = genomic DNA
cgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccc

SEQ ID NO: 93887 - DNA, 249 bp, Homo sapiens
  misc_feature 1..249: note = chr5:3600390-3600639
  misc_feature 1..249: note = hyper
  source 1..249: mol_type = genomic DNA
cgtccacctgtcccctagctgggaatgcagaggcctggctaggtgtggtagcgtggggtgcagcatgagccgggagggtaccaggcagtggccgctgagccctggggctgcgcttaatccctgcttcaatttagaaagccagacaaggccctagggctctcccaagagagctttgccctaccggcgggcctgctacggggtggtggtggggtgaggggtgacgtttttcggcgaatctgcctgggcagc

SEQ ID NO: 93888 - DNA, 21 bp, Homo sapiens
  misc_feature 1..21: note = chr5:3600732-3600753
  misc_feature 1..21: note = hyper
  source 1..21: mol_type = genomic DNA
cgtccccaggccagattcgcc

SEQ ID NO: 93889 - DNA, 346 bp, Homo sapiens
  misc_feature 1..346: note = chr5:3601025-3601371
  misc_feature 1..346: note = hyper
  source 1..346: mol_type = genomic DNA
ggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctg

SEQ ID NO: 93890 - DNA, 653 bp, Homo sapiens
  misc_feature 1..653: note = chr5:3602804-3603457
  misc_feature 1..653: note = hyper
  source 1..653: mol_type = genomic DNA
agcgagggggaaagtcggggcgctggtgtcttttcagaggttccaggaaagagggaggctcgcgttaggactaggaggtgccagtccacggctcctacccgctcccgacgcccgcatccttctacagccctccaccccgttcctggtccctgtagaggggaaggtcctctccctgccccgaggcgggaggaaaagcggcgaagaggaggctcgaagggcgccgcgtagggcaagtgggccgaggacaccgggggcgcgtcggggagcggggagtgggcggggtgggatgaggcagggaggagccgggccggagcggagtggagtggaccgcgggcggacggactcgggccgggccccggggagcagctccgcagtcggaatggacgtgctccaggcgccctctatggtccgaaagcggaatgcggccttgagcagcgcccatctcgctcctggggtgtgggggcaactctgggggcgctgggccttggggctccgtgggcacgagcctgcatttgtagtgatgggaaccaatttgtgttccaaggctgcacccactggttctttttgtgtgttttgggggagtgccgggcctgcaggttaggctactggcatttggagggagtgggcactgggctctacgtggggtgctctta

SEQ ID NO: 93891 - DNA, 167 bp, Homo sapiens; identical to SEQ ID NO: 29443
  misc_feature 1..167: note = chr5:3606268-3606435
  misc_feature 1..167: note = hyper
  source 1..167: mol_type = genomic DNA

SEQ ID NO: 93892 - DNA, 437 bp, Homo sapiens
  misc_feature 1..437: note = chr5:3606711-3607148
  misc_feature 1..437: note = hyper
  source 1..437: mol_type = genomic DNA
cgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagccacgacccaccctccacgggtcccacgccctcaggcagaacgcaatggtgggaatgacgccaaggtcggtgaaatcttccaaattgaagggcttttattttaaattccgattcccctttgaaacagccctttcgatgagggaagaagccagctcggtttctgcgtgcgtgtttatgatctacctgtgagcgcggcgctctggaaggtcacccaggctgcggacgccctgatagcggggtgacagcctg

SEQ ID NO: 93893 - DNA, 30 bp, Homo sapiens
  misc_feature 1..30: note = chr5:36127942-36127972
  misc_feature 1..30: note = hypo
  source 1..30: mol_type = genomic DNA
ggaagaacaaaagctcgggtggctttgcca

SEQ ID NO: 93894 - DNA, 34 bp, Homo sapiens
  misc_feature 1..34: note = chr5:3613874-3613908
  misc_feature 1..34: note = hypo
  source 1..34: mol_type = genomic DNA
tgtattgccaccccccgcccggtgtgtacgggat

SEQ ID NO: 93895 - DNA, 30 bp, Homo sapiens
  misc_feature 1..30: note = chr5:3623145-3623175
  misc_feature 1..30: note = hypo
  source 1..30: mol_type = genomic DNA
gcaccctcaagcatgcggttcagggaaatg

SEQ ID NO: 93896 - DNA, 34 bp, Homo sapiens
  misc_feature 1..34: note = chr5:3639390-3639424
  misc_feature 1..34: note = hypo
  source 1..34: mol_type = genomic DNA
gtgtgtcttgcagtagagacgcccagcatccctt

SEQ ID NO: 93897 - DNA, 20 bp, Homo sapiens
  misc_feature 1..20: note = chr5:36541411-36541431
  misc_feature 1..20: note = hypo
  source 1..20: mol_type = genomic DNA
ttaaaacaggccgggcgtgg

SEQ ID NO: 93898 - DNA, 69 bp, Homo sapiens
  misc_feature 1..69: note = chr5:36606740-36606809
  misc_feature 1..69: note = hyper
  source 1..69: mol_type = genomic DNA
tgcttacgcgcgctgcggattgttgctccgttgtacctgctggggaattcacctcgttactgcttgata

SEQ ID NO: 93899 - DNA, 86 bp, Homo sapiens
  misc_feature 1..86: note = chr5:36607023-36607109
  misc_feature 1..86: note = hyper
  source 1..86: mol_type = genomic DNA
cggagttgagtcattcggggtggattgggggcagattgtggcgcgagatctagaaaaggatcaaggttgagcggatctgcttaaaa

SEQ ID NO: 93900 - DNA, 30 bp, Homo sapiens
  misc_feature 1..30: note = chr5:36607317-36607347
  misc_feature 1..30: note = hyper
  source 1..30: mol_type = genomic DNA
gcgagaagtcatttgcgaggagtcctttgg

SEQ ID NO: 93901 - DNA, 454 bp, Homo sapiens
  misc_feature 1..454: note = chr5:36690192-36690646
  misc_feature 1..454: note = hyper
  source 1..454: mol_type = genomic DNA
gttctgttagctgaacgggcctggaggaagcgtggcgggaaggctggatccccgccgcaggggctgcggggctgtggctgcctgcgggctgggcagggccgggcgcacgccctccttccgggtggccgcgggccccgaccccaggctgccgtcagtcgagcggcctccgcagcggccgcgcttccccttctcccacccgggtggtcccagaactggagcaacaatggccggctctgtgtggccgcgtcctggggccaaagcagtcgggacgtgtcacgccgagggagggctccgaatgaatacgctgacaataagaaggaagggagagcgagggaggtgatgggcagcgtcctagagggaaagcgggagatgagaaatctacgagatccgcgaggcggcgtccggggagcgagcctcatagtggccaccagggggaatgcggagctcaccttgg

SEQ ID NO: 93902 - DNA, 30 bp, Homo sapiens
  misc_feature 1..30: note = chr5:36693244-36693274
  misc_feature 1..30: note = hyper
  source 1..30: mol_type = genomic DNA
cccttcgtgtgccagcgacctccccttctg

SEQ ID NO: 93903 - DNA, 176 bp, Homo sapiens; identical to SEQ ID NO: 14743
  misc_feature 1..176: note = chr5:3674048-3674224
  misc_feature 1..176: note = hypo
  source 1..176: mol_type = genomic DNA

SEQ ID NO: 93904 - DNA, 30 bp, Homo sapiens
  misc_feature 1..30: note = chr5:36938092-36938122
  misc_feature 1..30: note = hypo
  source 1..30: mol_type = genomic DNA
ttgcattaatagcaccggttgtttgccatg

SEQ ID NO: 93905 - DNA, 36 bp, Homo sapiens
  misc_feature 1..36: note = chr5:36985760-36985796
  misc_feature 1..36: note = hypo
  source 1..36: mol_type = genomic DNA
aggggtgaatcagagcgacatcgaggggatcagtct

SEQ ID NO: 93906 - DNA, 178 bp, Homo sapiens
  misc_feature 1..178: note = chr5:3724955-3725133
  misc_feature 1..178: note = hypo
  source 1..178: mol_type = genomic DNA
agcacaatcacccaccgccgcccttggcttggagtgggaaccccttttgctcatgtggctcccaggtgggccattgcaccaccctgcttttcctcactccccgcagctcgtgccagctgcctagtcagtcccaatgagagagcctggatacctcagttgctggcgcaggattcactca

SEQ ID NO: 93907 - DNA, 21 bp, Homo sapiens
  misc_feature 1..21: note = chr5:37255526-37255547
  misc_feature 1..21: note = hypo
  source 1..21: mol_type = genomic DNA
tcttggcggtgggtgcaggac

SEQ ID NO: 93908 - DNA, 101 bp, Homo sapiens
  misc_feature 1..101: note = chr5:37371474-37371575
  misc_feature 1..101: note = hyper
  source 1..101: mol_type = genomic DNA
gagggaggagggatacggtaggtgggagctaggtcgtgtgtctggcctaggaggttggtcaggttccgttggtttaagcgcgtgctcgacctgagtcttgg

SEQ ID NO: 93909 - DNA, 314 bp, Homo sapiens
  misc_feature 1..314: note = chr5:3740703-3741017
  misc_feature 1..314: note = hypo
  source 1..314: mol_type = genomic DNA
ggctgcttcccaggccgtcatcccagcacggcttcctcactgggaggacgcggcttgttcccatttctggagtcaggctgtatgggcccctccacaatcttcagcgccgcgtccctgcaggtccacatgtcccccgcgggccctcccctggtttccgatgcccatcacccaacctcttctgtgtcctcagcccggggtgggggtgcagcccctgcaggtgcctcagggtgtctgtgctcccagccctacccactgctcggtcaaaccttcacatcgccttctctcctgcgcgcagctggcggcttctatcttct

SEQ ID NO: 93910 - DNA, 276 bp, Homo sapiens
  misc_feature 1..276: note = chr5:374077-374353
  misc_feature 1..276: note = hyper
  source 1..276: mol_type = genomic DNA
cgatgccgggaggggcgcgcccctgccgccgcacctacgcgcttctcggggaaaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggggcgaccccagc

SEQ ID NO: 93911 - DNA, 121 bp, Homo sapiens
  misc_feature 1..121: note = chr5:3761119-3761240
  misc_feature 1..121: note = hypo
  source 1..121: mol_type = genomic DNA
gagccagaacatgcccgctgaatgcggctctagcagctgtcgtgggccttcagagaggaagaatcttaaggcgcgtccaagacaagcggagtcgaggactccgtttcggggaggtttacct

SEQ ID NO: 93912 - DNA, 56 bp, Homo sapiens
  misc_feature 1..56: note = chr5:3761567-3761623
  misc_feature 1..56: note = hypo
  source 1..56: mol_type = genomic DNA
gtgtgggtgcacatgcgctccctccatctccgtgggctttgcgtctctgtgtgggt

SEQ ID NO: 93913 - DNA, 69 bp, Homo sapiens
  misc_feature 1..69: note = chr5:3775375-3775444
  misc_feature 1..69: note = hypo
  source 1..69: mol_type = genomic DNA
ggaaggtggccagctcgccatcccctcaggctgacctgccgacctctcccgtggcggttgcctgttctt

SEQ ID NO: 93914 - DNA, 122 bp, Homo sapiens; identical to SEQ ID NO: 29523
  misc_feature 1..122: note = chr5:37834615-37834737
  misc_feature 1..122: note = hyper
  source 1..122: mol_type = genomic DNA

SEQ ID NO: 93915 - DNA, 3110 bp, Homo sapiens
  misc_feature 1..3110: note = chr5:37836626-37839736
  misc_feature 1..3110: note = hyper
  source 1..3110: mol_type = genomic DNA
gctggtttgcaaactcgggaaaaagctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagagatttgaatccaggactggcaagaaagcccctctcctaacctcgacggggatggttagttggggtggagggcgttaggaacgtgcaggcaaccgggtgaggaatgtagctttgccagacctcgcccggaggaggtgagccctccatttttaggttctcagcacctttgcagcagcccctcccccggcctgcgcttttccttggcacagatcaaaacaagctcaatagtaagttgcactcttggcaatgatagtatctctgcacgtccagagaggacacatttcgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagtt

SEQ ID NO: 93916 - DNA, 268 bp, Homo sapiens; identical to SEQ ID NO: 2549
  misc_feature 1..268: note = chr5:37839807-37840075
  misc_feature 1..268: note = hyper
  source 1..268: mol_type = genomic DNA

SEQ ID NO: 93917 - DNA, 144 bp, Homo sapiens; identical to SEQ ID NO: 2550
  misc_feature 1..144: note = chr5:37840076-37840220
  misc_feature 1..144: note = hyper
  source 1..144: mol_type = genomic DNA

SEQ ID NO: 93918 - DNA, 96 bp, Homo sapiens; identical to SEQ ID NO: 2551
  misc_feature 1..96: note = chr5:37840267-37840363
  misc_feature 1..96: note = hyper
  source 1..96: mol_type = genomic DNA

SEQ ID NO: 93919 - DNA, 210 bp, Homo sapiens; identical to SEQ ID NO: 29529
  misc_feature 1..210: note = chr5:37840529-37840739
  misc_feature 1..210: note = hyper
  source 1..210: mol_type = genomic DNA

SEQ ID NO: 93920 - DNA, 165 bp, Homo sapiens; identical to SEQ ID NO: 14745
  misc_feature 1..165: note = chr5:3806428-3806593
  misc_feature 1..165: note = hypo
  source 1..165: mol_type = genomic DNA

SEQ ID NO: 93921 - DNA, 17 bp, Homo sapiens
  misc_feature 1..17: note = chr5:38247048-38247065
  misc_feature 1..17: note = hypo
  source 1..17: mol_type = genomic DNA
gcttgggactgggtgcg

SEQ ID NO: 93922 - DNA, 135 bp, Homo sapiens
  misc_feature 1..135: note = chr5:38257406-38257541
  misc_feature 1..135: note = hyper
  source 1..135: mol_type = genomic DNA
aacattgtttcctcccgcgctcccaaacataggctaactgtgaagagccaggacgcccaccgagtcctggcagcgttgcaaggtggggagggggcgggcgcggtcctgtcgctagtgactgcagatttcctctgc

SEQ ID NO: 93923 - DNA, 367 bp, Homo sapiens; identical to SEQ ID NO: 29531
  misc_feature 1..367: note = chr5:38257542-38257909
  misc_feature 1..367: note = hyper
  source 1..367: mol_type = genomic DNA

SEQ ID NO: 93924 - DNA, 726 bp, Homo sapiens
  misc_feature 1..726: note = chr5:38257944-38258670
  misc_feature 1..726: note = hyper
  source 1..726: mol_type = genomic DNA
cgccaggcttaacttggagtttcatctcctccccaggagggtctcaagttgccttcctctgccgggaagggcccccactcccccgctccaggccctaatctccacccggcgtcccagtctgagcggcctggcctcagctctccatctgcgagccttaaatcccatttatcttcttagcgcctcagacccggacggtcccgcctctcttcctctcacccccaccccacttgcaaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcac

SEQ ID NO: 93925 - DNA, 287 bp, Homo sapiens; identical to SEQ ID NO: 29534
  misc_feature 1..287: note = chr5:38258671-38258958
  misc_feature 1..287: note = hyper
  source 1..287: mol_type = genomic DNA

SEQ ID NO: 93926 - DNA, 34 bp, Homo sapiens
  misc_feature 1..34: note = chr5:38259223-38259257
  misc_feature 1..34: note = hyper
  source 1..34: mol_type = genomic DNA
tgacagttgggacagcgatcgtgctgtctcaatt

SEQ ID NO: 93927 - DNA, 154 bp, Homo sapiens
  misc_feature 1..154: note = chr5:38556207-38556361
  misc_feature 1..154: note = hyper
  source 1..154: mol_type = genomic DNA
ggcagaagttctgggcgctggagtccgcgtcccccaggacacgagggtgacccaagggcgcgcggagagcggcgggacccggagcggcgctctccggggtcactcccctaggacgctccgcagagctgggagcgctgccccaccccgcccgggc

SEQ ID NO: 93928 - DNA, 24 bp, Homo sapiens
  misc_feature 1..24: note = chr5:38556411-38556435
  misc_feature 1..24: note = hyper
  source 1..24: mol_type = genomic DNA
cgcccacccgcccccaggactcac

SEQ ID NO: 93929 - DNA, 238 bp, Homo sapiens; identical to SEQ ID NO: 29537
  misc_feature 1..238: note = chr5:38556436-38556674
  misc_feature 1..238: note = hyper
  source 1..238: mol_type = genomic DNA

SEQ ID NO: 93930 - DNA, 212 bp, Homo sapiens
  misc_feature 1..212: note = chr5:38556773-38556985
  misc_feature 1..212: note = hyper
  source 1..212: mol_type = genomic DNA
cgccgctcggctgggggcgcagcgggcccggccccgcccctgacccgcccctgcccccggccccggccccgccccaacccgcgcgcccccgccgatccccggccgcgcgcccgcgcgcgcgggtgctccaaggagtcggaggaacgcggccgcgcgacgggccccggacgccgagggtggtgcttcctccgagcctccggtggtgaggccgc

SEQ ID NO: 93931 - DNA, 72 bp, Homo sapiens
  misc_feature 1..72: note = chr5:38557271-38557343
  misc_feature 1..72: note = hyper
  source 1..72: mol_type = genomic DNA
tcctggtcctcctgccgggtgtggggctcccctgcccgagatggccagcgggcgcgccgagagtatcctgga

SEQ ID NO: 93932 - DNA, 149 bp, Homo sapiens; identical to SEQ ID NO: 40475
  misc_feature 1..149: note = chr5:3856433-3856582
  misc_feature 1..149: note = hypo
  source 1..149: mol_type = genomic DNA

SEQ ID NO: 93933 - DNA, 187 bp, Homo sapiens
  misc_feature 1..187: note = chr5:3859680-3859867
  misc_feature 1..187: note = hypo
  source 1..187: mol_type = genomic DNA
gaatggaagagtgatcgctgattgtttgggctcagagaggcctaccagcctgactgttggaaaagcacattagacagatgggatgtagcggctagaagagcaggtgccagacggaaaatccactcatgaagtcagagctacctgtggcaccggtaccctgttggaagagcctcgctgttcttcttct

SEQ ID NO: 93934 - DNA, 30 bp, Homo sapiens
  misc_feature 1..30: note = chr5:386774-386804
  misc_feature 1..30: note = hypo
  source 1..30: mol_type = genomic DNA
tccaggcttcagccacgggtctgtagggaa

SEQ ID NO: 93935 - DNA, 255 bp, Homo sapiens
  misc_feature 1..255: note = chr5:38845617-38845872
  misc_feature 1..255: note = hyper
  source 1..255: mol_type = genomic DNA
cgccaaatggaaacacggccaaaatttagttaaaggacttctcttgcctgaagattttcggacggggatctcacgggtttggcctctgggttgggatgacaagtgcccctgtgggatacacagccccaggcctcatcggtcactcggcttacctctggttccgccggctggcccgtgcgtccttggccggggcaggagcagcgctgcgcgcggggcacggagcctcggccgccgagttttcggtttccaagtttc

SEQ ID NO: 93936 - DNA, 21 bp, Homo sapiens
  misc_feature 1..21: note = chr5:38846468-38846489
  misc_feature 1..21: note = hyper
  source 1..21: mol_type = genomic DNA
cgcccccggcctgcctacctg

SEQ ID NO: 93937 - DNA, 34 bp, Homo sapiens
  misc_feature 1..34: note = chr5:39248593-39248627
  misc_feature 1..34: note = hypo
  source 1..34: mol_type = genomic DNA
aacatggagaaacctcgaagacgtaatgctaagt

SEQ ID NO: 93938 - DNA, 36 bp, Homo sapiens; identical to SEQ ID NO: 40535
  misc_feature 1..36: note = chr5:39343165-39343201
  misc_feature 1..36: note = hypo
  source 1..36: mol_type = genomic DNA

SEQ ID NO: 93939 - DNA, 634 bp, Homo sapiens
  misc_feature 1..634: note = chr5:39424929-39425563
  misc_feature 1..634: note = hyper
  source 1..634: mol_type = genomic DNA
cgagcatgacttccccgcgcccggagcctccaggctacagcgcagcggatgcggcgggcctcgcttaaatagccgccggccgggagcttcggagccgcgcggccactcccggcgagagatatggttctaatcagatgctggcagctgaggactccccaggaatgtgccaggatgtttttgctgcctgggcttggtaactccccctcaacgtgtctgcagagtcttccaaacttaactgtttattaactcgcgctgcagcggcgcagaggaccccgctcccctgagctccgcgagccccaccagctgggggcgatcgcagggacccagcgacgggaggggaaatgtgttcggggagaagtcaaaagccccagaccgacgcgggcggggggcgggtgcaaataaggacaggaaagggaagctctggaggaaaggggtgggatccaccgagcttcgtttcacagatccgttccctggattgccactgcgagtgatgtggcacacggagtcatcctaaccaacccgttggggccctttgaacaaaggactgcctttactcctgacttttctgacaagggacaacggttcctgcgcagatctgcagtttctaaagttgatcgcgcgattggatttgctc

SEQ ID NO: 93940 - DNA, 130 bp, Homo sapiens
  misc_feature 1..130: note = chr5:398801-398931
  misc_feature 1..130: note = hypo
  source 1..130: mol_type = genomic DNA
tccgttttaagctgccgacactgggaggaggcattgccgttgtcaccgatgggcttctgtgagaagggctgggctggcagggccttctgccgccaggcctgggtcctgcgggctccggaggccgtgagtg

SEQ ID NO: 93941 - DNA, 32 bp, Homo sapiens
  misc_feature 1..32: note = chr5:400157-400189
  misc_feature 1..32: note = hyper
  source 1..32: mol_type = genomic DNA
cgcccggtgcccgctcgcgtgactagccgccg

SEQ ID NO: 93942 - DNA, 28 bp, Homo sapiens
  misc_feature 1..28: note = chr5:40066927-40066955
  misc_feature 1..28: note = hypo
  source 1..28: mol_type = genomic DNA
ggtccgggagtctggcggcagggatggc

SEQ ID NO: 93943 - DNA, 18 bp, Homo sapiens
  misc_feature 1..18: note = chr5:40294097-40294115
  misc_feature 1..18: note = hypo
  source 1..18: mol_type = genomic DNA
gcccggcctatttttctc

SEQ ID NO: 93944 - DNA, 93 bp, Homo sapiens
  misc_feature 1..93: note = chr5:40680534-40680627
  misc_feature 1..93: note = hyper
  source 1..93: mol_type = genomic DNA
ctgaccctgggggctcgtgaggctgccaccgctgctgccgctacaggtgagatggcgttgggctgacgttggggtcaacgggtagagaacgca

SEQ ID NO: 93945 - DNA, 265 bp, Homo sapiens
  misc_feature 1..265: note = chr5:40680963-40681228
  misc_feature 1..265: note = hyper
  source 1..265: mol_type = genomic DNA
cagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagt

SEQ ID NO: 93946 - DNA, 579 bp, Homo sapiens; identical to SEQ ID NO: 29544
  misc_feature 1..579: note = chr5:40681261-40681840
  misc_feature 1..579: note = hyper
  source 1..579: mol_type = genomic DNA

SEQ ID NO: 93947 - DNA, 25 bp, Homo sapiens
  misc_feature 1..25: note = chr5:40682069-40682094
  misc_feature 1..25: note = hyper
  source 1..25: mol_type = genomic DNA
gcctttaggtcggggctgggattcc

SEQ ID NO: 93948 - DNA, 194 bp, Homo sapiens
  misc_feature 1..194: note = chr5:4083866-4084060
  misc_feature 1..194: note = hypo
  source 1..194: mol_type = genomic DNA
ccattcctcctctcacgctttcccggggtagacaccttgaacgccaacaagcgattgtcacctggaggctgagtgtggcaccctgacaggctttttctggggtcctgaacacctggaaggcacaagtccctctgcagtggaggtgccattaggtgggtacagtgagagtcagggagaaacgccctgcaggctga

SEQ ID NO: 93949 - DNA, 25 bp, Homo sapiens
  misc_feature 1..25: note = chr5:40861757-40861782
  misc_feature 1..25: note = hypo
  source 1..25: mol_type = genomic DNA
agagagaattcttggcggggcgcgg

SEQ ID NO: 93950 - DNA, 22 bp, Homo sapiens
  misc_feature 1..22: note = chr5:41041433-41041455
  misc_feature 1..22: note = hypo
  source 1..22: mol_type = genomic DNA
aatacacatcttcagcggggtg

SEQ ID NO: 93951 - DNA, 30 bp, Homo sapiens
  misc_feature 1..30: note = chr5:411982-412012
  misc_feature 1..30: note = hypo
  source 1..30: mol_type = genomic DNA
ccccagcttctacctcgtgtgggatgtgag

SEQ ID NO: 93952 - DNA, 217 bp, Homo sapiens; identical to SEQ ID NO: 40479
  misc_feature 1..217: note = chr5:4144299-4144516
  misc_feature 1..217: note = hypo
  source 1..217: mol_type = genomic DNA

SEQ ID NO: 93953 - DNA, 30 bp, Homo sapiens
  misc_feature 1..30: note = chr5:4145036-4145066
  misc_feature 1..30: note = hypo
  source 1..30: mol_type = genomic DNA
atgcagagtgctgaccgcacagcttactac

SEQ ID NO: 93954 - DNA, 34 bp, Homo sapiens; identical to SEQ ID NO: 29546
  misc_feature 1..34: note = chr5:41510835-41510869
  misc_feature 1..34: note = hyper
  source 1..34: mol_type = genomic DNA

SEQ ID NO: 93955 - DNA, 49 bp, Homo sapiens
  misc_feature 1..49: note = chr5:41587836-41587885
  misc_feature 1..49: note = hypo
  source 1..49: mol_type = genomic DNA
acctccccagtgctgcggtcttggtccccgaacacggacaaaggcccct

SEQ ID NO: 93956 - DNA, 30 bp, Homo sapiens
  misc_feature 1..30: note = chr5:41746611-41746641
  misc_feature 1..30: note = hypo
  source 1..30: mol_type = genomic DNA
atgcacagagcatagcgataaacacacaac

SEQ ID NO: 93957 - DNA, 22 bp, Homo sapiens
  misc_feature 1..22: note = chr5:41777225-41777247
  misc_feature 1..22: note = hypo
  source 1..22: mol_type = genomic DNA
ttacaaaaaaggggccgggtgc

SEQ ID NO: 93958 - DNA, 196 bp, Homo sapiens
  misc_feature 1..196: note = chr5:42123791-42123987
  misc_feature 1..196: note = hypo
  source 1..196: mol_type = genomic DNA
gctttctcagatcagcgggcatatactacataataagaatttgtgttaatgcggtctggtaaatatatcacaactggcatagcaactgcagttggggctacagttggttaaactccagtagtcctttgttacgttttgatctatagaatttttgcaggaactacactggtgaagtaagtgacggaaatgatgggga

SEQ ID NO: 93959 - DNA, 30 bp, Homo sapiens
  misc_feature 1..30: note = chr5:423138-423168
  misc_feature 1..30: note = hypo
  source 1..30: mol_type = genomic DNA
ccctgtcctctgattcggctgccacagctc

SEQ ID NO: 93960 - DNA, 75 bp, Homo sapiens
  misc_feature 1..75: note = chr5:42423455-42423530
  misc_feature 1..75: note = hyper
  source 1..75: mol_type = genomic DNA
tgctttcatttggaacgggcaggcggagaggaaggaagtgtattgcaactaccaatattttcctctaggaggagc

SEQ ID NO: 93961 - DNA, 162 bp, Homo sapiens
  misc_feature 1..162: note = chr5:42423809-42423971
  misc_feature 1..162: note = hyper
  source 1..162: mol_type = genomic DNA
ccaagcctgacagcccgcgagctgccaagcagggcgcagccatgggaagaggaggagggctagggagcggcggcggcggcggcagcggcagcagcagctgctacagtggcggtggcggcggcggctgctgctgagcccgggcggcggcggggaccccgggct

SEQ ID NO: 93962 - DNA, 544 bp, Homo sapiens
  misc_feature 1..544: note = chr5:42424615-42425159
  misc_feature 1..544: note = hyper
  source 1..544: mol_type = genomic DNA
cgcgtttgtgcgggccgcagccgcacgttggcaccgatggaactggggtcagtagagtgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtg

SEQ ID NO: 93963 - DNA, 30 bp, Homo sapiens
  misc_feature 1..30: note = chr5:427604-427634
  misc_feature 1..30: note = hypo
  source 1..30: mol_type = genomic DNA
agttcgtgccacctgcgcatggggtggcac

SEQ ID NO: 93964 - DNA, 34 bp, Homo sapiens; identical to SEQ ID NO: 40480
  misc_feature 1..34: note = chr5:4278472-4278506
  misc_feature 1..34: note = hypo
  source 1..34: mol_type = genomic DNA

SEQ ID NO: 93965 - DNA, 31 bp, Homo sapiens; identical to SEQ ID NO: 40481
  misc_feature 1..31: note = chr5:4279105-4279136
  misc_feature 1..31: note = hypo
  source 1..31: mol_type = genomic DNA

SEQ ID NO: 93966 - DNA, 33 bp, Homo sapiens
  misc_feature 1..33: note = chr5:427958-427991
  misc_feature 1..33: note = hypo
  source 1..33: mol_type = genomic DNA
gacagaagaagaaggcgccgtcaggagccatgc

SEQ ID NO: 93967 - DNA, 43 bp, Homo sapiens
  misc_feature 1..43: note = chr5:42915864-42915907
  misc_feature 1..43: note = hypo
  source 1..43: mol_type = genomic DNA
aggttgaagtacacacgcccagggcacccgctgcagcccaggc

SEQ ID NO: 93968 - DNA, 88 bp, Homo sapiens; identical to SEQ ID NO: 29550
  misc_feature 1..88: note = chr5:42950080-42950168
  misc_feature 1..88: note = hyper
  source 1..88: mol_type = genomic DNA

SEQ ID NO: 93969 - DNA, 30 bp, Homo sapiens
  misc_feature 1..30: note = chr5:42950529-42950559
  misc_feature 1..30: note = hyper
  source 1..30: mol_type = genomic DNA
ggtaggaaaaaaagtcgctttcggcgggac

SEQ ID NO: 93970 - DNA, 467 bp, Homo sapiens
  misc_feature 1..467: note = chr5:42950845-42951312
  misc_feature 1..467: note = hyper
  source 1..467: mol_type = genomic DNA
gaggcagggctaacccggggttgttaggattagaattccgaggctacaggaaacccggaattgctgagatgtgagtcacagggtgactcagcctcgttacgatgaaacagtaacttcctactacctagaaatcgcagccagggccagaccggtgtttgtcctaagtcggaacttgattgggctgagaaatcacattgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 93971 - DNA, 693 bp, Homo sapiens; identical to SEQ ID NO: 433
  misc_feature 1..693: note = chr5:42951419-42952112
  misc_feature 1..693: note = hyper
  source 1..693: mol_type = genomic DNA

SEQ ID NO: 93972 - DNA, 126 bp, Homo sapiens
  misc_feature 1..126: note = chr5:429675-429801
  misc_feature 1..126: note = hypo
  source 1..126: mol_type = genomic DNA
cacccgacttgtcctcggcccctcggcgctgcaggcccaggccctggtaaccaagtgcagctcagccttgccgcgcgatcctgcagccgccactgggcagcccgctttgttcgtggcctccccact

SEQ ID NO: 93973 - DNA, 457 bp, Homo sapiens; identical to SEQ ID NO: 434
  misc_feature 1..457: note = chr5:42991785-42992242
  misc_feature 1..457: note = hyper
  source 1..457: mol_type = genomic DNA

SEQ ID NO: 93974 - DNA, 180 bp, Homo sapiens; identical to SEQ ID NO: 435
  misc_feature 1..180: note = chr5:42992375-42992555
  misc_feature 1..180: note = hyper
  source 1..180: mol_type = genomic DNA

SEQ ID NO: 93975 - DNA, 42 bp, Homo sapiens; identical to SEQ ID NO: 436
  misc_feature 1..42: note = chr5:42992556-42992598
  misc_feature 1..42: note = hyper
  source 1..42: mol_type = genomic DNA

SEQ ID NO: 93976 - DNA, 285 bp, Homo sapiens
  misc_feature 1..285: note = chr5:42992782-42993067
  misc_feature 1..285: note = hyper
  source 1..285: mol_type = genomic DNA
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttccttttgttttgttttgagacagagtctcgccgtgtcgcccagc

SEQ ID NO: 93977 - DNA, 240 bp, Homo sapiens
  misc_feature 1..240: note = chr5:42993307-42993547
  misc_feature 1..240: note = hyper
  source 1..240: mol_type = genomic DNA
ctgcgcccagccggtgactacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccc

SEQ ID NO: 93978 - DNA, 1136 bp, Homo sapiens
  misc_feature 1..1136: note = chr5:42993847-42994983
  misc_feature 1..1136: note = hyper
  source 1..1136: mol_type = genomic DNA
ccaaagcctcaagtttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccgccgaacgcgactttttcctcttgtggaccaagtcgggatatatcagctactacgattttttagtcgtaaacaggtttaaccatgactgggttttgttggtttcttgttgttgttgttgtttgtttttgtttttgtcctaagaaatgtagacttaggtgtaacatgtaccggtttagatctaacagggatatcctaatcacagaattgcttcttttggcaatacttgtaatttctgctttgtagggttggttctctctaatttttgcttatttttaaatgctctttttgtgtcttttgctctgagaacaatgctaccggtagtttccagtgtgtttgctttgcctttttatttgaattttagaatttattattttaaaattttatcttatttaaatgttattcatttttcttctactaattttgagtatcacagcttcgtactccttgacttgcattctctcaggagctggggagccaagctcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaaa

SEQ ID NO: 93979 - DNA, 356 bp, Homo sapiens
  misc_feature 1..356: note = chr5:42995072-42995428
  misc_feature 1..356: note = hyper
  source 1..356: mol_type = genomic DNA
cgggatggaagcacccctcctaagaatccgcagtttctttctagcagcaccgttatggcgcctaaacggatatttgtttggcaataccagcgctatccgctaggtgccggcgcttgctgagtctcagcgccgccagattcttgctagcgaggtccagagcagtgcagagacctagcggacagttttccggtggcagcaatgctcatttcccggacacagatggtttttggcccctgaagaactctttaatccctgcgttttgtagcgctcgttctctgtaaggtttgcttagtatccgtttcatttcgacttcttttctcgctgtttttctgtcggaattacgatttgttttgttt

SEQ ID NO: 93980 - DNA, 331 bp, Homo sapiens
  misc_feature 1..331: note = chr5:430042-430373
  misc_feature 1..331: note = hypo
  source 1..331: mol_type = genomic DNA
ctgtttgccttgccccgggttacggtttccagatatgtcctgattccgatgctcctcctctgtgcatggacagccccggggatgttcacagcagatggagctgtgcagaccggagcagacgtccccgccctgttctgggcgctgcctttactgctgtacctgctgtggcaggcgcgttggggtgatcttaagttgcagtcacgtgtgttgccttgtggtccgactttgaattctagctgcattccttaacttccattagtattcaatttcattttttagatgcggtcttgactgaccttgtcagagtccaggctcccgaactagtttgaga

SEQ ID NO: 93981 - DNA, 679 bp, Homo sapiens; identical to SEQ ID NO: 7809
  misc_feature 1..679: note = chr5:43007818-43008497
  misc_feature 1..679: note = hyper
  source 1..679: mol_type = genomic DNA

SEQ ID NO: 93982 - DNA, 199 bp, Homo sapiens; identical to SEQ ID NO: 7810
  misc_feature 1..199: note = chr5:43008737-43008936
  misc_feature 1..199: note = hyper
  source 1..199: mol_type = genomic DNA

SEQ ID NO: 93983 - DNA, 30 bp, Homo sapiens
  misc_feature 1..30: note = chr5:43017284-43017314
  misc_feature 1..30: note = hyper
  source 1..30: mol_type = genomic DNA
aggaggtgtatgtctcgctgtcaattctac

SEQ ID NO: 93984 - DNA, 476 bp, Homo sapiens
  misc_feature 1..476: note = chr5:43017701-43018177
  misc_feature 1..476: note = hyper
  source 1..476: mol_type = genomic DNA
agctctctcccaggacgagccacatccgccccattcacggtccttattccagctcctttccctctgcgaatcacactgggtgggtcgctgggggcctcggtaattacggattatggcacagccaagaaaaatacaggttttcttaagcctgaagccactgacttgaggggggagagtaggagtaatgccagcagcagttttgtatttggtttttgtttttatattctagtctctaggccacaagacaatgttgcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccag

SEQ ID NO: 93985 - DNA, 378 bp, Homo sapiens
  misc_feature 1..378: note = chr5:43018326-43018704
  misc_feature 1..378: note = hyper
  source 1..378: mol_type = genomic DNA
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaat

SEQ ID NO: 93986 - DNA, 343 bp, Homo sapiens
  misc_feature 1..343: note = chr5:43019004-43019347
  misc_feature 1..343: note = hyper
  source 1..343: mol_type = genomic DNA
ccgcgaatgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 93987 - DNA, 237 bp, Homo sapiens; identical to SEQ ID NO: 29565
  misc_feature 1..237: note = chr5:43019650-43019887
  misc_feature 1..237: note = hyper
  source 1..237: mol_type = genomic DNA

SEQ ID NO: 93988 - DNA, 30 bp, Homo sapiens
  misc_feature 1..30: note = chr5:43023202-43023232
  misc_feature 1..30: note = hypo
  source 1..30: mol_type = genomic DNA
aggcttgagccactgcgccaggcctctctc

SEQ ID NO: 93989 - DNA, 198 bp, Homo sapiens
  misc_feature 1..198: note = chr5:43040830-43041028
  misc_feature 1..198: note = hyper
  source 1..198: mol_type = genomic DNA
ttgtgacagaaaaagcgccggctaatggtaccacacaattactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgttgggtgcagcaa

SEQ ID NO: 93990 - DNA, 32 bp, Homo sapiens; identical to SEQ ID NO: 29567
  misc_feature 1..32: note = chr5:43043256-43043288
  misc_feature 1..32: note = hyper
  source 1..32: mol_type = genomic DNA

SEQ ID NO: 93991 - DNA, 25 bp, Homo sapiens
  misc_feature 1..25: note = chr5:43105351-43105376
  misc_feature 1..25: note = hypo
  source 1..25: mol_type = genomic DNA
agcaagactccgtcccccccaaaaa

SEQ ID NO: 93992 - DNA, 132 bp, Homo sapiens
  misc_feature 1..132: note = chr5:43173337-43173469
  misc_feature 1..132: note = hypo
  source 1..132: mol_type = genomic DNA
aaaagaaaaagtaaacgtttaaaattatttgctcttaggatttttcttaatttgccaacgtatcttttttcccctctaataggtgaaaaaccttttgaatgtccaaattgtcatgaacgatttgctagaaat

SEQ ID NO: 93993 - DNA, 1354 bp, Homo sapiens
  misc_feature 1..1354: note = chr5:43191786-43193140
  misc_feature 1..1354: note = hyper
  source 1..1354: mol_type = genomic DNA
tggcaccaggggaaccgatgtatgccaggaatccagacagagggtgacattagcacttctttctgcagaacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtgtccctgcgccgcgcgtcccctccctctcgcccctccctcctggctgccatagaaaccagcttacaaggtccaggccggcgtccgggtgcactacaggccccccgtccctccttccccacgccagcccctcgctccggattggtccttcaggaaacgctgtggggcgtctcggtccccgctgcggagccggcctaggccggagggcggggtttgccctgggccgctgccggtcaggtcggccgcccctgacagctccgggagcctcaagcgcgacagcggcgccctcacctcgggacatccacacaccgaccgctcctgctccagaggcaacaacccagcgcgcctagcctggcgccgtgcagcgaagcccaagagctggcctcgccacgaaggtaagcgaggggctgggggactcgccgccagcacccccaccccgccacccttcctctgctaggctgcagacctgggtggctgaggaggaggcgcctctcctccccgcgacccaaggaagaaaggaagccctgccacggggtgtctgcgaagtggggtcagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 93994 - DNA, 24 bp, Homo sapiens
  misc_feature 1..24: note = chr5:43215538-43215562
  misc_feature 1..24: note = hypo
  source 1..24: mol_type = genomic DNA
ctttttttcttttttcgagatgga

SEQ ID NO: 93995 - DNA, 30 bp, Homo sapiens
  misc_feature 1..30: note = chr5:43233280-43233310
  misc_feature 1..30: note = hypo
  source 1..30: mol_type = genomic DNA
ctgcttcacggctgccgaggcgatggtgga

SEQ ID NO: 93996 - DNA, 302 bp, Homo sapiens
  misc_feature 1..302: note = chr5:43396928-43397230
  misc_feature 1..302: note = hyper
  source 1..302: mol_type = genomic DNA
actggtatctgtagtcgtggctgccgtggaccaggagagactgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactac

SEQ ID NO: 93997 - DNA, 176 bp, Homo sapiens
  misc_feature 1..176: note = chr5:43397305-43397481
  misc_feature 1..176: note = hyper
  source 1..176: mol_type = genomic DNA
gcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgatgcgggtatgttaaaat

SEQ ID NO: 93998 - DNA, 42 bp, Homo sapiens
  misc_feature 1..42: note = chr5:43402630-43402672
  misc_feature 1..42: note = hypo
  source 1..42: mol_type = genomic DNA
aaaattggtgtgtgccggttccaagatggccgaataggaaca

SEQ ID NO: 93999 - DNA, 96 bp, Homo sapiens
  misc_feature 1..96: note = chr5:435478-435574
  misc_feature 1..96: note = hypo
  source 1..96: mol_type = genomic DNA
gtagaggccagcacacggcaaattagaaatacaacacgcggagaaaggggtccgtgagcccactcatagaggaatctagaacgttccaggcagcag

SEQ ID NO: 94000 - DNA, 197 bp, Homo sapiens
  misc_feature 1..197: note = chr5:43740546-43740743
  misc_feature 1..197: note = hypo
  source 1..197: mol_type = genomic DNA
agtttcaacaattgtcgacaattatcaattttaagtaacgtcttcctcaatcccttgacttggttctctttcccccaacaattttatctatgaattagtcatttatagataaaacaatattattttatctgtaaatacttcagtaggtattgctaacagataagggctgaaaaacataaccacgatactattgttat

SEQ ID NO: 94001 - DNA, 837 bp, Homo sapiens
  misc_feature 1..837: note = chr5:44388215-44389052
  misc_feature 1..837: note = hyper
  source 1..837: mol_type = genomic DNA
aaggggtgggtagagcggcaaggggtgggggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagaggagaaggaggaggaagaagagttggtggcctctggtgacaccatgtcctgaccaagggcttggcaggtgacagggacggaagacaccaagaacagcaacaaaaagcagcagcagcagcagccgggcaggtggggaaaggctgaggcacaatgtgtcagtatccatttccacattgtactgaaactctcggcactggaaattgtctcatcagaaggaacatactggaagggtaagacccgatgcaaggcaaggagagagctcgaggtggtggctgctggttagctccctctgggcgcggatctggccagaagtgaatgcaccaacatccataactcctcggaaaagccggctgactcccctcgctcctttctcggatccgctgcctacgcctctggagcctcccggtaaatggtggacgtgggtggccgcagcagcaggagc

SEQ ID NO: 94002 - DNA, 174 bp, Homo sapiens; identical to SEQ ID NO: 29574
  misc_feature 1..174: note = chr5:44389326-44389500
  misc_feature 1..174: note = hyper
  source 1..174: mol_type = genomic DNA

SEQ ID NO: 94003 - DNA, 601 bp, Homo sapiens
  misc_feature 1..601: note = chr5:44389793-44390394
  misc_feature 1..601: note = hyper
  source 1..601: mol_type = genomic DNA
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgctaacatgagcccttcactgaatcatgcgtgcacttcaaagc

SEQ ID NO: 94004 - DNA, 162 bp, Homo sapiens
  misc_feature 1..162: note = chr5:44492868-44493030
  misc_feature 1..162: note = hypo
  source 1..162: mol_type = genomic DNA
tgacacacccctgttcgctgaagctgtaggcagtgggaatgaacgagagctgtaatacttcctgggttctcagatcttgggactccccaagcagaagctgtaacacctcttggggtctgcggttgctggtgtctccaagttttcaggcgccaccacatcccc

SEQ ID NO: 94005 - DNA, 43 bp, Homo sapiens; identical to SEQ ID NO: 40542
  misc_feature 1..43: note = chr5:44637083-44637126
  misc_feature 1..43: note = hypo
  source 1..43: mol_type = genomic DNA

SEQ ID NO: 94006 - DNA, 21 bp, Homo sapiens
  misc_feature 1..21: note = chr5:44939696-44939717
  misc_feature 1..21: note = hypo
  source 1..21: mol_type = genomic DNA
gaaggtggtgctgggcgcggt

SEQ ID NO: 94007 - DNA, 24 bp, Homo sapiens
  misc_feature 1..24: note = chr5:45225641-45225665
  misc_feature 1..24: note = hypo
  source 1..24: mol_type = genomic DNA
aggggcccttcatcccgccactgg

SEQ ID NO: 94008 - DNA, 97 bp, Homo sapiens; identical to SEQ ID NO: 29576
  misc_feature 1..97: note = chr5:45695143-45695240
  misc_feature 1..97: note = hyper
  source 1..97: mol_type = genomic DNA

SEQ ID NO: 94009 - DNA, 295 bp, Homo sapiens; identical to SEQ ID NO: 7824
  misc_feature 1..295: note = chr5:45695313-45695608
  misc_feature 1..295: note = hyper
  source 1..295: mol_type = genomic DNA

SEQ ID NO: 94010 - DNA, 38 bp, Homo sapiens
  misc_feature 1..38: note = chr5:45695648-45695686
  misc_feature 1..38: note = hyper
  source 1..38: mol_type = genomic DNA
cgccggcagcgccaccccccgcccgccctcctagtccc

SEQ ID NO: 94011 - DNA, 58 bp, Homo sapiens
  misc_feature 1..58: note = chr5:45695906-45695964
  misc_feature 1..58: note = hyper
  source 1..58: mol_type = genomic DNA
gcctctgcatgaagccgtactgccgccggggcccctcggcgtcttcgaagccccccgc

SEQ ID NO: 94012 - DNA, 156 bp, Homo sapiens
  misc_feature 1..156: note = chr5:45696299-45696455
  misc_feature 1..156: note = hyper
  source 1..156: mol_type = genomic DNA
agcccagctgcccgtcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgcc

SEQ ID NO: 94013 - skipped

SEQ ID NO: 94014 - DNA, 92 bp, Homo sapiens
  misc_feature 1..92: note = chr5:45696466-45696558
  misc_feature 1..92: note = hyper
  source 1..92: mol_type = genomic DNA
aggctcagctcggctcagccctcgcgccccagcgcctcccctcggctgccctctgttggccagaaagggtctctccccgtccgctctccaca

SEQ ID NO: 94015 - DNA, 215 bp, Homo sapiens
  misc_feature 1..215: note = chr5:4581114-4581329
  misc_feature 1..215: note = hypo
  source 1..215: mol_type = genomic DNA
caggcacatgctcagcgacactcttgcacacagaaacacacgtggacagacacacgcacagcgacactcttggagagcacatacacatggacaggcacacgcacagtgacactcttgcacacacacacacgtggacagacacacgcacagcgacatcttgcacacgcggacacacacgtggacaggcacacacacagcgacgctcttggagagca

SEQ ID NO: 94016 - DNA, 35 bp, Homo sapiens; identical to SEQ ID NO: 40483
  misc_feature 1..35: note = chr5:4629575-4629610
  misc_feature 1..35: note = hypo
  source 1..35: mol_type = genomic DNA

SEQ ID NO: 94017 - DNA, 226 bp, Homo sapiens
  misc_feature 1..226: note = chr5:4629982-4630208
  misc_feature 1..226: note = hypo
  source 1..226: mol_type = genomic DNA
ttatttgcaatagagcgtttttgaaaattaaaacaacattataagcggtgagaaatgtcagaaaagcctgtttccaatggcatgctagagccagcttgtaccagtgaggtggttgttaaacacagccatcgctgatattttaattatgtgcatttaaaattaaatatattctattatagaaaaaacggataaatctgagtgtatatcactgcggaattacttgagt

SEQ ID NO: 94018 - DNA, 30 bp, Homo sapiens; identical to SEQ ID NO: 40484
  misc_feature 1..30: note = chr5:4630470-4630500
  misc_feature 1..30: note = hypo
  source 1..30: mol_type = genomic DNA

SEQ ID NO: 94019 - DNA, 30 bp, Homo sapiens
  misc_feature 1..30: note = chr5:465822-465852
  misc_feature 1..30: note = hypo
  source 1..30: mol_type = genomic DNA
tgccttccagggtttcggggaagacgtgga

SEQ ID NO: 94020 - DNA, 30 bp, Homo sapiens
  misc_feature 1..30: note = chr5:475028-475058
  misc_feature 1..30: note = hyper
  source 1..30: mol_type = genomic DNA
gccgctcctcggggccgtctgcctgcagga

SEQ ID NO: 94021 - DNA, 54 bp, Homo sapiens
  misc_feature 1..54: note = chr5:478158-478212
  misc_feature 1..54: note = hypo
  source 1..54: mol_type = genomic DNA
cgggtgtggagggaacgtcagctcactgcactcagacctcgccaggtgggcacc

SEQ ID NO: 94022 - DNA, 298 bp, Homo sapiens
  misc_feature 1..298: note = chr5:479376-479674
  misc_feature 1..298: note = hypo
  source 1..298: mol_type = genomic DNA
catagtgggcaggtgcgggagccagggcggcagtggcctcggggctgggtggggcgcctggcctctggtctctggagcagtcaggggctctgcagacgctgagaggcctgctcatagtggactgggagatgctggagcagcctcagagccatggccggcccacagcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatcc

SEQ ID NO: 94023 - DNA, 39 bp, Homo sapiens
  misc_feature 1..39: note = chr5:480581-480620
  misc_feature 1..39: note = hypo
  source 1..39: mol_type = genomic DNA
ggacatgggtgcagccgccagagccgccctccagggcac

SEQ ID NO: 94024 - DNA, 164 bp, Homo sapiens; identical to SEQ ID NO: 14710
  misc_feature 1..164: note = chr5:480880-481044
  misc_feature 1..164: note = hypo
  source 1..164: mol_type = genomic DNA

SEQ ID NO: 94025 - DNA, 38 bp, Homo sapiens
  misc_feature 1..38: note = chr5:484540-484578
  misc_feature 1..38: note = hypo
  source 1..38: mol_type = genomic DNA
tccccctggctggctcgccctgccggacccaggagggt

SEQ ID NO: 94026 - DNA, 36 bp, Homo sapiens
  misc_feature 1..36: note = chr5:4866865-4866901
  misc_feature 1..36: note = hypo
  source 1..36: mol_type = genomic DNA
tctacttcattgtgacgaggtcgaggctgtaagggg

SEQ ID NO: 94027 - DNA, 30 bp, Homo sapiens; identical to SEQ ID NO: 40486
  misc_feature 1..30: note = chr5:4867541-4867571
  misc_feature 1..30: note = hypo
  source 1..30: mol_type = genomic DNA

SEQ ID NO: 94028 - DNA, 46 bp, Homo sapiens
  misc_feature 1..46: note = chr5:487718-487764
  misc_feature 1..46: note = hypo
  source 1..46: mol_type = genomic DNA
ggtactttgtcatggcggccctggcagattacgtggttcctatggg

SEQ ID NO: 94029 - DNA, 30 bp, Homo sapiens
  misc_feature 1..30: note = chr5:4879422-4879452
  misc_feature 1..30: note = hypo
  source 1..30: mol_type = genomic DNA
tgagggtgacagggccggctgggagggtga

SEQ ID NO: 94030 - DNA, 58 bp, Homo sapiens
  misc_feature 1..58: note = chr5:488495-488553
  misc_feature 1..58: note = hypo
  source 1..58: mol_type = genomic DNA
ggacctcctcaaacacggccaggacggccaccgggtccacagccgccatgaggctgcc

SEQ ID NO: 94031 - DNA, 146 bp, Homo sapiens; identical to SEQ ID NO: 40391
  misc_feature 1..146: note = chr5:488846-488992
  misc_feature 1..146: note = hypo
  source 1..146: mol_type = genomic DNA

SEQ ID NO: 94032 - DNA, 64 bp, Homo sapiens
  misc_feature 1..64: note = chr5:490702-490766
  misc_feature 1..64: note = hypo
  source 1..64: mol_type = genomic DNA
actccatcccacactcgacacagctgggaggaagctgggatctcatgggcgaggggccatctgg

SEQ ID NO: 94033 - DNA, 948 bp, Homo sapiens
  misc_feature 1..948: note = chr5:491223-492171
  misc_feature 1..948: note = hypo
  source 1..948: mol_type = genomic DNA
ggtgccggaggcctgcgctcagccgtggggcccagctggtcaaagctaggctctgcctgaggtccctggacccacctggtcaaagctgtagcatccccggcagcagcggcgggcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgctctcgggaaccacgctggtgaccttgt

SEQ ID NO: 94034 - DNA, 386 bp, Homo sapiens; identical to SEQ ID NO: 7826
  misc_feature 1..386: note = chr5:49736592-49736978
  misc_feature 1..386: note = hyper
  source 1..386: mol_type = genomic DNA

SEQ ID NO: 94035 - DNA, 201 bp, Homo sapiens; identical to SEQ ID NO: 29584
  misc_feature 1..201: note = chr5:49737098-49737299
  misc_feature 1..201: note = hyper
  source 1..201: mol_type = genomic DNA

SEQ ID NO: 94036 - DNA, 30 bp, Homo sapiens
  misc_feature 1..30: note = chr5:500270-500300
  misc_feature 1..30: note = hypo
  source 1..30: mol_type = genomic DNA
gaagagaatagaactcgccccatggcacac

SEQ ID NO: 94037 - DNA, 30 bp, Homo sapiens
  misc_feature 1..30: note = chr5:500505-500535
  misc_feature 1..30: note = hypo
  source 1..30: mol_type = genomic DNA
gggggtggcaggagacggggacgggaccct

SEQ ID NO: 94038 - DNA, 30 bp, Homo sapiens
  misc_feature 1..30: note = chr5:50217968-50217998
  misc_feature 1..30: note = hypo
  source 1..30: mol_type = genomic DNA
catcccctctcagctcgtgcacaccagagg

SEQ ID NO: 94039 - DNA, 311 bp, Homo sapiens
  misc_feature 1..311: note = chr5:50262925-50263236
  misc_feature 1..311: note = hyper
  source 1..311: mol_type = genomic DNA
cttggggactgagggcgtggtgggcagacagctgttgaatccaaacaaagactattctggatctgacgccgtttcggtttccatctgggagtacttttcatttccttcttcccattccaaaggaaagaaatggattaggaatggggcagtcagaattatgtgtttatggcggacagatggaacaggagaggatgaaccttcagcaacaaaaggatcattgagatttggttcctgggtgtgcaaatttggaaacaaaataaccaaggaagctatgggaataccaagactctagctatcgacaatgttgactc

SEQ ID NO: 94040 - DNA, 231 bp, Homo sapiens
  misc_feature 1..231: note = chr5:50263484-50263715
  misc_feature 1..231: note = hyper
  source 1..231: mol_type = genomic DNA
cctcgccccaattaacgccctacagccagtcagccttacacctgctggaaaaatcttggtggcagtggtgggaggtggtggttttggtttttagcagagcgcgggagcaccctgtcacaccctcctgagaccgccctaggaccgtcctctggaatatcttggagccaggagccagggaggctttcctcagtcccagtcgttgcctgtcgccgctttcggtttctcttccct

SEQ ID NO: 94041 - DNA, 986 bp, Homo sapiens
  misc_feature 1..986: note = chr5:50264180-50265166
  misc_feature 1..986: note = hyper
  source 1..986: mol_type = genomic DNA
ttgcttatctgtattcgaggggttagtctccatcctaggattgtccctttcaaaaaaaattttttggatgcatctgttttcactttgcactttcaacgggctggagcagacaatagtgtgaaaaacatctgaaaatatgaggcgacagagctgcatgtgtgtttcatttctgcggtgttaggggagaaaataacaaaagaaacacacactacaacacacacgcacgcacgcacacacacacaccggcccaggacctcagcacaaagggcgcgctgacccagcgctaacacacaagacaaattaaagaaaggggcaaatcggaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtgaacttgggaaagataagttgcccggcgaggttggaggtagactgaggaacgcctttttttgtgaaggacacaaatatttgcagagtttaaagctgcaggaatacaaaagcaggagtgagattatctgattacggatacaggatgtccgagttgttgcctcccaaaaacgactgcgtaaaaaaaaataaataaaaggccagttcgaaaagtgaaattttaatatcagtgaaagcatcggagggactcggattgaacgcggcagctccggaactggacaacagctgcgtggtgcagccaatcccggggcctgtgggaa

SEQ ID NO: 94042 - DNA, 482 bp, Homo sapiens; identical to SEQ ID NO: 29589
  misc_feature 1..482: note = chr5:50265190-50265672
  misc_feature 1..482: note = hyper
  source 1..482: mol_type = genomic DNA

SEQ ID NO: 94043 - DNA, 160 bp, Homo sapiens; identical to SEQ ID NO: 7831
  misc_feature 1..160: note = chr5:50265720-50265880
  misc_feature 1..160: note = hyper
  source 1..160: mol_type = genomic DNA

SEQ ID NO: 94044 - DNA, 30 bp, Homo sapiens
  misc_feature 1..30: note = chr5:5049628-5049658
  misc_feature 1..30: note = hypo
  source 1..30: mol_type = genomic DNA
tctgttttttgttgtcgttgttgctgttgt

SEQ ID NO: 94045 - DNA, 36 bp, Homo sapiens
  misc_feature 1..36: note = chr5:50674152-50674188
  misc_feature 1..36: note = hyper
  source 1..36: mol_type = genomic DNA
ctttaaaagttgccccgtccacgcaccattcagctt

SEQ ID NO: 94046 - DNA, 30 bp, Homo sapiens
  misc_feature 1..30: note = chr5:50674452-50674482
  misc_feature 1..30: note = hyper
  source 1..30: mol_type = genomic DNA
tcgcctcccctcccccgctcgtccccagta

SEQ ID NO: 94047 - DNA, 353 bp, Homo sapiens
  misc_feature 1..353: note = chr5:50674730-50675083
  misc_feature 1..353: note = hyper
  source 1..353: mol_type = genomic DNA
gactgcaaccacttccgcgagaatctgatacatttaatgaaagctttgccaaatgtacgggtcagcgcgtccttgggccaccaccacttgggtcagcacactgcactcactagcgccaacctgggctccacgcagcagaactcggttaaaaatcgtctgttcctggtcacttaggagttctagggggcagggggaagcaagaaaaaggtttcacttgacactgccagccgcttttgataagtcatagtaaatactttcagaagcacaattttaaagggagaatacaaatttccgtcctcgcttggccgaacgcctccctgcaatcaactgcggaccttcgcatgctcaggact

SEQ ID NO: 94048 - DNA, 146 bp, Homo sapiens
  misc_feature 1..146: note = chr5:506753-506899
  misc_feature 1..146: note = hypo
  source 1..146: mol_type = genomic DNA
ttcctatgataatctcgacttttctgggcagttgtaaagactgaaaatcagactccttcagagagagtgggttgactttgttctcaaacccaaggaaaacgaaggataaaacgtgttatttattatccttgttttaaagttattgg

SEQ ID NO: 94049 - DNA, 70 bp, Homo sapiens
  misc_feature 1..70: note = chr5:50677690-50677760
  misc_feature 1..70: note = hyper
  source 1..70: mol_type = genomic DNA
tcaggaggaaacttacgcatctttgattccctttccgctttggagaggcattacccgttcaagcccagcc

SEQ ID NO: 94050 - DNA, 77 bp, Homo sapiens
  misc_feature 1..77: note = chr5:50678114-50678191
  misc_feature 1..77: note = hyper
  source 1..77: mol_type = genomic DNA
attaacgcctggggacgtgaaataggtctttcactgttctgtaataaatccctccctactcgcgcccttagactaat

SEQ ID NO: 94051 - DNA, 30 bp, Homo sapiens
  misc_feature 1..30: note = chr5:50678447-50678477
  misc_feature 1..30: note = hyper
  source 1..30: mol_type = genomic DNA
ccgcggagtcaacttcggtttaccggtgcg

SEQ ID NO: 94052 - DNA, 30 bp, Homo sapiens
  misc_feature 1..30: note = chr5:50679546-50679576
  misc_feature 1..30: note = hyper
  source 1..30: mol_type = genomic DNA
ttaccttgtggggctcggtgtgctgttctt

SEQ ID NO: 94053 - DNA, 518 bp, Homo sapiens
  misc_feature 1..518: note = chr5:50683061-50683579
  misc_feature 1..518: note = hyper
  source 1..518: mol_type = genomic DNA
tcatcggaaaggaaacgggagtaaaagaaagggaggagggagggaggggaaaagagagatgggggaaggaagagagacagggaaggagagagcagggtttcatttctgtccttctgtttccaacttctgtttggaaatgctgtttacttggggcgtcttgcccgggatcttgggccagggaagtgccggcctgaagtgaccccctcttcctgtacttctctccccgctctgggccgcctccgctcccccctcccccgcacaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatg

SEQ ID NO: 94054 - DNA, 143 bp, Homo sapiens; identical to SEQ ID NO: 29594
  misc_feature 1..143: note = chr5:50685653-50685796
  misc_feature 1..143: note = hyper
  source 1..143: mol_type = genomic DNA

SEQ ID NO: 94055 - DNA, 237 bp, Homo sapiens
  misc_feature 1..237: note = chr5:50685846-50686083
  misc_feature 1..237: note = hyper
  source 1..237: mol_type = genomic DNA
cgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtcctcccctc

SEQ ID NO: 94056 - DNA, 524 bp, Homo sapiens
  misc_feature 1..524: note = chr5:50694717-50695241
  misc_feature 1..524: note = hyper
  source 1..524: mol_type = genomic DNA
ttctacccccaggtgcgttgcccacgtccagcgggcagggcagcgcagcgcctgtctgcactcaggttaggggtgggaagtgctgggaatgggggacccggacactggtctaaccagccccgccactcccgcgggcaagtcagcccttgatcctttaaagcagggacaatcgacgtggtccgagagaggaaaataagggtatttctgggcccttctctttcaggagttgatcaggttggcagatctggagggctaatccaaacaaggcgcttgacttgtgaggtcgcgagtctagacagagctggtggctcggcggctccttatctttccctggaatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagac

SEQ ID NO: 94057 - DNA, 113 bp, Homo sapiens; identical to SEQ ID NO: 29598
  misc_feature 1..113: note = chr5:50695350-50695463
  misc_feature 1..113: note = hyper
  source 1..113: mol_type = genomic DNA

SEQ ID NO: 94058 - DNA, 11 bp, Homo sapiens
  misc_feature 1..11: note = chr5:5139610-5139621
  misc_feature 1..11: note = hyper
  source 1..11: mol_type = genomic DNA
gacccccgtgg

SEQ ID NO: 94059 - DNA, 247 bp, Homo sapiens; identical to SEQ ID NO: 7729
  misc_feature 1..247: note = chr5:5139753-5140000
  misc_feature 1..247: note = hyper
  source 1..247: mol_type = genomic DNA

SEQ ID NO: 94060 - DNA, 425 bp, Homo sapiens; identical to SEQ ID NO: 29447
  misc_feature 1..425: note = chr5:5140031-5140456
  misc_feature 1..425: note = hyper
  source 1..425: mol_type = genomic DNA

SEQ ID NO: 94061 - DNA, 231 bp, Homo sapiens; identical to SEQ ID NO: 7732
  misc_feature 1..231: note = chr5:5140527-5140758
  misc_feature 1..231: note = hyper
  source 1..231: mol_type = genomic DNA

SEQ ID NO: 94062 - DNA, 135 bp, Homo sapiens
  misc_feature 1..135: note = chr5:5140849-5140984
  misc_feature 1..135: note = hyper
  source 1..135: mol_type = genomic DNA
cggagcggccgggctggatggaaaagggcggtaagtccgtgaggtgggggcttctaatccttgccatttagcagctcgtaatctccgtgccgctggtttattaggtgctgtgaatgttcacgactctgtggaacc

SEQ ID NO: 94063 - DNA, 197 bp, Homo sapiens; identical to SEQ ID NO: 40393
  misc_feature 1..197: note = chr5:516758-516955
  misc_feature 1..197: note = hypo
  source 1..197: mol_type = genomic DNA

SEQ ID NO: 94064 - DNA, 30 bp, Homo sapiens
  misc_feature 1..30: note = chr5:51759873-51759903
  misc_feature 1..30: note = hypo
  source 1..30: mol_type = genomic DNA
gacatgtgccgtccacgaaaaggttttttt

SEQ ID NO: 94065 - DNA, 30 bp, Homo sapiens; identical to SEQ ID NO: 40394
  misc_feature 1..30: note = chr5:519988-520018
  misc_feature 1..30: note = hypo
  source 1..30: mol_type = genomic DNA

SEQ ID NO: 94066 - DNA, 292 bp, Homo sapiens
  misc_feature 1..292: note = chr5:52285516-52285808
  misc_feature 1..292: note = hyper
  source 1..292: mol_type = genomic DNA
aaagagatacttcttcgttcccttcctgctatcccaggccttgcgtccccattaggcgcgtctcgccctgtctgttaagcaccctccaaagtcatctcagtgagtgctttgttttaggtacacacacgcacacacacacacacacacacagacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctg

SEQ ID NO: 94067 - DNA, 25 bp, Homo sapiens
  misc_feature 1..25: note = chr5:523778-523803
  misc_feature 1..25: note = hyper
  source 1..25: mol_type = genomic DNA
ctgctgggtttcatgcgggtagcac

SEQ ID NO: 94068 - DNA, 1024 bp, Homo sapiens
  misc_feature 1..1024: note = chr5:523856-524880
  misc_feature 1..1024: note = hyper
  source 1..1024: mol_type = genomic DNA
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctgggatgcccgggcagctgtgggt

SEQ ID NO: 94069 - DNA, 30 bp, Homo sapiens
  misc_feature 1..30: note = chr5:52775107-52775137
  misc_feature 1..30: note = hyper
  source 1..30: mol_type = genomic DNA
aatcccagtgacctgcgaatgtccaagaat

SEQ ID NO: 94070 - DNA, 531 bp, Homo sapiens
  misc_feature 1..531: note = chr5:52775392-52775923
  misc_feature 1..531: note = hyper
  source 1..531: mol_type = genomic DNA
caatcttttttattccgcgaaaagagagaagacgagacagaaagagagagagattggagccgaggagactgagagacagacagaggcacacaggacagaaactggggagtctccaggcgggagaggaagggggggccagaccgcctacgtcggcgcccccgctccgggctccgactccagacgccgcgaagtgaaaggggagaaaagaaagggagagggcgaggctgtgccgcggggagaccgggcctgaggtgttaaacatttttgtttgcttccgactagtccagacgaagggccgcgtctcggtagcgctctgccagggtggaaggtgccggggccggggttcctagcaacacctctgggctgggggtggctgcaaagtcaggcactcacagacccagacacaaaacctcgcgggtcccgcgcccaggctgcgggtgcccggaaccgccgcgaggccggcgcgctccgacccgacccggggcgggatatttgggcagcccggggctcttcggccgtttgcaaaagtct

SEQ ID NO: 94071 - DNA, 390 bp, Homo sapiens
  misc_feature 1..390: note = chr5:52776428-52776818
  misc_feature 1..390: note = hyper
  source 1..390: mol_type = genomic DNA
tttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccagggtaagcgagtggggatgcgctggggaggcttggctgaggacaggggggtcgacttttctgtggtctccacttggtctgttctgagcaacgctgctctcggaagatgttgaac

SEQ ID NO: 94072 - DNA, 139 bp, Homo sapiens
  misc_feature 1..139: note = chr5:52778602-52778741
  misc_feature 1..139: note = hyper
  source 1..139: mol_type = genomic DNA
ccccctccccatccccgccgggtctccttcgctagccacctcgctctccctgccctgccaccgctcactgctcactcacccacctccccacccttgtctcttcacagctgggaactgctggctccgtcaagcgaagaac

SEQ ID NO: 94073 - DNA, 41 bp, Homo sapiens
  misc_feature 1..41: note = chr5:52888050-52888091
  misc_feature 1..41: note = hypo
  source 1..41: mol_type = genomic DNA
ggattacaggtgtgagccgctgcgcccggcattgttgagtt

SEQ ID NO: 94074 - DNA, 178 bp, Homo sapiens; identical to SEQ ID NO: 40487
  misc_feature 1..178: note = chr5:5296474-5296652
  misc_feature 1..178: note = hypo
  source 1..178: mol_type = genomic DNA

SEQ ID NO: 94075 - DNA, 30 bp, Homo sapiens; identical to SEQ ID NO: 40488
  misc_feature 1..30: note = chr5:5303702-5303732
  misc_feature 1..30: note = hypo
  source 1..30: mol_type = genomic DNA

SEQ ID NO: 94076 - DNA, 40 bp, Homo sapiens
  misc_feature 1..40: note = chr5:53147-53187
  misc_feature 1..40: note = hyper
  source 1..40: mol_type = genomic DNA
aggtcagaacttgttcgggaccgccgggtggagacaagga

SEQ ID NO: 94077 - DNA, 30 bp, Homo sapiens
  misc_feature 1..30: note = chr5:5320109-5320139
  misc_feature 1..30: note = hypo
  source 1..30: mol_type = genomic DNA
ttctattatagcagacgtcagccacacagc

SEQ ID NO: 94078 - DNA, 23 bp, Homo sapiens
  misc_feature 1..23: note = chr5:53300030-53300053
  misc_feature 1..23: note = hypo
  source 1..23: mol_type = genomic DNA
ttaaatattctcggccgggtgtg

SEQ ID NO: 94079 - DNA, 399 bp, Homo sapiens
  misc_feature 1..399: note = chr5:53500-53899
  misc_feature 1..399: note = hyper
  source 1..399: mol_type = genomic DNA
cgagtccccttctcaggcaggctgtgggggttggggttgggcttcgcgagcccaagcggacgccgcaaagagaatgagaacctcggagcgctcggggcgggcgggcccagcccaggctcttcctacccctgcgggggtccgagggccagcggcatcggcggcgggaggagggggcgggggcggggaattagggggaggcgggtgttaaagaggagaagggcgggggcggagggggaggaggagacggggcggggaggacccccaggtttccgagtctccgcccgggctttcgttcccggctgtgtggccccgcgcggttcccgagcagctccaggaactgaaacgtgaaggggacctcggtgcccggagctgctgcccaggtaaccgcgctgcgcccgg

SEQ ID NO: 94080 - DNA, 30 bp, Homo sapiens
  misc_feature 1..30: note = chr5:53674661-53674691
  misc_feature 1..30: note = hypo
  source 1..30: mol_type = genomic DNA
acctgggtgctgctgcggggtccccatgga

SEQ ID NO: 94081 - DNA, 88 bp, Homo sapiens
  misc_feature 1..88: note = chr5:537288-537376
  misc_feature 1..88: note = hypo
  source 1..88: mol_type = genomic DNA
gcttttctccctgagcgttgtgtgttagcgattctgtgagtctgacgctgcacaggtgggcgatgctttgctccggccggctcacctc

SEQ ID NO: 94082 - DNA, 193 bp, Homo sapiens
  misc_feature 1..193: note = chr5:537854-538047
  misc_feature 1..193: note = hypo
  source 1..193: mol_type = genomic DNA
tggcctcgctgtggacgttctcaccgagtggcagccgtgtctgcattggcccgagggcctgggggaatcccgttcccacactggttggctgtgctgcctctagggagtcacttggcctctctgtgcccagcgttctcatctgtcaggtgggggtcacaccatgccagcccactgctgccggggaggtccctgg

SEQ ID NO: 94083 - DNA, 370 bp, Homo sapiens
  misc_feature 1..370: note = chr5:538581-538951
  misc_feature 1..370: note = hypo
  source 1..370: mol_type = genomic DNA
cgggatgggggaccccggaaccccactggccttgggcagccatcttgggggtttcaggagatgcacagaggacagcggctggggatgctcagctctgtcccatcacctgtgcctgcctgacgatgccgcctcagccgcccagggctccctcagggaaaacgtcgccaagcaccgacggctcaagggagtaaccgcgcctctgggagatggcgtccctgacttggctgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 94084 - DNA, 95 bp, Homo sapiens
  misc_feature 1..95: note = chr5:54002-54097
  misc_feature 1..95: note = hyper
  source 1..95: mol_type = genomic DNA
cgccggaaccggggaggaggctggggaagagaaaggggcagaggggcgggcccgggggccggggccgagggggcggagcgcgaagtttccagagg

SEQ ID NO: 94085 - DNA, 30 bp, Homo sapiens
  misc_feature 1..30: note = chr5:54042403-54042433
  misc_feature 1..30: note = hypo
  source 1..30: mol_type = genomic DNA
cttctgttttctaaccgagaagaatgactt

SEQ ID NO: 94086 - skipped

SEQ ID NO: 94087 - DNA, 536 bp, Homo sapiens
  misc_feature 1..536: note = chr5:54179609-54180145
  misc_feature 1..536: note = hyper
  source 1..536: mol_type = genomic DNA
cgcaccgaccgggagatggaagtttttcgcggcggcgccccagccacttcgcagggccgagcggtctcctccaccggccgcccggctcaggaatgccctgcctgcgagtcaaagtcggggtcgcggcggggcgaacctggcccagcattgcctggggccctcaggagcgccgagggggtctccctgccagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccatttgcatcctgaagctgttgcgccccttcagcgcaaggagcgggctgggccttta

SEQ ID NO: 94088 - DNA, 166 bp, Homo sapiens
  misc_feature 1..166: note = chr5:54332-54498
  misc_feature 1..166: note = hyper
  source 1..166: mol_type = genomic DNA
cgaacaaccaaaaaccgccccagccccccaaaccccaattgccttattctgtttccacttgctttagcccccacgctcctgtgtgcgagaggggcctggtcagactgcagaccccacccaggaggaggaagaggaaggggccgccgtggcccgggcacccccaggg

SEQ ID NO: 94089 - DNA, 336 bp, Homo sapiens
  misc_feature 1..336: note = chr5:54472206-54472542
  misc_feature 1..336: note = hyper
  source 1..336: mol_type = genomic DNA
tattcaactaatttccgagcagtgcaaaccggagagctccccattcccagcgccaacggcaggtttgcgcgcccctccggcccgcggttactccccgccctgctccaggctggtgcctcgccctcagcccgctcgcgcctggctacgcccgcgcccgcgcccgctcccgcccctagcttctgcgcgccgccctgcagcccctgcgcgcgcctactgggccaaagggacggttgggagtttgctccaactgtccctggggcacgccttccccgcccagcaggggttggggaacgcgagctgggagtgtgagggaaagcgccacgccagtgggggctg

SEQ ID NO: 94090 - DNA, 347 bp, Homo sapiens; identical to SEQ ID NO: 441
  misc_feature 1..347: note = chr5:54516334-54516681
  misc_feature 1..347: note = hyper
  source 1..347: mol_type = genomic DNA

SEQ ID NO: 94091 - DNA, 343 bp, Homo sapiens
  misc_feature 1..343: note = chr5:54516831-54517174
  misc_feature 1..343: note = hyper
  source 1..343: mol_type = genomic DNA
cgccccacttacatccagcaccgaggccaggtgccgggttcggctggcgagttccttcagctgcacgttccgctccttgagcgaggcgatctcctcctgtttctgggtcaatgtcacgtgcagctgcaggaggagacccaaacattcaggggtaggtactgtgctgggtctcgtctgcatatctggcatgaatcaaacccagatcctgacgtctcatcaggaactggggacgcacaggcatttacgctagtgagaataataatcaatttactttttttttaaaacaaagcacttggacaaaatttatctccattaatcctcggtgtagcgtgctgataaagag

SEQ ID NO: 94092 - DNA, 156 bp, Homo sapiens; identical to SEQ ID NO: 443
  misc_feature 1..156: note = chr5:54519133-54519289
  misc_feature 1..156: note = hyper
  source 1..156: mol_type = genomic DNA

SEQ ID NO: 94093 - DNA, 259 bp, Homo sapiens
  misc_feature 1..259: note = chr5:54519382-54519641
  misc_feature 1..259: note = hyper
  source 1..259: mol_type = genomic DNA
cgactcaccagcgaccggccaccgagccgccgctgtaggagctgagagcacgtcttgaacaccggatctttccacccaagacccgacagcgtgcaggggcctcgagcagtaatttgaggccgcgtttcccgccaaggtttggccccagctaaccgccccacccatgcaaccgagcgggaagaaagctgtgattcgaggggccaggagaatacgggaaaagcttctgttctgcgcacagccagtgcggcctccattgctc

SEQ ID NO: 94094 - DNA, 216 bp, Homo sapiens
  misc_feature 1..216: note = chr5:54523786-54524002
  misc_feature 1..216: note = hyper
  source 1..216: mol_type = genomic DNA
tccactttctgaaaacgccacagtggaaagtaccgaatccccgaaaaccctgttcctgtctttcctagtggcctcagcggcccatcgccacgtttggctggtctcttcgcagtcgtagttgccattcccaagccaacacctctccaaggaatgggcattttcctgagtccgaggcatctcctagggaggggcatccttaggcgagggacctttctc

SEQ ID NO: 94095 - DNA, 314 bp, Homo sapiens; identical to SEQ ID NO: 7839
  misc_feature 1..314: note = chr5:54527322-54527636
  misc_feature 1..314: note = hyper
  source 1..314: mol_type = genomic DNA

SEQ ID NO: 94096 - DNA, 41 bp, Homo sapiens
  misc_feature 1..41: note = chr5:54528342-54528383
  misc_feature 1..41: note = hyper
  source 1..41: mol_type = genomic DNA
ctgagcagcttacagcgggattccgccgtcacctgccggga

SEQ ID NO: 94097 - DNA, 46 bp, Homo sapiens
  misc_feature 1..46: note = chr5:55309312-55309358
  misc_feature 1..46: note = hypo
  source 1..46: mol_type = genomic DNA
tgtgacctgggaatgcggttgttgttagcagcggcaacaactggta

SEQ ID NO: 94098 - DNA, 272 bp, Homo sapiens
  misc_feature 1..272: note = chr5:554299-554571
  misc_feature 1..272: note = hypo
  source 1..272: mol_type = genomic DNA
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacagga

SEQ ID NO: 94099 - DNA, 120 bp, Homo sapiens
  misc_feature 1..120: note = chr5:554631-554751
  misc_feature 1..120: note = hypo
  source 1..120: mol_type = genomic DNA
gggggcgggtcacaggatgaaccgtgggcgggtcatgggataaaccagggtggggtctgggtcacaggatgacccgggggtgggtcacgggataaaccaggggtggggggtgggtcacgg

SEQ ID NO: 94100 - DNA, 120 bp, Homo sapiens
  misc_feature 1..120: note = chr5:554811-554931
  misc_feature 1..120: note = hypo
  source 1..120: mol_type = genomic DNA
gggtctgggtcacgggatgaacggggttgggggctgggtcacgggatgaaccggggggtgggtcacgggatgaacggggggggggtgggtcacgggctaaaccggggttgggggtgggtc

SEQ ID NO: 94101 - DNA, 151 bp, Homo sapiens
  misc_feature 1..151: note = chr5:555171-555322
  misc_feature 1..151: note = hypo
  source 1..151: mol_type = genomic DNA
cacgggatgaaccggggtgaggggtgggtcaccggatgaacgggggtgggtcatgggatgaaccaggggtttccgaggtcgcaggcggcttccttgccccgtgacctggctggggctgcttaacttatgagcagttcggcttcctcgcggg

SEQ ID NO: 94102 - DNA, 789 bp, Homo sapiens
  misc_feature 1..789: note = chr5:555668-556457
  misc_feature 1..789: note = hypo
  source 1..789: mol_type = genomic DNA
gtccctcgagccctccgcataaacctctgtgccctggaacccgacggggacacaagcgggaagttgacagccatgccctctggaacctttagaaaagaaaccggcccagtgcaaggtcgttcaatgcagagcctctcctgagcacaaacaaaatccagatgagtgtccgcacggggccgtgcggaggtcacgggagctgcagtgtgggccgtggatggctccctcccgtaccaaaggccggcgtgaagacaagaacacaggcaggcagacggcagtgaaaagcagccagaaatggaggagcttcagagaggccgaagtctgaaacagcccgaaatggagggggttcagagggcccgaagcgggacgcacctgctccctcccggggtgccggggctgtcagggaggggtgggccgagaagtgtggatgggtacatggagggtcccgggccctcggggtctggctggtagcactgggaggaggtgaaaagcaaggcttgtgagggctcagctcccagagttgcaactctgcggactgcagcggggccttggctccacctgcgcttctggtctcggctgccctgacagccactgggctccaggcaggcctgggtggtgaggacggcgctgggctgcggccaccagatccatggcttccctggacaatgacgggtcagccagacgctctagctgagtcagggcctaggaaacccccgctcccccgccccatacatgtgagtctcccaaggggagagcctaaggaatgctgagacgcagcgggtgggggagcgg

SEQ ID NO: 94103 - DNA, 185 bp, Homo sapiens
  misc_feature 1..185: note = chr5:5571260-5571445
  misc_feature 1..185: note = hypo
  source 1..185: mol_type = genomic DNA
actcactgtgggacccggggaagttccacaaaccctctggggcctcagtctcctcatccataaagtggggacacttagaacagcacctgactcccacgtggatgggagcagctaggccctgatgcccagagagcccaggaccgggaagcaggatgtgtgccggctcttcccggtggggcatccga

SEQ ID NO: 94104 - DNA, 199 bp, Homo sapiens
  misc_feature 1..199: note = chr5:5577412-5577611
  misc_feature 1..199: note = hypo
  source 1..199: mol_type = genomic DNA
gcctctatcctggagcgtgaatgaaaatagactgcgtgtctgttcacatattgatctgggtttatatcttccatctacagccatgctgaggcaagggctgtcttcaaacaaaggcgttgatagacctccatggggaggtcctttgaacaagctgacggatcttccaaatgagtgtgtttgcacgcggtattgatgaagg

SEQ ID NO: 94105 - DNA, 167 bp, Homo sapiens
  misc_feature 1..167: note = chr5:55776589-55776756
  misc_feature 1..167: note = hyper
  source 1..167: mol_type = genomic DNA
aatggcctatttatccggctcttacgcacggccggcagccccggctgggaatcacgggggtggcagccgtccccggaaaacggcggcattccgacacaggaaagcccgcggatcaactgatctgcagacaacgcttcttccttcctgggaagcggccacaaaggcag

SEQ ID NO: 94106 - DNA, 30 bp, Homo sapiens
  misc_feature 1..30: note = chr5:55777140-55777170
  misc_feature 1..30: note = hyper
  source 1..30: mol_type = genomic DNA
aaacacagacatgtgcgtcaccccgggaag

SEQ ID NO: 94107 - DNA, 30 bp, Homo sapiens
  misc_feature 1..30: note = chr5:559409-559439
  misc_feature 1..30: note = hypo
  source 1..30: mol_type = genomic DNA
acagcttatgttttgcgaggaaattgttcg

SEQ ID NO: 94108 - DNA, 39 bp, Homo sapiens
  misc_feature 1..39: note = chr5:56346672-56346711
  misc_feature 1..39: note = hypo
  source 1..39: mol_type = genomic DNA
attacaggcatgagccaccgcgcccggcctggggtgtta

SEQ ID NO: 94109 - DNA, 30 bp, Homo sapiens; identical to SEQ ID NO: 40491
  misc_feature 1..30: note = chr5:5652506-5652536
  misc_feature 1..30: note = hypo
  source 1..30: mol_type = genomic DNA

SEQ ID NO: 94110 - DNA, 211 bp, Homo sapiens; identical to SEQ ID NO: 40492
  misc_feature 1..211: note = chr5:5719870-5720081
  misc_feature 1..211: note = hypo
  source 1..211: mol_type = genomic DNA

SEQ ID NO: 94111 - DNA, 876 bp, Homo sapiens
  misc_feature 1..876: note = chr5:57877797-57878673
  misc_feature 1..876: note = hyper
  source 1..876: mol_type = genomic DNA
ggtgcttttgggttccggtgatgaatgtgttcattttatgtggcttgctctgggtaaataacccagtgccctatcagctctgcagcccgcggccagcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaattagcacaaggtagtgttgtttcctaatcagaaaatcaccatctacttccgaaggcgatagttagcaaagaaaaatctccagctgagataagctggggtcacattcgcctgcccctggcgaggaaaagagcag

SEQ ID NO: 94112 - DNA, 43 bp, Homo sapiens
  misc_feature 1..43: note = chr5:57878910-57878953
  misc_feature 1..43: note = hyper
  source 1..43: mol_type = genomic DNA
gttggagccggttagcgaaccccaagagtgcagagtgtggagc

SEQ ID NO: 94113 - DNA, 236 bp, Homo sapiens; identical to SEQ ID NO: 29611
  misc_feature 1..236: note = chr5:57878954-57879190
  misc_feature 1..236: note = hyper
  source 1..236: mol_type = genomic DNA

SEQ ID NO: 94114 - DNA, 71 bp, Homo sapiens
  misc_feature 1..71: note = chr5:583170-583241
  misc_feature 1..71: note = hypo
  source 1..71: mol_type = genomic DNA
cctgtgactggggatcgctctgccatcggcacaggtgtctctggccgcgggcagcccgcctgtttggggtc

SEQ ID NO: 94115 - DNA, 339 bp, Homo sapiens
  misc_feature 1..339: note = chr5:58335014-58335353
  misc_feature 1..339: note = hyper
  source 1..339: mol_type = genomic DNA
cttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttct

SEQ ID NO: 94116 - DNA, 318 bp, Homo sapiens
  misc_feature 1..318: note = chr5:58335563-58335881
  misc_feature 1..318: note = hyper
  source 1..318: mol_type = genomic DNA
gcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcg

SEQ ID NO: 94117 - DNA, 30 bp, Homo sapiens
  misc_feature 1..30: note = chr5:5880192-5880222
  misc_feature 1..30: note = hypo
  source 1..30: mol_type = genomic DNA
agactggagagttgacgtgggacatgaata

SEQ ID NO: 94118 - DNA, 46 bp, Homo sapiens
  misc_feature 1..46: note = chr5:5886643-5886689
  misc_feature 1..46: note = hypo
  source 1..46: mol_type = genomic DNA
agcctgccgtggacacgtgaactgggccaggcggccacgaggccga

SEQ ID NO: 94119 - DNA, 19 bp, Homo sapiens
  misc_feature 1..19: note = chr5:5887137-5887156
  misc_feature 1..19: note = hyper
  source 1..19: mol_type = genomic DNA
acagacccaggcatccggc

SEQ ID NO: 94120 - DNA, 15 bp, Homo sapiens
  misc_feature 1..15: note = chr5:5887231-5887246
  misc_feature 1..15: note = hyper
  source 1..15: mol_type = genomic DNA
cggtgacacctgcca

SEQ ID NO: 94121 - DNA, 173 bp, Homo sapiens
  misc_feature 1..173: note = chr5:5890841-5891014
  misc_feature 1..173: note = hypo
  source 1..173: mol_type = genomic DNA
aatgccccaaccctgcgttgaccttctcccctccctctcccaattcctgttcccttcttcatgcttcctcgactcagctcccaaattagccatttacccccaaaatctgatctcaagatctacttctgagagaacccaaattaagacagatgcttaaccggaaaagggaaata

SEQ ID NO: 94122 - DNA, 50 bp, Homo sapiens
  misc_feature 1..50: note = chr5:59064594-59064644
  misc_feature 1..50: note = hyper
  source 1..50: mol_type = genomic DNA
aaggagggaaagcaccgcgctcgcacggctttgtccgtgctacaaagcag

SEQ ID NO: 94123 - DNA, 88 bp, Homo sapiens
  misc_feature 1..88: note = chr5:5907706-5907794
  misc_feature 1..88: note = hypo
  source 1..88: mol_type = genomic DNA
taaaatttattttcacgtgtcatagacctccttctacattgtcactattttcatttaaagaatcaataaggcagccgggtgcggtggc

SEQ ID NO: 94124 - DNA, 72 bp, Homo sapiens
  misc_feature 1..72: note = chr5:59188376-59188448
  misc_feature 1..72: note = hyper
  source 1..72: mol_type = genomic DNA
tctccaagtcacccacgtgttctccccttttgctattcaatttacttctccacctgacgaagagaaatgcga

SEQ ID NO: 94125 - DNA, 154 bp, Homo sapiens
  misc_feature 1..154: note = chr5:59188904-59189058
  misc_feature 1..154: note = hyper
  source 1..154: mol_type = genomic DNA
ttggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggc

SEQ ID NO: 94126 - DNA, 319 bp, Homo sapiens
  misc_feature 1..319: note = chr5:59189188-59189507
  misc_feature 1..319: note = hyper
  source 1..319: mol_type = genomic DNA
cggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagc

SEQ ID NO: 94127 - DNA, 375 bp, Homo sapiens
  misc_feature 1..375: note = chr5:59189708-59190083
  misc_feature 1..375: note = hyper
  source 1..375: mol_type = genomic DNA
accaagactagggtgcgcggtgcccggtttcgccagaggttggtccttcttcctccctttcttcttcccttcctttgggcgccggcggcgagagcagggattgtcagcaactcgggctgcagaagcagcagcaacggcggcggcggcagtggtagccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctccacactgctccccactgccccggagccttcctcttcacctccgcttgcctcagtgc

SEQ ID NO: 94128 - DNA, 30 bp, Homo sapiens; identical to SEQ ID NO: 40403
  misc_feature 1..30: note = chr5:595300-595330
  misc_feature 1..30: note = hypo
  source 1..30: mol_type = genomic DNA

SEQ ID NO: 94129 - DNA, 85 bp, Homo sapiens
  misc_feature 1..85: note = chr5:601137-601222
  misc_feature 1..85: note = hypo
  source 1..85: mol_type = genomic DNA
gaccagcagctgggacgggaccagcagtgcatgcggctctggattcatgtttgttgaatgactgactgaacggaggctcccttac

SEQ ID NO: 94130 - DNA, 30 bp, Homo sapiens
  misc_feature 1..30: note = chr5:60139344-60139374
  misc_feature 1..30: note = hyper
  source 1..30: mol_type = genomic DNA
caccaagacaggatgcggctcggggagccg

SEQ ID NO: 94131 - DNA, 30 bp, Homo sapiens
  misc_feature 1..30: note = chr5:60182155-60182185
  misc_feature 1..30: note = hypo
  source 1..30: mol_type = genomic DNA
ctgatttatgttctacgaaaggcactgtca

SEQ ID NO: 94132 - DNA, 58 bp, Homo sapiens
  misc_feature 1..58: note = chr5:602421-602479
  misc_feature 1..58: note = hypo
  source 1..58: mol_type = genomic DNA
cccccagtctgtggccgccgcagggcctcctcctggaccagcccgaagggcacatggg

SEQ ID NO: 94133 - DNA, 30 bp, Homo sapiens
  misc_feature 1..30: note = chr5:6029681-6029711
  misc_feature 1..30: note = hypo
  source 1..30: mol_type = genomic DNA
attggccaaaggctccgtaaacagatcctt

SEQ ID NO: 94134 - DNA, 30 bp, Homo sapiens
  misc_feature 1..30: note = chr5:6080787-6080817
  misc_feature 1..30: note = hypo
  source 1..30: mol_type = genomic DNA
aggttttcctagaagcgccaggagcaggct

SEQ ID NO: 94135 - DNA, 37 bp, Homo sapiens
  misc_feature 1..37: note = chr5:62077372-62077409
  misc_feature 1..37: note = hypo
  source 1..37: mol_type = genomic DNA
tacaggcgtgagccaccgcgcccggcctgatgtaagt

SEQ ID NO: 94136 - DNA, 256 bp, Homo sapiens
  misc_feature 1..256: note = chr5:6219037-6219293
  misc_feature 1..256: note = hypo
  source 1..256: mol_type = genomic DNA
caggcaagctccacacgtcccactgccgctgtggttgagccagccttggctgtgtgatgcctgcaagccattcctggtagcacagagggaaataatgccgaggcaaagaacaagtcagctctgacaccaaggagacggatgataaattgaaatgatgaatttctaatgccggcacaaaatcaggtaggagggatcattcgtcaaatttccagcacaacatacaatggaaaggtttttggttcgatagggaaataga

SEQ ID NO: 94137 - DNA, 30 bp, Homo sapiens
  misc_feature 1..30: note = chr5:6228545-6228575
  misc_feature 1..30: note = hypo
  source 1..30: mol_type = genomic DNA
caccgcggtccctcccgcagctccagccat

SEQ ID NO: 94138 - DNA, 30 bp, Homo sapiens
  misc_feature 1..30: note = chr5:6264312-6264342
  misc_feature 1..30: note = hypo
  source 1..30: mol_type = genomic DNA
aacacaggaggtttgcgagactcagctgaa

SEQ ID NO: 94139 - DNA, 340 bp, Homo sapiens
  misc_feature 1..340: note = chr5:63254903-63255243
  misc_feature 1..340: note = hyper
  source 1..340: mol_type = genomic DNA
gcgagtgttgggacacgctaaacagaattattccccgatccaaaaaggacaagagcgtgaattaggaggaaaaattctacatcgtaaggataaaattgctctttcaggttttactgggggagccagctggagccttgggcacgcgcgccctggggaacctttcctctttgccgcccctgcgtgtcgcccctttaaagccttcttggtctctccaatcccaagagttccgcggcatcttgcgccactggctaaggcaaaaacctcaggtgtctacccgcgcttcagggcgccccagagcgtaggcggaggaacccagatcctgtaagtcagcagccgggag

SEQ ID NO: 94140 - DNA, 69 bp, Homo sapiens
  misc_feature 1..69: note = chr5:63257323-63257392
  misc_feature 1..69: note = hyper
  source 1..69: mol_type = genomic DNA
taagataattggccacgttctgcagggagcgctccaaggcgatggcagccaccacgcacgcattgccca

SEQ ID NO: 94141 - DNA, 250 bp, Homo sapiens
  misc_feature 1..250: note = chr5:63257611-63257861
  misc_feature 1..250: note = hyper
  source 1..250: mol_type = genomic DNA
tcccctggggtcttccgcccttctcctgggaagtttcggaggaagggaatgcagagacccaagcaggaagttcttactgcttcggcgaagggtatctccgaggagcagctttcaggcgctccctgggctctcgcagtccagcgcgttcagaagctccagctgggaaactggagttggcctgaaagcagctccaggatctcccggcggcggagaggtggctggaacgtctgtctgtcgctgtccattttac

SEQ ID NO: 94142 - DNA, 40 bp, Homo sapiens
  misc_feature 1..40: note = chr5:63373761-63373801
  misc_feature 1..40: note = hypo
  source 1..40: mol_type = genomic DNA
atagtaatttctggccgggcgagttggctcacgcctgtaa

SEQ ID NO: 94143 - DNA, 764 bp, Homo sapiens
  misc_feature 1..764: note = chr5:63461355-63462119
  misc_feature 1..764: note = hyper
  source 1..764: mol_type = genomic DNA
aactccagaaaaggccgagtgaggacaagggagaccacagggataatttctgtggctctggtaaggggatgacaagggagaaaaactttcccacggttccgtctggcccgcggcgcttgtctgcctgcgcggggtcaaagcccggcgccgcccacgcgcggctcgggtgggaacccgcagacgtggggcgagcagggccgctggctgtggcgggcgagcgccggggcgccacgtccgaggccgcggggtcggggctgcaggcacagctcgagcgctttccgcggggtttggctcctgtcgcttcccgtctcgccgaaccggcatcgccgccgccggagccgcagcgagtcctcagagcctggctgctggcggccgggagcgccgggacggggcgcgaagccggaggctccgggacgtggatacaggtaaaggccggcgggtcggagtcgggcggggcgcggcggcggcgcctctcggagggacctggcctcggccgggccctacccagccgcggtggcccgggcccccacgttggcccaggcggggacgtgccaaggggctgggctagggttgccgctggcctggccgcctctcgcccggcgggcctcaggtgacgcggccgcggcttaactttcgcacctgaggctctcggagcggcctcggggcgcgcccacctggaggttggaattacacagggtcgaaaaagctgagtcctggaggcgaggcgctgtaggtgtggcggaggaggccggggaaggtggggt

SEQ ID NO: 94144 - DNA, 468 bp, Homo sapiens
  misc_feature 1..468: note = chr5:63801804-63802272
  misc_feature 1..468: note = hyper
  source 1..468: mol_type = genomic DNA
cgaacaacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 94145 - DNA, 32 bp, Homo sapiens; identical to SEQ ID NO: 2574
  misc_feature 1..32: note = chr5:63802273-63802305
  misc_feature 1..32: note = hyper
  source 1..32: mol_type = genomic DNA

SEQ ID NO: 94146 - DNA, 268 bp, Homo sapiens
  misc_feature 1..268: note = chr5:63802339-63802607
  misc_feature 1..268: note = hyper
  source 1..268: mol_type = genomic DNA
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgac

SEQ ID NO: 94147 - DNA, 354 bp, Homo sapiens
  misc_feature 1..354: note = chr5:63986174-63986528
  misc_feature 1..354: note = hyper
  source 1..354: mol_type = genomic DNA
aaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccgg

SEQ ID NO: 94148 - DNA, 415 bp, Homo sapiens
  misc_feature 1..415: note = chr5:63986569-63986984
  misc_feature 1..415: note = hyper
  source 1..415: mol_type = genomic DNA
cgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgctctcccctcgccgggaccagtcc

SEQ ID NO: 94149 - DNA, 30 bp, Homo sapiens
  misc_feature 1..30: note = chr5:643539-643569
  misc_feature 1..30: note = hypo
  source 1..30: mol_type = genomic DNA
tggtctcagacccagcgatcagctttcacc

SEQ ID NO: 94150 - DNA, 880 bp, Homo sapiens
  misc_feature 1..880: note = chr5:6448738-6449618
  misc_feature 1..880: note = hyper
  source 1..880: mol_type = genomic DNA
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccaggtaaggcgagcgcgccggggctgggggcgcggggccgagatcgggtctgcagcgccgccgggcgcccgggccccgtggtgagggccagcgccggcccctccggccatctcgctccctgctctgactacaccagcgccccacggggatgctccgagcgcctccacctcttttccctgagcgttttcttcctgcccctgctttccgtcccgtctctcccgtccccgtctggtctcagtctctgcccgtctctctggtatc

SEQ ID NO: 94151 - DNA, 30 bp, Homo sapiens
  misc_feature 1..30: note = chr5:6456111-6456141
  misc_feature 1..30: note = hypo
  source 1..30: mol_type = genomic DNA
gatgagacgcagctgcggagggtggtgtga

SEQ ID NO: 94152 - DNA, 30 bp, Homo sapiens
  misc_feature 1..30: note = chr5:64767606-64767636
  misc_feature 1..30: note = hypo
  source 1..30: mol_type = genomic DNA
acaaaaacaaaaacacgtcaatgggaatgt

SEQ ID NO: 94153 - DNA, 30 bp, Homo sapiens; identical to SEQ ID NO: 40494
  misc_feature 1..30: note = chr5:6478603-6478633
  misc_feature 1..30: note = hypo
  source 1..30: mol_type = genomic DNA

SEQ ID NO: 94154 - DNA, 153 bp, Homo sapiens
  misc_feature 1..153: note = chr5:64860458-64860611
  misc_feature 1..153: note = hypo
  source 1..153: mol_type = genomic DNA
taaagcccaaactccctcacatggcatataaagccctttatgatgtgatctctccttaccttcttagtgcatcttccattaccttcctctcccaaccccttactttgtactccacccattctaaaatcactcgagaatcggtcttgtactttt

SEQ ID NO: 94155 - DNA, 32 bp, Homo sapiens; identical to SEQ ID NO: 40549
  misc_feature 1..32: note = chr5:65181746-65181778
  misc_feature 1..32: note = hypo
  source 1..32: mol_type = genomic DNA

SEQ ID NO: 94156 - DNA, 60 bp, Homo sapiens
  misc_feature 1..60: note = chr5:65220787-65220847
  misc_feature 1..60: note = hyper
  source 1..60: mol_type = genomic DNA
aattattagggccagcgcaattcaacgactgcaccaccaccgaaccgctggggttggaag

SEQ ID NO: 94157 - DNA, 39 bp, Homo sapiens
  misc_feature 1..39: note = chr5:6522524-6522563
  misc_feature 1..39: note = hypo
  source 1..39: mol_type = genomic DNA
cttatggcaagataacgaaggggacggcaagggctgctc

SEQ ID NO: 94158 - DNA, 30 bp, Homo sapiens
  misc_feature 1..30: note = chr5:6550961-6550991
  misc_feature 1..30: note = hypo
  source 1..30: mol_type = genomic DNA
ttctcaacacccactcgccaaaagtggcca

SEQ ID NO: 94159 - DNA, 30 bp, Homo sapiens
  misc_feature 1..30: note = chr5:6582801-6582831
  misc_feature 1..30: note = hypo
  source 1..30: mol_type = genomic DNA
ctggcgctgcctaagcgggtcaggcaagtc

SEQ ID NO: 94160 - DNA, 578 bp, Homo sapiens
  misc_feature 1..578: note = chr5:6583176-6583754
  misc_feature 1..578: note = hyper
  source 1..578: mol_type = genomic DNA
cgctgcacaccctcccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtggcagaggagagggaagggtcgcgcctggtgggggcc

SEQ ID NO: 94161 - DNA, 175 bp, Homo sapiens
  misc_feature 1..175: note = chr5:6586039-6586214
  misc_feature 1..175: note = hypo
  source 1..175: mol_type = genomic DNA
ggctgcggtacacggcgcccatcctgagccccaggttcctcacatgtcaacagcatgaaaagtgcctctaagacatccacaggtgtgcagtgttaaagcaggtgagtgtcctagtgtagacttagcggagtggggctagggctgcgggtagtgggtgttccgcccccggcttgct

SEQ ID NO: 94162 - DNA, 30 bp, Homo sapiens; identical to SEQ ID NO: 29628
  misc_feature 1..30: note = chr5:65891802-65891832
  misc_feature 1..30: note = hyper
  source 1..30: mol_type = genomic DNA

SEQ ID NO: 94163 - DNA, 71 bp, Homo sapiens
  misc_feature 1..71: note = chr5:65893398-65893469
  misc_feature 1..71: note = hyper
  source 1..71: mol_type = genomic DNA
gagaagaggactccccgcgctccctcggtggcgctggcgtgcgcgcctgcagctcccgttcagacttgttt

SEQ ID NO: 94164 - DNA, 67 bp, Homo sapiens
  misc_feature 1..67: note = chr5:66511784-66511851
  misc_feature 1..67: note = hyper
  source 1..67: mol_type = genomic DNA
acctcaaagggtcctcggtgttcaacaacaggaagtgctggcaggcttccctcgctagggaactgaa

SEQ ID NO: 94165 - DNA, 30 bp, Homo sapiens
  misc_feature 1..30: note = chr5:66673601-66673631
  misc_feature 1..30: note = hypo
  source 1..30: mol_type = genomic DNA
tctggcaggcagtgccgcctgcgtgcaggg

SEQ ID NO: 94166 - DNA, 321 bp, Homo sapiens; identical to SEQ ID NO: 29452
  misc_feature 1..321: note = chr5:6687127-6687448
  misc_feature 1..321: note = hyper
  source 1..321: mol_type = genomic DNA

SEQ ID NO: 94167 - DNA, 112 bp, Homo sapiens
  misc_feature 1..112: note = chr5:675631-675743
  misc_feature 1..112: note = hypo
  source 1..112: mol_type = genomic DNA
ggggtgcagtgtggccggggatgccgtgtggccgggggtgcagtgtggctgggggtgcggtgtggccaggggtgcagcatggggggtacagtgtggccgggagtgcagtgcc

SEQ ID NO: 94168 - DNA, 145 bp, Homo sapiens
  misc_feature 1..145: note = chr5:67573236-67573381
  misc_feature 1..145: note = hypo
  source 1..145: mol_type = genomic DNA
agtgatttaacacttcgcctcttcaccttttaaatttaataattcttttcctcaagttgacctatccatatcctattccagacctacttttcttagagctgtgtggttgtgtgactcactttcggaacgtcggcctacctagtgg

SEQ ID NO: 94169 - DNA, 496 bp, Homo sapiens
  misc_feature 1..496: note = chr5:67583945-67584441
  misc_feature 1..496: note = hyper
  source 1..496: mol_type = genomic DNA
ctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagca

SEQ ID NO: 94170 - DNA, 30 bp, Homo sapiens
  misc_feature 1..30: note = chr5:67591271-67591301
  misc_feature 1..30: note = hypo
  source 1..30: mol_type = genomic DNA
gcaaaagaagttgaacgagtggttgggcaa

SEQ ID NO: 94171 - DNA, 158 bp, Homo sapiens
  misc_feature 1..158: note = chr5:676768-676926
  misc_feature 1..158: note = hypo
  source 1..158: mol_type = genomic DNA
atcatggtggggtgtcgggacatgaggtgaaatgtgctggggcgtgtgagggtgcctcagtgtgcttcccagcattcatccaggagaaaacagacaatgcgtgacacggcaacagacgtgtgcacacatgacacagaaacgcacgtgcacatgcagaa

SEQ ID NO: 94172 - DNA, 464 bp, Homo sapiens
  misc_feature 1..464: note = chr5:677630-678094
  misc_feature 1..464: note = hypo
  source 1..464: mol_type = genomic DNA
ctgccactcaggcctcggcaccgagaagtccggcaatgcccggacccctgctccctgggggcccagatggcacgttcaggctcccatgtcagggctgcttctgagaagggcggggtcttgaagcacaaccccctccactccccatggcccgctccccacagaacccacccaggggctcagggccgcagacccccgtaagtcaggtccctcggcccgtgagcccagcgcactcacttgatcttgctgaagacgatgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctccagggcactgagctcaggggatgcggctgccccctcaccagcaccctccgattccagcgacagcctcttggc

SEQ ID NO: 94173 - DNA, 226 bp, Homo sapiens; identical to SEQ ID NO: 40551
  misc_feature 1..226: note = chr5:67840329-67840555
  misc_feature 1..226: note = hypo
  source 1..226: mol_type = genomic DNA

SEQ ID NO: 94174 - DNA, 49 bp, Homo sapiens
  misc_feature 1..49: note = chr5:68370981-68371030
  misc_feature 1..49: note = hypo
  source 1..49: mol_type = genomic DNA
gctggcgtcagtgcccgcggtgccttccagcacccgcctgtcctggagg

SEQ ID NO: 94175 - DNA, 17 bp, Homo sapiens
  misc_feature 1..17: note = chr5:68391002-68391019
  misc_feature 1..17: note = hypo
  source 1..17: mol_type = genomic DNA
gtaatagcattataacg

SEQ ID NO: 94176 - DNA, 17 bp, Homo sapiens
  misc_feature 1..17: note = chr5:68391319-68391336
  misc_feature 1..17: note = hypo
  source 1..17: mol_type = genomic DNA
cccgcccaacataagca

SEQ ID NO: 94177 - DNA, 54 bp, Homo sapiens; identical to SEQ ID NO: 40407
  misc_feature 1..54: note = chr5:684241-684295
  misc_feature 1..54: note = hypo
  source 1..54: mol_type = genomic DNA

SEQ ID NO: 94178 - DNA, 78 bp, Homo sapiens
  misc_feature 1..78: note = chr5:68475607-68475685
  misc_feature 1..78: note = hypo
  source 1..78: mol_type = genomic DNA
gcccggccctcagtaggcgatttttatatgtggtataaagtagaattcttacagatggatacccgtttatgccagtgc

SEQ ID NO: 94179 - DNA, 70 bp, Homo sapiens
  misc_feature 1..70: note = chr5:6867674-6867744
  misc_feature 1..70: note = hypo
  source 1..70: mol_type = genomic DNA
tgcagagaagggagccggggaccccgggcagtgagccgggcagaatcaccgggaacgactgggatggaag

SEQ ID NO: 94180 - DNA, 136 bp, Homo sapiens
  misc_feature 1..136: note = chr5:697176-697312
  misc_feature 1..136: note = hypo
  source 1..136: mol_type = genomic DNA
acctgtgtgtgtgcacgtgcctgtgtgtgtttgggctgtgattgcatctggttattctgggggtggaattgctgtggaacatggaattaaagtgcaggttccgggtcttgctgccagggagcgactctggcccccc

SEQ ID NO: 94181 - DNA, 120 bp, Homo sapiens
  misc_feature 1..120: note = chr5:6981335-6981455
  misc_feature 1..120: note = hypo
  source 1..120: mol_type = genomic DNA
caacatcaatgccttcgagtttgagttcaggttcttttcagatgcttctcattccgatttcccgaatccccttattgttaccattttctccgcctctccagtgaacgctgttatttttga

SEQ ID NO: 94182 - DNA, 322 bp, Homo sapiens
  misc_feature 1..322: note = chr5:71014657-71014979
  misc_feature 1..322: note = hyper
  source 1..322: mol_type = genomic DNA
cttggggttggggtgcgaggcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggag

SEQ ID NO: 94183 - DNA, 834 bp, Homo sapiens
  misc_feature 1..834: note = chr5:71015031-71015865
  misc_feature 1..834: note = hyper
  source 1..834: mol_type = genomic DNA
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacccctcgaccattccctgtgtccgcggagtcccaccgcagagtgcgtgtgggtccggggctccttataactagggctggaagtgcgcacctgggctgggctcgcagccaaggcggcaacttcaggctccgaagcggtgtgttgcagatcgaagcgctgcaagaagtcttgaagaagctcaagagtaaacgtgttcccatctatgagaagaagtatggccaagtccccatggtaaggtttgtggtcactcccttcccgtgtttttccaagagaaagtacaccgccttgaatcgtacacacagtctt

SEQ ID NO: 94184 - DNA, 1211 bp, Homo sapiens
  misc_feature 1..1211: note = chr5:71402862-71404073
  misc_feature 1..1211: note = hyper
  source 1..1211: mol_type = genomic DNA
ggtgtaggttgagagcgtcttcccccttcacggctgcagcaggagctcagcgggcgccccagccccttggctcgcggccctgccccgaccattgtccgcacacctcgtccctccagcttccgggccgcgggcgagatgatttgctgcagatgacatcagccccgggccaacggctggaagagcggaggcagccaccgcgtgaggatgtgccgggtggtcctttcctcctcctcttcctcctcctcccggctccctgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctctcctcgtcacctctcatacttggtccagaccctttctgggctaattaagaataatccgaattattagatatgagacccagagggagagtctccaataaccttgagggatctgtcaccacgctgagtccgcagcctgtgctgagttggccaccgcctctcccgctaagtgaaatgcaggtgtcaggggagcagaggccacaataaagccgcaaccgcaggaggcagaagggtgggggagacctgatgcaaccactcctttcagtcctcttctggcctcaggaaaaggctgggacccccaccaccgcagacctggggccgaagcccatgtgccagggcccgcgtgggattcatcctcaccacggctacctcagcccctgagaaacgccttttctgatttcaaacctcccgatcctttctttcc

SEQ ID NO: 94185 - DNA, 350 bp, Homo sapiens
  misc_feature 1..350: note = chr5:71404392-71404742
  misc_feature 1..350: note = hyper
  source 1..350: mol_type = genomic DNA
gccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgc

SEQ ID NO: 94186 - DNA, 138 bp, Homo sapiens
  misc_feature 1..138: note = chr5:71404743-71404881
  misc_feature 1..138: note = hyper
  source 1..138: mol_type = genomic DNA
ctctattctcctggggtggtgctgaagcgtttctccgggagacaccggttggtgggcgtggtgcagtccgcactgcggtctctacggcagcccgaggcggacaaagggcgttcacgcagccctcgttccccactcccc

SEQ ID NO: 94187 - DNA, 156 bp, Homo sapiens
  misc_feature 1..156: note = chr5:71491785-71491941
  misc_feature 1..156: note = hypo
  source 1..156: mol_type = genomic DNA
ggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagt

SEQ ID NO: 94188 - DNA, 30 bp, Homo sapiens; identical to SEQ ID NO: 40555
  misc_feature 1..30: note = chr5:72175493-72175523
  misc_feature 1..30: note = hypo
  source 1..30: mol_type = genomic DNA

SEQ ID NO: 94189 - DNA, 240 bp, Homo sapiens
  misc_feature 1..240: note = chr5:72236789-72237029
  misc_feature 1..240: note = hypo
  source 1..240: mol_type = genomic DNA
gcgacatagcgagattccatctcaaacaaacaaaacaaacttgaagacgtatttttcttcctgttgacgaaacatgagacagcagggcctagagagaagtgaaaagaatgttaaaattagcgaaagtgaacatgatgtacaagcagcacaaaggaaaacagacattgttgaaaacacagtgatgtacacagagggcaggatttttcttttttaaaaagaaaaacattttttaagtgacag

SEQ ID NO: 94190 - DNA, 164 bp, Homo sapiens
  misc_feature 1..164: note = chr5:72415759-72415923
  misc_feature 1..164: note = hyper
  source 1..164: mol_type = genomic DNA
gagcgcacgtcgtcccgtgacctggtggctccatattcgatggggagctcgcagcgagtcgcttccctctgtaaccccactccaggtctccagagcagtaggagggccacagggctgctgggtgtagtcgccccggacctcgcggtggccaaggccaaggcggc

SEQ ID NO: 94191 - DNA, 143 bp, Homo sapiens; identical to SEQ ID NO: 29640
  misc_feature 1..143: note = chr5:72416022-72416165
  misc_feature 1..143: note = hyper
  source 1..143: mol_type = genomic DNA

SEQ ID NO: 94192 - DNA, 294 bp, Homo sapiens
  misc_feature 1..294: note = chr5:72497893-72498187
  misc_feature 1..294: note = hyper
  source 1..294: mol_type = genomic DNA
tgccctccgccgggccgacttcccgcgaaactgcagcggctccccctacaggacaaaggaggaaacgctagcggggccccagagccctctccaatgggacccaaagggacacatcccggcacagaccctccccactctaaggcagagcctttcgcagggcctatcacagggcggagggagggagggagggcggcaggaggactgctggcctgaaactctgctttcacaaagaggttacacttcgaagttagacctcatctgcaaatgaggttatggacacggtcccatagaagc

SEQ ID NO: 94193 - DNA, 30 bp, Homo sapiens
  misc_feature 1..30: note = chr5:72511476-72511506
  misc_feature 1..30: note = hyper
  source 1..30: mol_type = genomic DNA
tggcagctgaaacctcgctggctgggctgg

SEQ ID NO: 94194 - DNA, 191 bp, Homo sapiens
  misc_feature 1..191: note = chr5:72512184-72512375
  misc_feature 1..191: note = hyper
  source 1..191: mol_type = genomic DNA
aaggtccgcgggagacgatccccgacctccgggaacaggcctgcggtcggccgccttggcacccaggctctgccgcccccggagactcggatcgagcgctggaagtggccgcaagggacgcgagggagagcagagctgtgaatcagccggaaagtcactccaactccagggaattccgctccgggaagaaa

SEQ ID NO: 94195 - DNA, 29 bp, Homo sapiens
  misc_feature 1..29: note = chr5:72526037-72526066
  misc_feature 1..29: note = hyper
  source 1..29: mol_type = genomic DNA
gctactgctagccctcgccccagactgtc

SEQ ID NO: 94196 - DNA, 279 bp, Homo sapiens
  misc_feature 1..279: note = chr5:72526136-72526415
  misc_feature 1..279: note = hyper
  source 1..279: mol_type = genomic DNA
cgatcagattctatttactgccctcttccccaaccccggggccacctctgaggcatgaacccagagacgcgcgccctggtctgggaaagcaggaccgctgcgcccagcgcctcaggggtagaggcgggaacaggcccgcggtcgctttgctggcggggaagggcgatctgacgatcagggagttgcgcccctctctctgggcctcgtgaaggaacagagcaattacagcgctgggccggccacgtagtcctggggctaggtgggcccaatgctccgggc

SEQ ID NO: 94197 - DNA, 209 bp, Homo sapiens
  misc_feature 1..209: note = chr5:72526491-72526700
  misc_feature 1..209: note = hyper
  source 1..209: mol_type = genomic DNA
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacatgtggggcaaaagagacgtattttaaaaccc

SEQ ID NO: 94198 - DNA, 15 bp, Homo sapiens
  misc_feature 1..15: note = chr5:72528095-72528110
  misc_feature 1..15: note = hyper
  source 1..15: mol_type = genomic DNA
atagactcagaaacc

SEQ ID NO: 94199 - DNA, 458 bp, Homo sapiens
  misc_feature 1..458: note = chr5:72528189-72528647
  misc_feature 1..458: note = hyper
  source 1..458: mol_type = genomic DNA
cggccgcccttaggagaccagtgatcatcccagccacctccctgcccagccccgggccgaactggaaaactcttaactttgggctttatttaaaacactcgggtttcgaaagccgggtcccctccgcaggccaggaggcctcagtgagcatcctgtgctgcgtggggagggcctggcagctggcggatccgtctgggctgcagctgcagggtcgggagctcttcttggactcggctcctttcagaaaactcttttcttgtcggatgtggtttccctttaattaatcactcatgcccgcgtgtccaccgcgccgcttccccactcttcctccagccccgcatgtgatctctatttggaggcaggagagctggtggagcatctggggttgccgcggaggtggttctgcctgccgctgggcttcgggccgccgcccagagacagagcgatatcctcccaga

SEQ ID NO: 94200 - DNA, 833 bp, Homo sapiens
  misc_feature 1..833: note = chr5:72528993-72529826
  misc_feature 1..833: note = hyper
  source 1..833: mol_type = genomic DNA
gtgcaggctcctttccggaaagccctggccccaaaccccaacatcaagccactctcaggattgcggggcagtgggcaagacctgatccagagggtgtgcattaagccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 94201 - DNA, 747 bp, Homo sapiens
  misc_feature 1..747: note = chr5:72529889-72530636
  misc_feature 1..747: note = hyper
  source 1..747: mol_type = genomic DNA
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacacacttgctctggtaaagaaaacatgtcccagatgaaagacgtttttttcaaacgtacatgtgttttgcagaaaacggaggtgacagggtgggataacgaggagaaaggaagggtggctttcctgcctcccccacccccgaaaggtcatcggagtcagaggggtaaccatcgggttaaaaagtattgtgggcagagttcagatgtccggtgaatcgcacggttctgccctgggggagatctgccttccacccccacccccgcggaatgacagaaagagttgggaggaccgtggggatgtagat

SEQ ID NO: 94202 - DNA, 67 bp, Homo sapiens
  misc_feature 1..67: note = chr5:72594770-72594837
  misc_feature 1..67: note = hyper
  source 1..67: mol_type = genomic DNA
aaagagaaaaggcaccgggcacggaggtttaatgtgaagcatgtgagcggggctcagtttacaggta

SEQ ID NO: 94203 - DNA, 150 bp, Homo sapiens; identical to SEQ ID NO: 29652
  misc_feature 1..150: note = chr5:72594867-72595017
  misc_feature 1..150: note = hyper
  source 1..150: mol_type = genomic DNA

SEQ ID NO: 94204 - DNA, 676 bp, Homo sapiens; identical to SEQ ID NO: 29653
  misc_feature 1..676: note = chr5:72595046-72595722
  misc_feature 1..676: note = hyper
  source 1..676: mol_type = genomic DNA

SEQ ID NO: 94205 - DNA, 199 bp, Homo sapiens
  misc_feature 1..199: note = chr5:72595773-72595972
  misc_feature 1..199: note = hyper
  source 1..199: mol_type = genomic DNA
cgaaccaatgggcagaccggggagagcgggacgcgcaggagagggtttgaaaggaggtgtgggttttaatttttaaagagcataattgggctgaggagggttattttttccttggccacgggaaaaaaaagaggaagaaggggaaaaaaaagtcaggcgaaacacaacacatttatctatcaaccgctagacaagacaa

SEQ ID NO: 94206 - DNA, 134 bp, Homo sapiens
  misc_feature 1..134: note = chr5:72596806-72596940
  misc_feature 1..134: note = hyper
  source 1..134: mol_type = genomic DNA
gggttgttgccttggcgtttactaaattcatttacactgaaaaccacatgtatgacacagagaggttgagcgttgccaaggactgctttgtttgctcttcccttccaggaggaagggaacgaacgacacgaacg

SEQ ID NO: 94207 - DNA, 72 bp, Homo sapiens; identical to SEQ ID NO: 7872
  misc_feature 1..72: note = chr5:72598030-72598102
  misc_feature 1..72: note = hyper
  source 1..72: mol_type = genomic DNA

SEQ ID NO: 94208 - DNA, 383 bp, Homo sapiens; identical to SEQ ID NO: 449
  misc_feature 1..383: note = chr5:72599059-72599442
  misc_feature 1..383: note = hyper
  source 1..383: mol_type = genomic DNA

SEQ ID NO: 94209 - DNA, 396 bp, Homo sapiens; identical to SEQ ID NO: 29658
  misc_feature 1..396: note = chr5:72599462-72599858
  misc_feature 1..396: note = hyper
  source 1..396: mol_type = genomic DNA

SEQ ID NO: 94210 - DNA, 30 bp, Homo sapiens; identical to SEQ ID NO: 7875
  misc_feature 1..30: note = chr5:72608427-72608457
  misc_feature 1..30: note = hyper
  source 1..30: mol_type = genomic DNA

SEQ ID NO: 94211 - DNA, 50 bp, Homo sapiens
  misc_feature 1..50: note = chr5:72677145-72677195
  misc_feature 1..50: note = hyper
  source 1..50: mol_type = genomic DNA
gctaaaattaatctgcgctgggccacttgcagaaagcagaaccacctccc

SEQ ID NO: 94212 - DNA, 52 bp, Homo sapiens; identical to SEQ ID NO: 29660
  misc_feature 1..52: note = chr5:72677774-72677826
  misc_feature 1..52: note = hyper
  source 1..52: mol_type = genomic DNA

SEQ ID NO: 94213 - DNA, 32 bp, Homo sapiens; identical to SEQ ID NO: 29661
  misc_feature 1..32: note = chr5:72677997-72678029
  misc_feature 1..32: note = hyper
  source 1..32: mol_type = genomic DNA

SEQ ID NO: 94214 - DNA, 86 bp, Homo sapiens
  misc_feature 1..86: note = chr5:72715262-72715348
  misc_feature 1..86: note = hyper
  source 1..86: mol_type = genomic DNA
gtagtggggagggggcgccaagagtaacaaagggagccagcggcctggtttgtttggattgccgggccggcgcgggagcggccggg

SEQ ID NO: 94215 - DNA, 106 bp, Homo sapiens; identical to SEQ ID NO: 29663
  misc_feature 1..106: note = chr5:72715590-72715696
  misc_feature 1..106: note = hyper
  source 1..106: mol_type = genomic DNA

SEQ ID NO: 94216 - DNA, 406 bp, Homo sapiens
  misc_feature 1..406: note = chr5:72715730-72716136
  misc_feature 1..406: note = hyper
  source 1..406: mol_type = genomic DNA
cgcagtactgctctcccgccccccggagccgagcctcttcgcgttcgcaccgtgaaaggaggggagcgaggggttagccatctcgaacatttttaactaatcaaaatatttgctgatgagtatttatttttacaagaactcggtttggctggagacttcccgagcaacaatatgggctgccgtattaggtttgtgacggagccaagtgtggttggggcttattgaatctgcgggccggagatcgctcgctccggagacgtttctccgttctggggaagcagctttcccaaaaccgtccttctgcagatggctcttagaacacaaccacatgtcccctaaagcacgggaagcttcgtgttttatgtttgggctgaatgaaaagaggaacgcacgctctttcctgccc

SEQ ID NO: 94217 - DNA, 30 bp, Homo sapiens
  misc_feature 1..30: note = chr5:72716375-72716405
  misc_feature 1..30: note = hyper
  source 1..30: mol_type = genomic DNA
gtgattaaacaactacgtcaagtcattgca

SEQ ID NO: 94218 - DNA, 30 bp, Homo sapiens; identical to SEQ ID NO: 29666
  misc_feature 1..30: note = chr5:72731806-72731836
  misc_feature 1..30: note = hyper
  source 1..30: mol_type = genomic DNA

SEQ ID NO: 94219 - DNA, 152 bp, Homo sapiens
  misc_feature 1..152: note = chr5:72732228-72732380
  misc_feature 1..152: note = hyper
  source 1..152: mol_type = genomic DNA
ttcacaacccctaagcggttcagtccccgggcctagcgacactccagagcgctcctaattagtctaattagaaaggtggattgatagatggaaagaagacagagttgggttaggaagatgctcaatgctgccaatctcggctgggttgccgc

SEQ ID NO: 94220 - DNA, 41 bp, Homo sapiens; identical to SEQ ID NO: 29667
  misc_feature 1..41: note = chr5:72732869-72732910
  misc_feature 1..41: note = hyper
  source 1..41: mol_type = genomic DNA

SEQ ID NO: 94221 - DNA, 173 bp, Homo sapiens
  misc_feature 1..173: note = chr5:72733012-72733185
  misc_feature 1..173: note = hyper
  source 1..173: mol_type = genomic DNA
gctcgccacagccggcgggaggcggggaagggagcagcccgggtggcttggagaacactgaacctttaattgggctataaatcagacaggggagtgcggtggagtttatgcaggtgtaaaaacagaggggaaagcccgggccgagcagccaaagcgcccgggcaggtcagaac

SEQ ID NO: 94222 - DNA, 87 bp, Homo sapiens
  misc_feature 1..87: note = chr5:72733501-72733588
  misc_feature 1..87: note = hyper
  source 1..87: mol_type = genomic DNA
ggggccccgggcgagcgggcagcggcccccgcgtccctcccggacacagcgccaccgagaggccgagcctcccgctcctgttgccat

SEQ ID NO: 94223 - DNA, 245 bp, Homo sapiens
  misc_feature 1..245: note = chr5:72740103-72740348
  misc_feature 1..245: note = hyper
  source 1..245: mol_type = genomic DNA
cggcctgacggggcgcgccccgcgctcctggctcgcccatccagggtccacggctcactcgtccctcgcctgccccgcggcccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaatcgaggcggc

SEQ ID NO: 94224 - DNA, 1912 bp, Homo sapiens
  misc_feature 1..1912: note = chr5:72742569-72744481
  misc_feature 1..1912: note = hyper
  source 1..1912: mol_type = genomic DNA
ggctgtagcataggtcggctttgcataaatagagggacccgcagagccaaaaggcgcgcccgggctgttgacagttttgtccgagaattcgcagcggcgaaaatgggcgcgcgaggtcgagaggggccgcgcctggaggagcgaacaaaacaccgaaccaccaagacgagaaaaggagccgggattcctaccttcttcctcgagcgcgctaacatagcgttattaacaattggaaatcctagcagtaaagttctcgacactggacagggcagtcccttggtgcagagtccccaaggcggcggacgaggagactgaggaggcggcggcggccgcggcggccacgagggatcgggtgagcgcggccgccgggcccacggccgcctgcgccgcgcagcctcctccgctggatccgggagctggcggcgccgccaccggcgagggcgagggcgaggcctgagcggcggcggcggcctgcgcggcggcggcggcagcggcggccgggcccaagctgcccccgatgatgctctcgatggagaagggcgagcgcgccagcgctgaggcgcccgggccgcccgccttggccgcggaggccggcagggggccgggtagggcggcgccgagcgggtgcggccggtagccgaaggcggtccgggccagctcggcggccgcgccgtgcggtggcgggggcggcgggggcgagtgcgggtggaaggcggcggcggcggcggcgcgctgcggcggcgaagagggccgagggcggcgcgtaaggcggcagctgcaggccgtagccgcagccgtaggggccgtagccgtaggcatgcgggggcggcgggggcgcgggcgggaagagcgcggcggcggctgccgggtcgcccgcgccccctgcggctcccgcgccgcgcagcagcagagactcggcggccgcggcgttgggtgggagcagcggctgccgcttgaagcgcttcctccggcgcaggaagctgccgttgtcgaacatgtcggcggactccgggtccagcgtccagtagttgcccttgcccgggttgccgggctcgcgggggatcttgacgaagcagtcgttgagcgagaggttgtggcggatgctgttctgccaggcggggaacttctcccggtagtaggggaagcggccgctgatgaactcacagatctcgctcagcgtcagccgcttcttggggctctgcaggatggccatagtgatgagcgcgatatacgagtagggcggcttcaccagcgggttcttggcgccgctacccgcgctcccgccgccgcccgcgccgccgccgccgccgcccccaccggctcctgcccccgccgccggggccgggcccgggggcgccggggagcccccagcaggcggggccagcaggatgtcatcgtcgtcctcctcctcctccagatcctccagctcgtcctccccggcgtacgagcgccgccgccgccgccgctgcgcggggacagccagccggggcccgccaccgccgccctcgtcgtcgtcctcctcttcctcgtcttcttcgtcctcgccctcccccaccacgtcgatgtctgtttcctcggcgaggccagaggcatcggacatctcagtgctcagggtcatagctgtggcgcggcggcggcggggcggcgcatgggggcgccgggctccgggctccctctgcgccccagcccgggtcccgggcggcaggcccggccggggggcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgaccttctcctctcggagcagcttttgc

SEQ ID NO: 94225 - DNA, 499 bp, Homo sapiens
  misc_feature 1..499: note = chr5:72744697-72745196
  misc_feature 1..499: note = hyper
  source 1..499: mol_type = genomic DNA
gaaatcagcccttctcgggagagaaaattcacccgtaggagggaggcagcagctgagaagagtggggaggagaggggacctcactatttcttgccaaagaggctgatgcccgaattacgcggctgtctgcaccgagggccgctgcacgagttagacttcccagcctcctcaattagtcctccaccctaacctcagaagcacacccgcgacactctggtttgacccctcgacagcctgtaggagccttccagccgggggataaccaccccatcctctgaggtggcccctgggggacgctctggggtcggttgggggtgtccagcccctccagatcgggcgagcggccccccattggatctgatgcgaagccccccaatttaagcacgataataattgtttattgaccctttaacccattctcttcggttttactccaaagacgtttgttttccgccatctgttaataaaaacgctgtgagactggcgttttactcacttc

SEQ ID NO: 94226 - skipped

SEQ ID NO: 94227 - DNA, 528 bp, Homo sapiens
  misc_feature 1..528: note = chr5:72746992-72747520
  misc_feature 1..528: note = hyper
  source 1..528: mol_type = genomic DNA
agtcgcgaaattccccgagcgcggaaactcaagcgattcacgtcttgcgcgacccccttgtctcccccatcgtcccctaccccgggcctccttctctacagcgctcccagctttcggccccagctggtaactctcccccggctccccgcccccaagctggtacaagggaccaaaacctttcccagaggcgagccggggaagcgacgcgaagacccccgtccggcgcaacccgctcgcgtggacgcggaaagtggcgggcggcgggtcccggtggtgcctgcgtagggcagagttgccccctggcggcggtgcgacgacctgcgggccctcgcgcccgggccggcaactccctgggagctcggcccgcgcggggaactcgcccagcagcctgtgtttctcgagtgtgggcagccggctcccgggcgtccctcccaccggctgcgggggcccgggactgggcggtagtggaggcaggtccttggactgcaggctgaggctttttccccccacgagcggtttgggccctcc

SEQ ID NO: 94228 - DNA, 30 bp, Homo sapiens
  misc_feature 1..30: note = chr5:72747820-72747850
  misc_feature 1..30: note = hyper
  source 1..30: mol_type = genomic DNA
tagaaggctgtattgcgatagtgtttgtac

SEQ ID NO: 94229 - DNA, 179 bp, Homo sapiens
  misc_feature 1..179: note = chr5:7394900-7395079
  misc_feature 1..179: note = hyper
  source 1..179: mol_type = genomic DNA
gggggctctttgggccggaccacactcgaataggaggaaacttccagaagggtgggttcctttggtgataagcaatgaagccccttcggcccccagggcgaaggccagcggcctccgctcccacgcgtgtcgggaggggacactgtccctggtgacatccgcccccacaacgctcctgc

SEQ ID NO: 94230 - DNA, 234 bp, Homo sapiens
  misc_feature 1..234: note = chr5:7395160-7395394
  misc_feature 1..234: note = hyper
  source 1..234: mol_type = genomic DNA
cgcccagccgctctccccggcgcccctttgccgccatccccgctcagcagaggggctcggcgaggaccacgaccagccacggggcagctctgtaaacctgtgatatgacaggcttatacggcacctccaaagtgtgactgaagctgagcgtgcagggcgcaacggacgctgcccccgcgaggccgtggcgggggctcccagtgcagtcactgccgcttcacttccacatggtgc

SEQ ID NO: 94231 - DNA, 831 bp, Homo sapiens
  misc_feature 1..831: note = chr5:7395433-7396264
  misc_feature 1..831: note = hyper
  source 1..831: mol_type = genomic DNA
cgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggagggaccccccgggtcctctgaccccggctgcgctctgtgactgtgggggagggtgggagcaggccccgcagcccactaaggggtggaggaaacaggagggtggcagcgtccctgcccgctgaccttgaggtagtggagaggagctgaggagccccgcagtgctccgagccaggtggggcggggggagtggtgggggtaggactccctccctccaccccttaggctgtgttctcacttcgtagcggggagggccgtccctcccaccccacccacgctgcactcgggatagggcagaggaggtggacgacctggtggctgagtgtgggaggccggcgggcgaggacgaccccgggccggggcgcagcgggagcccctcagttcgccactccccccaccgtacagcccccgccgtccccagcctgcagccgggccgtcgggtgggggccgacaccgcccctgcacggaggccggctgcgcgcggggcggggagcggcgggcggagggccccgtggaacccgccccctcccgcgcggtggcggtggcggcggcggcgccgggagctgcccccgaggccgccgcccggcccccgcccgcgcgtcagcgcgcccagcccggggcgccgagctc

SEQ ID NO: 94232 - DNA, 505 bp, Homo sapiens
  misc_feature 1..505: note = chr5:7396473-7396978
  misc_feature 1..505: note = hyper
  source 1..505: mol_type = genomic DNA
gcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcccctcggcccgcggctccctgcttctcctgctggcccgcggcccggtggactctggcaagggctgcgggcgggagaaaagtttcctgggaaggctcttcccaaaataaagttcccgaggtgttcaccaggtggacgggcagggcgtgtgctttttgcatctttgcgcacccgctggcaaactctgcgctttccgccgggcaccgctgcccgcagcgctggaataggtcttcccc

SEQ ID NO: 94233 - DNA, 56 bp, Homo sapiens; identical to SEQ ID NO: 29459
  misc_feature 1..56: note = chr5:7396979-7397035
  misc_feature 1..56: note = hyper
  source 1..56: mol_type = genomic DNA

SEQ ID NO: 94234 - DNA, 104 bp, Homo sapiens
  misc_feature 1..104: note = chr5:74061423-74061527
  misc_feature 1..104: note = hypo
  source 1..104: mol_type = genomic DNA
aaagagattatataacgtactgtacctaaaatatacaaatgctagttactatttctggttttaaagagaatgatgagatcaccttagaaaatggagccttaaaa

SEQ ID NO: 94235 - DNA, 67 bp, Homo sapiens; identical to SEQ ID NO: 29677
  misc_feature 1..67: note = chr5:74161713-74161780
  misc_feature 1..67: note = hyper
  source 1..67: mol_type = genomic DNA

SEQ ID NO: 94236 - DNA, 35 bp, Homo sapiens
  misc_feature 1..35: note = chr5:74162202-74162237
  misc_feature 1..35: note = hyper
  source 1..35: mol_type = genomic DNA
gtgacgcactagcgccgcagcgcctccagccttcg

SEQ ID NO: 94237 - DNA, 110 bp, Homo sapiens
  misc_feature 1..110: note = chr5:74162506-74162616
  misc_feature 1..110: note = hyper
  source 1..110: mol_type = genomic DNA
atataaaaatagatgcggttaagccgcgggggctgcaacgctgattttgcgtattcctttaatgccgaccttcgcaggattctgttcgcatagcccggtggagttctcca

SEQ ID NO: 94238 - DNA, 381 bp, Homo sapiens
  misc_feature 1..381: note = chr5:74348254-74348635
  misc_feature 1..381: note = hyper
  source 1..381: mol_type = genomic DNA
tagcaccgtttcctacgtgaagactgcaaatggactcgagcgtcccgtttctcggctcggatcccagaagctcccgacccgctgtggtaggcaccgccacctcgcaggcagacgatcccggcccgctctgcggcacaaaaaacttgaccttaaaaagcccagaaactggtctctgggaagggcgcggcctgggaggcgcggcccgcagcttccgcccccaaagaacaactcggaggccccctccagccccggttgccctggcgcagaagccgcggtagcagtcctttcaggcgccccgcgtccctgtcccgaagcccaggggcgggggctcgggcagcatcgcttgtcccctctggtccagggctgcggagaagcggcaag

SEQ ID NO: 94239 - DNA, 511 bp, Homo sapiens
  misc_feature 1..511: note = chr5:74349496-74350007
  misc_feature 1..511: note = hyper
  source 1..511: mol_type = genomic DNA
cccggggtgggagagcgctgagcggcccccgtgacgtgcggagaaagtaggagcgcctccgcgctcccgcagagggagctccctgccctgcgctcccagtccccgggccgcgcttcggacaaagttctcaggcgcgcgcggtgatctcggctctccgccgctgcccggagcgtcatccacgttcggttccctcccacattagacaagaaatctgaggtcaggagagctaagtaacttgcccaaagtcgctcacaaggcagtgacgaagcaaactcacatccgcggctccttttttctccttgaacgccgggctctgcggaggctcaggccctgcaggaatcgcccaaccagacagaaggcagctcgctctcatgggtgagacgaggagtgtcccacgcagccgcgagaaatattatcagcagcgtgggaaggtggagctttttgccgaataactagagtgcaaagttgtttttcaaacagtgcctacatgccaaatcggcttgctttttat

SEQ ID NO: 94240 - DNA, 25 bp, Homo sapiens
  misc_feature 1..25: note = chr5:74536034-74536059
  misc_feature 1..25: note = hypo
  source 1..25: mol_type = genomic DNA
aatttttttttgagacggagtttcg

SEQ ID NO: 94241 - DNA, 125 bp, Homo sapiens
  misc_feature 1..125: note = chr5:74906134-74906259
  misc_feature 1..125: note = hypo
  source 1..125: mol_type = genomic DNA
aataacaggcagcagcgggatttggcctggggatggagcaaagtgaccccctgctgtagagcaaggtgagtgagtcacgcccttgacaacacattcttagaagtcatgctcgttaggggcaagtt

SEQ ID NO: 94242 - DNA, 104 bp, Homo sapiens
  misc_feature 1..104: note = chr5:74907576-74907680
  misc_feature 1..104: note = hyper
  source 1..104: mol_type = genomic DNA
tggaggagcctgtcccggatcccgaagcgggagggtcttggagaggaggacacagcagttgccggacacgagctccgtgagtcccgggacgaggtctcagaaaa

SEQ ID NO: 94243 - DNA, 42 bp, Homo sapiens
  misc_feature 1..42: note = chr5:75014106-75014148
  misc_feature 1..42: note = hypo
  source 1..42: mol_type = genomic DNA
ttacaggcgtgagccaccacgcccggccgaaggtgttgattc

SEQ ID NO: 94244 - DNA, 116 bp, Homo sapiens
  misc_feature 1..116: note = chr5:75377684-75377800
  misc_feature 1..116: note = hyper
  source 1..116: mol_type = genomic DNA
accgcctgtctccaccggctcctctgggcaggaggctccagcctgggggtgcctgacagctctccttccccggcgcctgtattatacatgtaacatttatatttctatccacacag

SEQ ID NO: 94245 - DNA, 438 bp, Homo sapiens
  misc_feature 1..438: note = chr5:75377859-75378297
  misc_feature 1..438: note = hyper
  source 1..438: mol_type = genomic DNA
cggagagatgtgtgtgtttgagttccaatcactgcagcccgtattggcgcggcgctttgtctcgctttgggtcaccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 94246 - DNA, 155 bp, Homo sapiens
  misc_feature 1..155: note = chr5:75378559-75378714
  misc_feature 1..155: note = hyper
  source 1..155: mol_type = genomic DNA
gtagacttaacccagcgaagttttcttctgtttgctcttgctgtgcccaagtttcctctggacttgtcttccagcgtcggggtgggggctgggggaagtaggcaacctagctctgcctggttgctccctggaagccaagtcgaagtgaacaagtc

SEQ ID NO: 94247 - DNA, 689 bp, Homo sapiens; identical to SEQ ID NO: 29683
  misc_feature 1..689: note = chr5:75379005-75379694
  misc_feature 1..689: note = hyper
  source 1..689: mol_type = genomic DNA

SEQ ID NO: 94248 - DNA, 857 bp, Homo sapiens
  misc_feature 1..857: note = chr5:75380067-75380924
  misc_feature 1..857: note = hyper
  source 1..857: mol_type = genomic DNA
caggcgaagcagacccgaggctgtgaagctcagaggggagagggaccaatcgcagtaaataagctaccgaggtaatcttagatggcgatgagggcagcaaaagccatcagccgaccctctgaccctttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcccttcatacttagctgactgctagcgcggtagcttccgtttaattcttatc

SEQ ID NO: 94249 - DNA, 36 bp, Homo sapiens
  misc_feature 1..36: note = chr5:75587117-75587153
  misc_feature 1..36: note = hypo
  source 1..36: mol_type = genomic DNA
aggaggtgttttgttcggatccgcaccgagctgtac

SEQ ID NO: 94250 - DNA, 21 bp, Homo sapiens
  misc_feature 1..21: note = chr5:75688128-75688149
  misc_feature 1..21: note = hypo
  source 1..21: mol_type = genomic DNA
acagagcgagactccgtctca

SEQ ID NO: 94251 - DNA, 30 bp, Homo sapiens
  misc_feature 1..30: note = chr5:75698244-75698274
  misc_feature 1..30: note = hyper
  source 1..30: mol_type = genomic DNA
tgtttttcctgttatcgggtcacccacaca

SEQ ID NO: 94252 - DNA, 714 bp, Homo sapiens
  misc_feature 1..714: note = chr5:75699459-75700173
  misc_feature 1..714: note = hyper
  source 1..714: mol_type = genomic DNA
ctccctccccgaggacggcgttggagaagccgagggagccggttgcgcggcgcagaggaaattggaaggcagcaactgcgcggctggcaaagttgggagctggagttgcaaagggcagtgaatcgcgtccccccgctcctcccgccccccaattcctaatatccagctggcaacccagaccctccactccgcatacccaaacggggtgcgcgggcagtgcggggattgcgctctgggacagaccaggttgggattttaggggtatcaggtgaggagtccgcggagctccgggtcgccgccggcttgggccagggggtggcgtaaggcaccggattcttccaacccagaaggggaggaaagtttgtttgctgtggctacaggtgggcaccgcaagtagggcgccggcgcactctgctagtgcaaagccggcttgactggaagggcgggagtctcctcctgtcccgcgccctcgaacttcacctgacccgctagagccattggcctcacaggtgtaagtccctcccctctgaaaccccccaacccctttcccccccgctcccctcgcgcgggaggattgctgtgtggagaggacgcggcactaggctccggggaatccggcgggagcccgcgtgacttgaacgagatggtgtcgattacccagccaggggctgccctcggaaataggttgctttggccgatcgtgagtggatggag

SEQ ID NO: 94253 - DNA, 17 bp, Homo sapiens
  misc_feature 1..17: note = chr5:75719149-75719166
  misc_feature 1..17: note = hypo
  source 1..17: mol_type = genomic DNA
aaaatggtgcttggtcg

SEQ ID NO: 94254 - DNA, 76 bp, Homo sapiens
  misc_feature 1..76: note = chr5:75743288-75743364
  misc_feature 1..76: note = hypo
  source 1..76: mol_type = genomic DNA
aaatcttgtaactgcaaaaacaaacaaacaaacaaaaaacatggggcatagccacgtccgtcgagagctgccagaa

SEQ ID NO: 94255 - DNA, 30 bp, Homo sapiens; identical to SEQ ID NO: 40558
  misc_feature 1..30: note = chr5:75819580-75819610
  misc_feature 1..30: note = hypo
  source 1..30: mol_type = genomic DNA

SEQ ID NO: 94256 - DNA, 30 bp, Homo sapiens
  misc_feature 1..30: note = chr5:75913911-75913941
  misc_feature 1..30: note = hypo
  source 1..30: mol_type = genomic DNA
tgcttgggcaggccccggtaggtgaaagga

SEQ ID NO: 94257 - DNA, 89 bp, Homo sapiens; identical to SEQ ID NO: 40559
  misc_feature 1..89: note = chr5:75963986-75964075
  misc_feature 1..89: note = hypo
  source 1..89: mol_type = genomic DNA

SEQ ID NO: 94258 - DNA, 40 bp, Homo sapiens
  misc_feature 1..40: note = chr5:75965679-75965719
  misc_feature 1..40: note = hypo
  source 1..40: mol_type = genomic DNA
ttcttcttcctaggccggagtgcaatggcatgatctcagc

SEQ ID NO: 94259 - DNA, 30 bp, Homo sapiens; identical to SEQ ID NO: 40560
  misc_feature 1..30: note = chr5:75969716-75969746
  misc_feature 1..30: note = hypo
  source 1..30: mol_type = genomic DNA

SEQ ID NO: 94260 - DNA, 30 bp, Homo sapiens
  misc_feature 1..30: note = chr5:75996136-75996166
  misc_feature 1..30: note = hypo
  source 1..30: mol_type = genomic DNA
gcttggctgacgtggcgaaactccttctcc

SEQ ID NO: 94261 - DNA, 580 bp, Homo sapiens
  misc_feature 1..580: note = chr5:76011174-76011754
  misc_feature 1..580: note = hyper
  source 1..580: mol_type = genomic DNA
atgcgcaggtgaccccggcgggcggcgcgggaaagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaagaattctgtccagactcaagggccctttctcatttaggggcaaccctgtcactacatcataaacttttaaatccgtgatccccacgttacaaaagcagaagtcccttttagacttttagcgaaaactgaactttgccggtgtcccacacggagggagggaggacgggaggccacgccagggctgcggggctgcagggcgtggacgcatcctggccggggcgtccactgtcgacgtctccacatcccaggagggtcgagacggccgcgggaagcagcctgcgagccgtgcggccccattccaaggaccccgccagtgtgagtcactgacagcttcgcgaatcaacggtgcccagaggaaaaaacttctcatttggacttctaggcccggcagtggccggcg

SEQ ID NO: 94262 - DNA, 35 bp, Homo sapiens
  misc_feature 1..35: note = chr5:76012164-76012199
  misc_feature 1..35: note = hyper
  source 1..35: mol_type = genomic DNA
ctgcttcagtctgtgcggcccgctgttgtctgccc

SEQ ID NO: 94263 - DNA, 41 bp, Homo sapiens
  misc_feature 1..41: note = chr5:76012602-76012643
  misc_feature 1..41: note = hyper
  source 1..41: mol_type = genomic DNA
taaaatataaagtggcgaaccgctgccgctgaagttttgct

SEQ ID NO: 94264 - DNA, 30 bp, Homo sapiens
  misc_feature 1..30: note = chr5:76114850-76114880
  misc_feature 1..30: note = hyper
  source 1..30: mol_type = genomic DNA
ccctgaaacctaacccgccctggggaggcg

SEQ ID NO: 94265 - DNA, 63 bp, Homo sapiens
  misc_feature 1..63: note = chr5:76115162-76115225
  misc_feature 1..63: note = hyper
  source 1..63: mol_type = genomic DNA
atccgggcaggtgtgcgaaggctgttctgctgccggcacccatctctacgaatcccttagcct

SEQ ID NO: 94266 - DNA, 166 bp, Homo sapiens
  misc_feature 1..166: note = chr5:76115443-76115609
  misc_feature 1..166: note = hyper
  source 1..166: mol_type = genomic DNA
acctagtcccctccccgggcttggttgctttgtaaacactaagtcattaagagctttttgccaactccggagacttcctccgctggccccgcggggccggtggggttagcgagctgattgcgcagggcagggcggagtgggtgggaacccgcggcccgggagcctt

SEQ ID NO: 94267 - DNA, 392 bp, Homo sapiens
  misc_feature 1..392: note = chr5:76249279-76249671
  misc_feature 1..392: note = hyper
  source 1..392: mol_type = genomic DNA
ccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggagg

SEQ ID NO: 94268 - DNA, 212 bp, Homo sapiens; identical to SEQ ID NO: 452
  misc_feature 1..212: note = chr5:76249695-76249907
  misc_feature 1..212: note = hyper
  source 1..212: mol_type = genomic DNA

SEQ ID NO: 94269 - DNA, 206 bp, Homo sapiens; identical to SEQ ID NO: 29692
  misc_feature 1..206: note = chr5:76249944-76250150
  misc_feature 1..206: note = hyper
  source 1..206: mol_type = genomic DNA

SEQ ID NO: 94270 - DNA, 236 bp, Homo sapiens
  misc_feature 1..236: note = chr5:76250409-76250645
  misc_feature 1..236: note = hyper
  source 1..236: mol_type = genomic DNA
cttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataa

SEQ ID NO: 94271 - DNA, 30 bp, Homo sapiens; identical to SEQ ID NO: 40561
  misc_feature 1..30: note = chr5:76327167-76327197
  misc_feature 1..30: note = hypo
  source 1..30: mol_type = genomic DNA

SEQ ID NO: 94272 - DNA, 26 bp, Homo sapiens
  misc_feature 1..26: note = chr5:76327430-76327456
  misc_feature 1..26: note = hypo
  source 1..26: mol_type = genomic DNA
aaccttggctggacgcggtagctcac

SEQ ID NO: 94273 - DNA, 25 bp, Homo sapiens
  misc_feature 1..25: note = chr5:76327696-76327721
  misc_feature 1..25: note = hypo
  source 1..25: mol_type = genomic DNA
ccagccagggcgacagagtgcaact

SEQ ID NO: 94274 - DNA, 30 bp, Homo sapiens
  misc_feature 1..30: note = chr5:76475962-76475992
  misc_feature 1..30: note = hyper
  source 1..30: mol_type = genomic DNA
aggctggacttccctcgaggggccaggaag

SEQ ID NO: 94275 - DNA, 556 bp, Homo sapiens
  misc_feature 1..556: note = chr5:76476235-76476791
  misc_feature 1..556: note = hyper
  source 1..556: mol_type = genomic DNA
cgggcaccaccagggcgcccaggagccgcccgccgccggcatggaccagctgtactgcccaccgagcgcgtgccaggtgagcccccagcgcgggggaccgcgcagccctcggccgccccctcacacctgggtacccggccgctggcacaagcccagagccggcttcagggccccctttcagacacccaggtgctagggtggctttttttcttttcttttcgcccttagtccctgcgtgtcctagtgccaactacctccttcctttccaggcgggaagcacctcgagcgtctagtgtaaccgtcaggtttattattcccaataataattgaccacagacagccgccgttcgcgtccacctggcgcttctcagcaggagctggacctgtttctccgtcgggccggctcctcgggctgctgttgcgcctggtgttttccacgcttccccggcgcgggacggtggggcccctgcattcctcctcgtgcttccagtggctgcaaagctgcctccccttctgagtagtgagtcgccggcagccccagcgtggggtgtgtaca

SEQ ID NO: 94276 - DNA, 614 bp, Homo sapiens
  misc_feature 1..614: note = chr5:76506145-76506759
  misc_feature 1..614: note = hyper
  source 1..614: mol_type = genomic DNA
gccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 94277 - DNA, 442 bp, Homo sapiens; identical to SEQ ID NO: 29697
  misc_feature 1..442: note = chr5:76506760-76507202
  misc_feature 1..442: note = hyper
  source 1..442: mol_type = genomic DNA

SEQ ID NO: 94278 - DNA, 30 bp, Homo sapiens
  misc_feature 1..30: note = chr5:76507421-76507451
  misc_feature 1..30: note = hyper
  source 1..30: mol_type = genomic DNA
accattgagagcattcggtggccagtcctg

SEQ ID NO: 94279 - DNA, 345 bp, Homo sapiens; identical to SEQ ID NO: 454
  misc_feature 1..345: note = chr5:76923679-76924024
  misc_feature 1..345: note = hyper
  source 1..345: mol_type = genomic DNA

SEQ ID NO: 94280 - DNA, 214 bp, Homo sapiens; identical to SEQ ID NO: 455
  misc_feature 1..214: note = chr5:76924086-76924300
  misc_feature 1..214: note = hyper
  source 1..214: mol_type = genomic DNA

SEQ ID NO: 94281 - DNA, 64 bp, Homo sapiens; identical to SEQ ID NO: 29700
  misc_feature 1..64: note = chr5:76924416-76924480
  misc_feature 1..64: note = hyper
  source 1..64: mol_type = genomic DNA

SEQ ID NO: 94282 - DNA, 167 bp, Homo sapiens; identical to SEQ ID NO: 29701
  misc_feature 1..167: note = chr5:76924754-76924921
  misc_feature 1..167: note = hyper
  source 1..167: mol_type = genomic DNA

SEQ ID NO: 94283 - DNA, 1402 bp, Homo sapiens
  misc_feature 1..1402: note = chr5:76925454-76926856
  misc_feature 1..1402: note = hyper
  source 1..1402: mol_type = genomic DNA
gtgacctaggtgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcggccgccgcccagcgggtgtcgttggcgtggaaagagcacaggctgtcgcccatggcggcggcagcggcggcggcagccgacgggaactgaggcaggcctggcgtgggcagcagtgtgccgggcgcacggaacacgttggtcgtctttttgcgcttcttccacttggcgcgtcggttctggaaccagacctggagcgggcggggcgggagacagacagggagctattagccggcccggcggctggggagttggggcttgagccccagaaacccgcctcggatacagccgctctgccctgggaggaacaagtgccgtaggcccgacaagcccccatacccagccggagactgtggctccccaccaactcctggcaactggcgccccctgcacccaccaagcgcggagtcctgcgctcctaagagctc

SEQ ID NO: 94284 - DNA, 783 bp, Homo sapiens
  misc_feature 1..783: note = chr5:76928157-76928940
  misc_feature 1..783: note = hyper
  source 1..783: mol_type = genomic DNA
aatctggtcatctggcgtttactgtgcctaaatataaatgatgtaggacaagcccaggtactgagtttcctcttagaatttggccaacgcaatttgaccacgatatccgtggaaaaaaacgttgtgcatccgttaatctaacctatttagtgtttactctgcaagctaaagtatcaggggtatggacatacctgccctcggtctcggtgagccagcaatgttcagcggtgtgttcatgcccaggcaagcgtagacgcactctacgcttaccagtgtgaacggtgttgcagtctagaatactcccccagcttggggccggccctcgcctttctaccgtgcctgcgccgtcgcctaccactttcttcctgtggtttctaccccattttgcagattgctgcgtatcccagtgtcggcgatggataaacaggtctcgtctcttcccagttgcagcccgtgagctggtggcacaacggattaatgaggcaacagggctctagatggtgagtgggatcaatgagacccaattgagctgttagcggtcttaggcggagagcatctctcaggaggaaaggaaggcacagcgagaagacctaaggccgaaagtcgctgtgcagcacccacccaaggctggactcgggggaggtagacgggacggtgtctgtgactaaacggttcccacaccttacacgccgcaccgggattatgttttgaaaggtgtcttataaaatcaagaccggttcctaacaacctgcaagtgccagtgaatcccgaaatgtttgtttg

SEQ ID NO: 94285 - DNA, 30 bp, Homo sapiens
  misc_feature 1..30: note = chr5:76929223-76929253
  misc_feature 1..30: note = hyper
  source 1..30: mol_type = genomic DNA
ctccgttccaagctacgatgcatatgtttt

SEQ ID NO: 94286 - DNA, 984 bp, Homo sapiens; identical to SEQ ID NO: 2591
  misc_feature 1..984: note = chr5:76932282-76933266
  misc_feature 1..984: note = hyper
  source 1..984: mol_type = genomic DNA

SEQ ID NO: 94287 - DNA, 55 bp, Homo sapiens; identical to SEQ ID NO: 29707
  misc_feature 1..55: note = chr5:76933464-76933519
  misc_feature 1..55: note = hyper
  source 1..55: mol_type = genomic DNA

SEQ ID NO: 94288 - DNA, 30 bp, Homo sapiens
  misc_feature 1..30: note = chr5:76933770-76933800
  misc_feature 1..30: note = hyper
  source 1..30: mol_type = genomic DNA
cacagccattggcaacgctgagtcccttgc

SEQ ID NO: 94289 - DNA, 614 bp, Homo sapiens; identical to SEQ ID NO: 29708
  misc_feature 1..614: note = chr5:76934040-76934654
  misc_feature 1..614: note = hyper
  source 1..614: mol_type = genomic DNA

SEQ ID NO: 94290 - DNA, 622 bp, Homo sapiens
  misc_feature 1..622: note = chr5:76934676-76935298
  misc_feature 1..622: note = hyper
  source 1..622: mol_type = genomic DNA
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcggccttcagacaacgcctggacttcgccgcggctcagtaggcctgcgcctagggtccaggcgccctggctgtgccctggggtctatacgagccccaaccccacagtgggcctagagcgcaaagaggagtcggcttccctggcaccgccagcgcccgctgtctgctttggggaccctcgcggagtgtgggttcgagcgctctgcactcttctcaccgggcttcttcccggctcctgctcttccgcttggcccacgcccgcatcctcgcccctaactcgct

SEQ ID NO: 94291 - DNA, 799 bp, Homo sapiens
  misc_feature 1..799: note = chr5:76936016-76936815
  misc_feature 1..799: note = hyper
  source 1..799: mol_type = genomic DNA
ggctgagagcagatgcgagaggaattgtgtgtgtgtgtgtgtgtgtgtgtgtgtgtgtgtgtgtcctcagctgtatgtgtgacagggaccgagcaaggagacaaaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagtggggggaaagtggctaaggaagagacagggagacctggctccagaaccctgctcccagaaataggcaggtccgccaggccgcacagcctggctc

SEQ ID NO: 94292 - DNA, 26 bp, Homo sapiens
  misc_feature 1..26: note = chr5:76937397-76937423
  misc_feature 1..26: note = hyper
  source 1..26: mol_type = genomic DNA
gctcccccctgctcccggttccctct

SEQ ID NO: 94293 - DNA, 30 bp, Homo sapiens
  misc_feature 1..30: note = chr5:76938430-76938460
  misc_feature 1..30: note = hyper
  source 1..30: mol_type = genomic DNA
attaaatgtaactttcggctgcttgagttg

SEQ ID NO: 94294 - DNA, 378 bp, Homo sapiens
  misc_feature 1..378: note = chr5:76939435-76939813
  misc_feature 1..378: note = hyper
  source 1..378: mol_type = genomic DNA
cggagccaaatgccaagcaacgttcaggatccacacttggggctttctttctgttttttaaacgccggtagcaggctgcgtgtgcatgacacgtgtacttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 94295 - DNA, 151 bp, Homo sapiens
  misc_feature 1..151: note = chr5:76940344-76940495
  misc_feature 1..151: note = hyper
  source 1..151: mol_type = genomic DNA
cgagccgcctgcgctcgcccactccccgctcgctccccgcccggctcctacgtcccaatccttttcttttcgggcgcaattagtgccaggtttgcaacagacgccgggactcggccgctccagcgactctacgcttcggggggtggggtgg

SEQ ID NO: 94296 - DNA, 641 bp, Homo sapiens; identical to SEQ ID NO: 29715
  misc_feature 1..641: note = chr5:76940857-76941498
  misc_feature 1..641: note = hyper
  source 1..641: mol_type = genomic DNA

SEQ ID NO: 94297 - DNA, 389 bp, Homo sapiens; identical to SEQ ID NO: 7912
  misc_feature 1..389: note = chr5:76941512-76941901
  misc_feature 1..389: note = hyper
  source 1..389: mol_type = genomic DNA

SEQ ID NO: 94298 - DNA, 23 bp, Homo sapiens
  misc_feature 1..23: note = chr5:77047288-77047311
  misc_feature 1..23: note = hypo
  source 1..23: mol_type = genomic DNA
caccgcgccggccagcctgacca

SEQ ID NO: 94299 - DNA, 244 bp, Homo sapiens
  misc_feature 1..244: note = chr5:77140527-77140771
  misc_feature 1..244: note = hyper
  source 1..244: mol_type = genomic DNA
gctgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccctattctccttattgttatttccactcaccccccaaccccctcccgccgtcctggttccaga

SEQ ID NO: 94300 - DNA, 134 bp, Homo sapiens
  misc_feature 1..134: note = chr5:77147516-77147650
  misc_feature 1..134: note = hyper
  source 1..134: mol_type = genomic DNA
cggcgtgcatgtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgtt

SEQ ID NO: 94301 - DNA, 260 bp, Homo sapiens; identical to SEQ ID NO: 461
  misc_feature 1..260: note = chr5:77147872-77148132
  misc_feature 1..260: note = hyper
  source 1..260: mol_type = genomic DNA

SEQ ID NO: 94302 - DNA, 283 bp, Homo sapiens
  misc_feature 1..283: note = chr5:77148386-77148669
  misc_feature 1..283: note = hyper
  source 1..283: mol_type = genomic DNA
tccctgaggagctgacgctgaacgcctgaatgggcagcgcgccaacttcgctgctccaggaggggggtggggagggagaggaggaggaggaggatgaggagagaggggaggtggaaggctgtggtaacggtgggcggaggcgggaccatggcgcatgctccgcgacgtcccgggccgcgggcggaatcccccggctaacctccttgggggtgagactgggtgggatgggggtcggtgggggaagttgcatggggtgttatacccgcccggttacaggccgctg

SEQ ID NO: 94303 - DNA, 32 bp, Homo sapiens
  misc_feature 1..32: note = chr5:77253986-77254018
  misc_feature 1..32: note = hyper
  source 1..32: mol_type = genomic DNA
cggcgctggtgcccacccggcctccccgtggc

SEQ ID NO: 94304 - DNA, 367 bp, Homo sapiens; identical to SEQ ID NO: 463
  misc_feature 1..367: note = chr5:77268367-77268734
  misc_feature 1..367: note = hyper
  source 1..367: mol_type = genomic DNA

SEQ ID NO: 94305 - DNA, 503 bp, Homo sapiens; identical to SEQ ID NO: 29722
  misc_feature 1..503: note = chr5:77268735-77269238
  misc_feature 1..503: note = hyper
  source 1..503: mol_type = genomic DNA

SEQ ID NO: 94306 - DNA, 184 bp, Homo sapiens
  misc_feature 1..184: note = chr5:77269263-77269447
  misc_feature 1..184: note = hyper
  source 1..184: mol_type = genomic DNA
cgccagcaccaggggcgggctggagggggaccggcgatcagggaaaccttactcctcgcaggcttcaacctgctggggcgtgtttacgtccgcaaagtccgataatatattttgtccccacttcttaggagctgattcttcttaaaatgcattgccacgttatctctaacgttggctttctgac

SEQ ID NO: 94307 - DNA, 30 bp, Homo sapiens
  misc_feature 1..30: note = chr5:7763815-7763845
  misc_feature 1..30: note = hypo
  source 1..30: mol_type = genomic DNA
ctggcatcgtgccctcgggtgttccttttc

SEQ ID NO: 94308 - DNA, 90 bp, Homo sapiens
  misc_feature 1..90: note = chr5:77655493-77655583
  misc_feature 1..90: note = hypo
  source 1..90: mol_type = genomic DNA
taagccaccgcgcccggccggtacaaattaatttaacacatcttttgataatctcatccttggtgttggaaaagacgggaaaatccaaaa

SEQ ID NO: 94309 - DNA, 19 bp, Homo sapiens
  misc_feature 1..19: note = chr5:77806301-77806320
  misc_feature 1..19: note = hyper
  source 1..19: mol_type = genomic DNA
ggcccgtgcccgcagaacc

SEQ ID NO: 94310 - DNA, 30 bp, Homo sapiens
  misc_feature 1..30: note = chr5:77943372-77943402
  misc_feature 1..30: note = hyper
  source 1..30: mol_type = genomic DNA
acgtaggtcacccaccgatggtaacctaca

SEQ ID NO: 94311 - DNA, 106 bp, Homo sapiens
  misc_feature 1..106: note = chr5:78105439-78105545
  misc_feature 1..106: note = hypo
  source 1..106: mol_type = genomic DNA
ggtcaggctgagggccgccagagcctgcggccaggcctaacactaggcagagacgactctgcagctgtctgctcacactcactgccagtcacgcttcactccactt

SEQ ID NO: 94312 - DNA, 368 bp, Homo sapiens
  misc_feature 1..368: note = chr5:78407583-78407951
  misc_feature 1..368: note = hyper
  source 1..368: mol_type = genomic DNA
ccccacgcccaactgcgggtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaaggtgagtctccaggggacccgagggcgctctccttcccctcccacctgctctgtatcccagcctctgggagcgcagaggggccctcggaccctgcctggtacccatcatcctcctactccctcccctccctcagcctcagaccagaatgtgcttccagaacttctccagcaggaccccaaggcgcctctgagcctccccactcctgcccca

SEQ ID NO: 94313 - DNA, 259 bp, Homo sapiens
  misc_feature 1..259: note = chr5:78408016-78408275
  misc_feature 1..259: note = hyper
  source 1..259: mol_type = genomic DNA
cgccccagatctatgtgatccttgcctctcagacccaaaggcaccctctgagccctccctgacggctgggtgtccccagaactccgagccttccaatatcttctgaatctggcaccccaagaccagaaaactccctagagatactgctcctagccccgcaggcgcgatatcccgtccccacggagcccctccgcatctgtgtccgaggccgccgcgagcgccctctgcacccggcgcgcccagaacagggaggagtgca

SEQ ID NO: 94314 - DNA, 164 bp, Homo sapiens
  misc_feature 1..164: note = chr5:78408297-78408461
  misc_feature 1..164: note = hyper
  source 1..164: mol_type = genomic DNA
cgcctggatctgcaccgcgggtgtcggggccgcctccccgccgggttctcgctgcacccaaggcccaggcgctggttgggtgattgcagattttcacaggcaatttgatgtccgtgatgacagaaaaatgtcatccgaaatgtcagcctcgaaaacatggttta

SEQ ID NO: 94315 - DNA, 20 bp, Homo sapiens
  misc_feature 1..20: note = chr5:78469259-78469279
  misc_feature 1..20: note = hypo
  source 1..20: mol_type = genomic DNA
agtatttttctatttcgaaa

SEQ ID NO: 94316 - DNA, 156 bp, Homo sapiens
  misc_feature 1..156: note = chr5:7850282-7850438
  misc_feature 1..156: note = hyper
  source 1..156: mol_type = genomic DNA
gctgacactggtagtcgcctgagctgtactctttggggcccaggcgccttggcgggagctcaccctccctgtctccccagctgaccctgccgcgcccccttcatctccgcacgctcccacccggccccctccacaggctgtccagccccgcccctc

SEQ ID NO: 94317 - DNA, 179 bp, Homo sapiens
  misc_feature 1..179: note = chr5:7850439-7850618
  misc_feature 1..179: note = hyper
  source 1..179: mol_type = genomic DNA
gaacccacccctggtagtgaagccctgcccccagggtccctgcccgaaggtgcgctcctcctctagggcccctctactctgtgagctctgtccccgatccctagcggtgcagcccctcccagggcccctcctcgttgtgagctcctctctccagtccccggcggcgcatccctgccccc

SEQ ID NO: 94318 - DNA, 377 bp, Homo sapiens; identical to SEQ ID NO: 29462
  misc_feature 1..377: note = chr5:7850922-7851299
  misc_feature 1..377: note = hyper
  source 1..377: mol_type = genomic DNA

SEQ ID NO: 94319 - DNA, 30 bp, Homo sapiens
  misc_feature 1..30: note = chr5:78533526-78533556
  misc_feature 1..30: note = hyper
  source 1..30: mol_type = genomic DNA
ctgggctctactggtcgcttttggtttact

SEQ ID NO: 94320 - DNA, 115 bp, Homo sapiens; identical to SEQ ID NO: 40564
  misc_feature 1..115: note = chr5:78552615-78552730
  misc_feature 1..115: note = hypo
  source 1..115: mol_type = genomic DNA

SEQ ID NO: 94321 - DNA, 35 bp, Homo sapiens; identical to SEQ ID NO: 40565
  misc_feature 1..35: note = chr5:78881941-78881976
  misc_feature 1..35: note = hypo
  source 1..35: mol_type = genomic DNA

SEQ ID NO: 94322 - DNA, 165 bp, Homo sapiens
  misc_feature 1..165: note = chr5:78985096-78985261
  misc_feature 1..165: note = hypo
  source 1..165: mol_type = genomic DNA
cttttgagcagggcacgcctagctttgtttctcattgggtcattttactagcaatgacagcctgagctgctggagctcttcggagtctcagtttcctcatctgggaaaccagcactacagtaaaaccttctacaggtaccaccacagaatcgaggtaatgaaagc

SEQ ID NO: 94323 - DNA, 16 bp, Homo sapiens
  misc_feature 1..16: note = chr5:79330913-79330929
  misc_feature 1..16: note = hyper
  source 1..16: mol_type = genomic DNA
ctttctctccagcccc

SEQ ID NO: 94324 - DNA, 205 bp, Homo sapiens; identical to SEQ ID NO: 29728
  misc_feature 1..205: note = chr5:79330930-79331135
  misc_feature 1..205: note = hyper
  source 1..205: mol_type = genomic DNA

SEQ ID NO: 94325 - DNA, 108 bp, Homo sapiens; identical to SEQ ID NO: 7923
  misc_feature 1..108: note = chr5:79331229-79331337
  misc_feature 1..108: note = hyper
  source 1..108: mol_type = genomic DNA

SEQ ID NO: 94326 - skipped

SEQ ID NO: 94327 - DNA, 209 bp, Homo sapiens
  misc_feature 1..209: note = chr5:7954008-7954217
  misc_feature 1..209: note = hypo
  source 1..209: mol_type = genomic DNA
attctagaaaataaacgcatgagctgcaggaaaacaatgaacaaatattttaaaattaaaagggtatgtcagaagtttcgatgaattgtatagaatacaaaagcagaataactttctgtgggaaagtttaatagaatgcttcggggatttatcatgctctgattttttgccttactgagagaattgcagccattcgaataaaattcctt

SEQ ID NO: 94328 - DNA, 30 bp, Homo sapiens
  misc_feature 1..30: note = chr5:79550635-79550665
  misc_feature 1..30: note = hyper
  source 1..30: mol_type = genomic DNA
accaagacagctccacgtggccactctaaa

SEQ ID NO: 94329 - DNA, 34 bp, Homo sapiens
  misc_feature 1..34: note = chr5:79554316-79554350
  misc_feature 1..34: note = hypo
  source 1..34: mol_type = genomic DNA
acaggtgtgagccaccgcgcgcagccacaaggca

SEQ ID NO: 94330 - DNA, 16 bp, Homo sapiens
  misc_feature 1..16: note = chr5:79783240-79783256
  misc_feature 1..16: note = hypo
  source 1..16: mol_type = genomic DNA
acagtctagctctatc

SEQ ID NO: 94331 - DNA, 30 bp, Homo sapiens
  misc_feature 1..30: note = chr5:79784399-79784429
  misc_feature 1..30: note = hyper
  source 1..30: mol_type = genomic DNA
agctggcagagtgtgcggctcgcttgattc

SEQ ID NO: 94332 - DNA, 618 bp, Homo sapiens
  misc_feature 1..618: note = chr5:79864827-79865445
  misc_feature 1..618: note = hyper
  source 1..618: mol_type = genomic DNA
tgaggatgctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 94333 - DNA, 140 bp, Homo sapiens; identical to SEQ ID NO: 29732
  misc_feature 1..140: note = chr5:79865522-79865662
  misc_feature 1..140: note = hyper
  source 1..140: mol_type = genomic DNA

SEQ ID NO: 94334 - DNA, 411 bp, Homo sapiens
  misc_feature 1..411: note = chr5:79866099-79866510
  misc_feature 1..411: note = hyper
  source 1..411: mol_type = genomic DNA
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcctccagtccgtatccctcccctcagctcacatccacccgctggttcatgggt

SEQ ID NO: 94335 - DNA, 169 bp, Homo sapiens
  misc_feature 1..169: note = chr5:79911156-79911325
  misc_feature 1..169: note = hypo
  source 1..169: mol_type = genomic DNA
ggaagacagcagccacgcctgcatatgggcttctgcactgctagcctcaaggctgccagagtgcaaagaatgccaggataatggctttatccacgtgtggccttttgacacataagctaatgactatattccaggtacaaatagttctttcccacgagctgtttctgca

SEQ ID NO: 94336 - DNA, 302 bp, Homo sapiens
  misc_feature 1..302: note = chr5:79947482-79947784
  misc_feature 1..302: note = hypo
  source 1..302: mol_type = genomic DNA
ttgtgtgttcagatgcgttaaagccactttcgtagtttattttgtatcaactggagttttttacaactcaggtgaattttagctttattgaggggaattgatctaaaacactctttacgccggtttctattgacttgggttaatcgtgtgaccgcggtggctggcacgaacttgacgaaccctagggttagtatagcttagttaaactttcgtttattgctaaaggtttatcactgctgtctcccgtgggggtgtggctaggctaagcgttttgagctgcgttgctgcgtgcttgatacttg

SEQ ID NO: 94337 - DNA, 324 bp, Homo sapiens
  misc_feature 1..324: note = chr5:80255751-80256075
  misc_feature 1..324: note = hyper
  source 1..324: mol_type = genomic DNA
tgtcatgagtgtgtgcgcgtgtgtttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgc

SEQ ID NO: 94338 - DNA, 58 bp, Homo sapiens; identical to SEQ ID NO: 7929
  misc_feature 1..58: note = chr5:80256312-80256370
  misc_feature 1..58: note = hyper
  source 1..58: mol_type = genomic DNA

SEQ ID NO: 94339 - DNA, 138 bp, Homo sapiens; identical to SEQ ID NO: 29736
  misc_feature 1..138: note = chr5:80256428-80256566
  misc_feature 1..138: note = hyper
  source 1..138: mol_type = genomic DNA

SEQ ID NO: 94340 - DNA, 18 bp, Homo sapiens
  misc_feature 1..18: note = chr5:80256790-80256808
  misc_feature 1..18: note = hyper
  source 1..18: mol_type = genomic DNA
gccacccagggccggcgc

SEQ ID NO: 94341 - DNA, 110 bp, Homo sapiens
  misc_feature 1..110: note = chr5:80256887-80256997
  misc_feature 1..110: note = hyper
  source 1..110: mol_type = genomic DNA
cgcactcccttgccgtcctaatccggggatcaggggtcgggggtcgtgaaagagtgcggggactatgctccgaaatccccccgcgtcaccagtggcgggacatctccacg

SEQ ID NO: 94342 - DNA, 203 bp, Homo sapiens
  misc_feature 1..203: note = chr5:80689592-80689795
  misc_feature 1..203: note = hyper
  source 1..203: mol_type = genomic DNA
ggaatgaaggagtcccgagagccacacatttgggaaccaccggtctcggccatgcccagcgcgggcgcactgttgcaacacccctatccctggctgcgcagggttcagctctccgcaagtaccttcctcgccttcctaccccccccagcccccagccgccgccgctcccgcagccccggtcccgcgcctccccgcagccccgg

SEQ ID NO: 94343 - DNA, 304 bp, Homo sapiens
  misc_feature 1..304: note = chr5:80689879-80690183
  misc_feature 1..304: note = hyper
  source 1..304: mol_type = genomic DNA
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcc

SEQ ID NO: 94344 - DNA, 26 bp, Homo sapiens
  misc_feature 1..26: note = chr5:80887672-80887698
  misc_feature 1..26: note = hypo
  source 1..26: mol_type = genomic DNA
aggagccaagatggccgaataggaac

SEQ ID NO: 94345 - DNA, 143 bp, Homo sapiens
  misc_feature 1..143: note = chr5:80895313-80895456
  misc_feature 1..143: note = hypo
  source 1..143: mol_type = genomic DNA
acagtagtcacagtccgctgatcctagagagaaagagggagaaactgattgagattgattttccttggtaaagtctgagggtctcaggctcaggaaaggattttaccaaggacacgtgcctttgcacacgctgttccctctgt

SEQ ID NO: 94346 - DNA, 89 bp, Homo sapiens
  misc_feature 1..89: note = chr5:81075041-81075130
  misc_feature 1..89: note = hyper
  source 1..89: mol_type = genomic DNA
cacagcacagacagccgccgtgccagcttccctgttttgcactgccaaaacagctccctcctgacctgcagctccgcagaattccaaac

SEQ ID NO: 94347 - DNA, 103 bp, Homo sapiens
  misc_feature 1..103: note = chr5:81266149-81266252
  misc_feature 1..103: note = hypo
  source 1..103: mol_type = genomic DNA
tgtgagtagatttttcggtgaacctcagcgatcagagaggagagctacaggagccctgcttgaaccttgaaatgctatgatgacagaccgtagccttaaagca

SEQ ID NO: 94348 - DNA, 38 bp, Homo sapiens
  misc_feature 1..38: note = chr5:81266652-81266690
  misc_feature 1..38: note = hypo
  source 1..38: mol_type = genomic DNA
ttcttgttttcatctgtgaaatacgtttttaaggtaaa

SEQ ID NO: 94349 - DNA, 21 bp, Homo sapiens
  misc_feature 1..21: note = chr5:81575044-81575065
  misc_feature 1..21: note = hypo
  source 1..21: mol_type = genomic DNA
ccaccgcgcctggccatttaa

SEQ ID NO: 94350 - DNA, 30 bp, Homo sapiens
  misc_feature 1..30: note = chr5:8208408-8208438
  misc_feature 1..30: note = hypo
  source 1..30: mol_type = genomic DNA
tcggtatatgtgttacgtgtatgtgtttgt

SEQ ID NO: 94351 - DNA, 784 bp, Homo sapiens
  misc_feature 1..784: note = chr5:82767026-82767810
  misc_feature 1..784: note = hyper
  source 1..784: mol_type = genomic DNA
ggcaagctctgtgggcgcgtaaacacgctgtaaccaagttctttgctgattttacagttttgtgtgctcccgagaagaagtgatcgtactcaattgtctattgctggcctgccccctaagagcctgggggctcctttcccctaacccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattt

SEQ ID NO: 94352 - DNA, 1152 bp, Homo sapiens; identical to SEQ ID NO: 29742
  misc_feature 1..1152: note = chr5:82768217-82769369
  misc_feature 1..1152: note = hyper
  source 1..1152: mol_type = genomic DNA

SEQ ID NO: 94353 - DNA, 408 bp, Homo sapiens
  misc_feature 1..408: note = chr5:82769910-82770318
  misc_feature 1..408: note = hyper
  source 1..408: mol_type = genomic DNA
accacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctg

SEQ ID NO: 94354 - DNA, 49 bp, Homo sapiens
  misc_feature 1..49: note = chr5:82770563-82770612
  misc_feature 1..49: note = hyper
  source 1..49: mol_type = genomic DNA
agagccgagtggcctcgcccccaggattcggggccggctgcttctggag

SEQ ID NO: 94355 - DNA, 172 bp, Homo sapiens
  misc_feature 1..172: note = chr5:83017828-83018000
  misc_feature 1..172: note = hyper
  source 1..172: mol_type = genomic DNA
ggctgttggagcagccgggaggagggagcggggctggccctgggactgaggacaagcaaacaagctcgaggggcccgcggccagggtggaggcgagacgcaggccgtccccgagttgcagcgagcagggcccggtgtcgcggagcgctggggacgtgcggggattcgcggcc

SEQ ID NO: 94356 - DNA, 30 bp, Homo sapiens
  misc_feature 1..30: note = chr5:83527381-83527411
  misc_feature 1..30: note = hypo
  source 1..30: mol_type = genomic DNA
ttaaggttacatctgcgcagagtacacatt

SEQ ID NO: 94357 - DNA, 94 bp, Homo sapiens
  misc_feature 1..94: note = chr5:83678217-83678311
  misc_feature 1..94: note = hyper
  source 1..94: mol_type = genomic DNA
acccagccaggcaagcgcggccacataggcaagcgcggccacataggctagacgcactatcttctcctctaccccgcgccgccctccacctcgg

SEQ ID NO: 94358 - DNA, 265 bp, Homo sapiens
  misc_feature 1..265: note = chr5:83678989-83679254
  misc_feature 1..265: note = hyper
  source 1..265: mol_type = genomic DNA
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactccagcaggacactcgtcgaagtcctgcgttt

SEQ ID NO: 94359 - DNA, 74 bp, Homo sapiens
  misc_feature 1..74: note = chr5:83679569-83679643
  misc_feature 1..74: note = hyper
  source 1..74: mol_type = genomic DNA
cctctccacctcacccgcggccaaaacgcccagcgccgggtctgggtttgcgaacggctcagcccaggccctgc

SEQ ID NO: 94360 - DNA, 725 bp, Homo sapiens; identical to SEQ ID NO: 29747
  misc_feature 1..725: note = chr5:83679644-83680369
  misc_feature 1..725: note = hyper
  source 1..725: mol_type = genomic DNA

SEQ ID NO: 94361 - DNA, 58 bp, Homo sapiens
  misc_feature 1..58: note = chr5:83680693-83680751
  misc_feature 1..58: note = hyper
  source 1..58: mol_type = genomic DNA
cgtgtgagtctgagcctggcaggcgcgctccccactcccccggcgcccgcccgccctc

SEQ ID NO: 94362 - DNA, 30 bp, Homo sapiens
  misc_feature 1..30: note = chr5:84126401-84126431
  misc_feature 1..30: note = hypo
  source 1..30: mol_type = genomic DNA
gctgtgctggcctgccgcttgagccaacgc

SEQ ID NO: 94363 - DNA, 206 bp, Homo sapiens
  misc_feature 1..206: note = chr5:851688-851894
  misc_feature 1..206: note = hypo
  source 1..206: mol_type = genomic DNA
tagttaacaattcttcgttcttgcagtcgtgaacgtccatgatacagtggctctgcgctgcctttggtggctcctccctggtcctctaaatgtgacaccaggcggatgcggggccacaggaccctggggcttgagtcacacaagaatgtctctgggagacccgagagactcacagttatgaaacaggaccatggttctttggccgg

SEQ ID NO: 94364 - DNA, 32 bp, Homo sapiens
  misc_feature 1..32: note = chr5:86308932-86308964
  misc_feature 1..32: note = hypo
  source 1..32: mol_type = genomic DNA
gcgtgagccaccgcgcccggcctagtattcat

SEQ ID NO: 94365 - DNA, 30 bp, Homo sapiens
  misc_feature 1..30: note = chr5:86795866-86795896
  misc_feature 1..30: note = hypo
  source 1..30: mol_type = genomic DNA
catggggttgagggccgtgggcagagtaaa

SEQ ID NO: 94366 - DNA, 225 bp, Homo sapiens
  misc_feature 1..225: note = chr5:86837505-86837730
  misc_feature 1..225: note = hypo
  source 1..225: mol_type = genomic DNA
gtgtgaactggcatacgatgtaattttgaagaatagtataatgaaggtatgttgaattggcgagatgcaagtccagcagtatattataacatcgtcattttacttcagattctggtttcatatacacttccgcctttggtaatttacataaacatgcatagtctatgaataatgcataaaccttattttaaatgcagagctttcaactctcgcagtgcactagta

SEQ ID NO: 94367 - DNA, 175 bp, Homo sapiens
  misc_feature 1..175: note = chr5:87436594-87436769
  misc_feature 1..175: note = hyper
  source 1..175: mol_type = genomic DNA
cttagtcggcttacccgtcctgttccaggagccgacagggaacagcccacctggagcaggtcttgggccaccactcgccccgccccccgtctctactcctcactcgctctccccgctcctattaagcagccaacgctgggtgatctcctctccagttcttcgtggtttcattgta

SEQ ID NO: 94368 - DNA, 30 bp, Homo sapiens; identical to SEQ ID NO: 29749
  misc_feature 1..30: note = chr5:87955350-87955380
  misc_feature 1..30: note = hyper
  source 1..30: mol_type = genomic DNA

SEQ ID NO: 94369 - DNA, 63 bp, Homo sapiens; identical to SEQ ID NO: 466
  misc_feature 1..63: note = chr5:87955602-87955665
  misc_feature 1..63: note = hyper
  source 1..63: mol_type = genomic DNA

SEQ ID NO: 94370 - DNA, 101 bp, Homo sapiens; identical to SEQ ID NO: 29751
  misc_feature 1..101: note = chr5:87955839-87955940
  misc_feature 1..101: note = hyper
  source 1..101: mol_type = genomic DNA

SEQ ID NO: 94371 - DNA, 505 bp, Homo sapiens; identical to SEQ ID NO: 29752
  misc_feature 1..505: note = chr5:87956158-87956663
  misc_feature 1..505: note = hyper
  source 1..505: mol_type = genomic DNA

SEQ ID NO: 94372 - DNA, 521 bp, Homo sapiens; identical to SEQ ID NO: 29753
  misc_feature 1..521: note = chr5:87956679-87957200
  misc_feature 1..521: note = hyper
  source 1..521: mol_type = genomic DNA

SEQ ID NO: 94373 - DNA, 287 bp, Homo sapiens
  misc_feature 1..287: note = chr5:87961738-87962025
  misc_feature 1..287: note = hyper
  source 1..287: mol_type = genomic DNA
acatctcctgcattccgtttagcggaatcaattaggcaagacagaccctcagattccccaccccctttccatttttgtcaggtctatatacgtcctaattatttcagtttgggatgccagagctgtttcctggatagacctgatcatccttaaacaaaaagagaggaggcgcacacgtgggttgtggcgtaaatgtcactttcatttccaatgctaggcgcagagtaagacagaacatttttttaacactttgacaagaggggaggcgatctcgtctccatcatgtc

SEQ ID NO: 94374 - DNA, 302 bp, Homo sapiens
  misc_feature 1..302: note = chr5:87962615-87962917
  misc_feature 1..302: note = hyper
  source 1..302: mol_type = genomic DNA
gtttttactgtctctcggctgtagtctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctccttttatgtaaatatgacctggtttctgtttgtgtgtgtgcgcggctaaaacatcca

SEQ ID NO: 94375 - DNA, 55 bp, Homo sapiens; identical to SEQ ID NO: 29755
  misc_feature 1..55: note = chr5:87963456-87963511
  misc_feature 1..55: note = hyper
  source 1..55: mol_type = genomic DNA

SEQ ID NO: 94376 - DNA, 446 bp, Homo sapiens
  misc_feature 1..446: note = chr5:87967773-87968219
  misc_feature 1..446: note = hyper
  source 1..446: mol_type = genomic DNA
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataactaaccatgatggttgcatcttgatgaatctgaacttgggataaccctgtaaagcggcctctcacctcc

SEQ ID NO: 94377 - DNA, 198 bp, Homo sapiens
  misc_feature 1..198: note = chr5:87968488-87968686
  misc_feature 1..198: note = hyper
  source 1..198: mol_type = genomic DNA
ttcccttttccaacgcgaagatttcctggcatctctctgcgattgggggtcaagccgctggataattaacagtactggctaagaaaactcacgagatcaacaggtttaacatccgaggcacacaatcaattagctgaagcaaagccccggactggccctcggagcggcccgcagcgggactctgcgggcaccggctag

SEQ ID NO: 94378 - DNA, 219 bp, Homo sapiens
  misc_feature 1..219: note = chr5:87968772-87968991
  misc_feature 1..219: note = hyper
  source 1..219: mol_type = genomic DNA
cgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaaaaaaaaaaatgtttttctcatcattcctctcccctgctcaacacatttaaaactgccgctcaattccacat

SEQ ID NO: 94379 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 94380 - DNA, 803 bp, Homo sapiens; identical to SEQ ID NO: 29760
  misc_feature 1..803: note = chr5:87970115-87970918
  misc_feature 1..803: note = hyper
  source 1..803: mol_type = genomic DNA

SEQ ID NO: 94381 - DNA, 624 bp, Homo sapiens
  misc_feature 1..624: note = chr5:87971517-87972141
  misc_feature 1..624: note = hyper
  source 1..624: mol_type = genomic DNA
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacatacatcaaggaaattagggcattaaaaaaatatgcaaatcctgcgcgaagaggagcgggtgcattcctggcgcgatcgccttttattgaagcttttaattaaaggggccagttggcgagcccctgaaacaaccgccaaaaccccccaaaagagaaaaataaacgctgtagccttcgagaacggttgtttcggctcctgttctgtgggcggctgaggaccgccggctgcccggctcggagaagaacaggttagaggaggcagctccagcccatgcataatcagggctccgcggcgcctccattctttc

SEQ ID NO: 94382 - DNA, 30 bp, Homo sapiens
  misc_feature 1..30: note = chr5:87973581-87973611
  misc_feature 1..30: note = hyper
  source 1..30: mol_type = genomic DNA
ggtcagatggctacacgtatgacattaaaa

SEQ ID NO: 94383 - DNA, 1076 bp, Homo sapiens
  misc_feature 1..1076: note = chr5:87973988-87975064
  misc_feature 1..1076: note = hyper
  source 1..1076: mol_type = genomic DNA
atgcgtgtgtatgtgcgcgcgcgcgctatgtgacaaggaacacagagaggtacacctcttatctctgatctctctgtaatctccttttctgtttctaatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagcgacagacaactccccaaagtgccctgcgcgcggtggagagagggtctgctgagggtactgggtctcccacttgctacttttatattaacttgacatagaatcagacaataaatgagaggagagagaagagaagaggaaagaagagacagaaaaagggagaggcgctgtaaaggggagagagaaaacagaagcgagaatgggagagaaaaaggagaaagagaacccaaagggttgagttaaagagagagtaaaatggggaccgggtggggaaacggtgggagggggagaaatacccaaatatctgaatttggacttctcaagctaaaaataccacctcactgaacttcacaacctccaatgagacacgtgtttctcccctcaccaccacgtcaccgaatgattaatttgccgtctcaatcagaaataattatttagaattgtataacagatataggacttagcagaaagaagctcattttatgaaacatagcgaaaaatatatgacatttaaagatgatgttggctacctcacggtaaaaattaagg

SEQ ID NO: 94384 - DNA, 461 bp, Homo sapiens
  misc_feature 1..461: note = chr5:87976202-87976663
  misc_feature 1..461: note = hyper
  source 1..461: mol_type = genomic DNA
tctcctttctctccccgaaggtacttccttaggccggcagtgtcgctacggtggtagccaggtgagcacgggcacagtcccggggcgggggcgggtagagcggccctctctcgggagctccggtgggtctgcgaacctgccgggagcggaaggctgagtggcgctgggggcccgcgcggggctcctggctcccgccggcaggggaacagcgacacctactggccgcatgggtaccgcgcccgggccgtcagggctgccctgggacggggtgccgggctccgtggacttgggaggccgcgggaaacttcaccgaaggctctgcggactgctctaggactcgtccgccctggagaagacaaagccacgctttctggagacccctgggaggactgtaggatggaactgaacacacaggcacacacgcatgcccattttttctggggaaccggataaaccctcag

SEQ ID NO: 94385 - DNA, 87 bp, Homo sapiens
  misc_feature 1..87: note = chr5:87979692-87979779
  misc_feature 1..87: note = hyper
  source 1..87: mol_type = genomic DNA
gtaacaaggaggacacgtacacagcctttacacacttaaaagcccttgcgactccctctgaattcttagttacttatgacggccttc

SEQ ID NO: 94386 - DNA, 86 bp, Homo sapiens
  misc_feature 1..86: note = chr5:87979899-87979985
  misc_feature 1..86: note = hyper
  source 1..86: mol_type = genomic DNA
cttattggtaggtcatcagcagctgatcagacatggtaatccaataatttttttgaatacacacaatttttcgttgaagttaattt

SEQ ID NO: 94387 - DNA, 164 bp, Homo sapiens
  misc_feature 1..164: note = chr5:87980397-87980561
  misc_feature 1..164: note = hyper
  source 1..164: mol_type = genomic DNA
agggtgcccatctctcggctatgggcgggggctggaccctgacaggtacggactccgcgggaccccagtgtgcttacctcgagcgaggccctggcaaatggtggcccagaagcatcaagtttcctctcccagccgttgtgccagatttcccctcctgccttctg

SEQ ID NO: 94388 - DNA, 704 bp, Homo sapiens
  misc_feature 1..704: note = chr5:87980621-87981325
  misc_feature 1..704: note = hyper
  source 1..704: mol_type = genomic DNA
tcacacacgaggattacttgtgacttttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagctcacggctggccaaggcggggccgtacaaaagctagcgccgcgggacccccttcatgggcttctaccctagcagaccgagcgctggaggccgctccacgcgcgagctcgaaccacggagggctctcagctcggacaagcgtcgctgtctaagagctccaagctccacggaactttgattttatgcccgggagcccggtcatccacttctgcatctcagacaagcgccggaggctcgtgcagcttcctcgcgtcctcttcctggacgcggggcgcccaccttagtcatagcccctggtcccggcactgctcacgccgtcggtttccccactgcccaggctccctcagcccgaaccctgcgtctctgttcacat

SEQ ID NO: 94389 - DNA, 30 bp, Homo sapiens; identical to SEQ ID NO: 29769
  misc_feature 1..30: note = chr5:87983365-87983395
  misc_feature 1..30: note = hyper
  source 1..30: mol_type = genomic DNA

SEQ ID NO: 94390 - DNA, 30 bp, Homo sapiens; identical to SEQ ID NO: 29770
  misc_feature 1..30: note = chr5:87984984-87985014
  misc_feature 1..30: note = hyper
  source 1..30: mol_type = genomic DNA

SEQ ID NO: 94391 - DNA, 293 bp, Homo sapiens
  misc_feature 1..293: note = chr5:87985348-87985641
  misc_feature 1..293: note = hyper
  source 1..293: mol_type = genomic DNA
aataatttgggactgcgataaaaaaaaaatagccgcagtttcgaagtcccagagctttatcaggaagcattggacgcccctttctcctccagactggggcgggcttccagggatgccccctccgaccccgtcaccagcggaggactcatctgccgcggggctgccggaagctctcactcccgccagccccctgggtgctattgatgcggaccttggaggtgcctgcggcgtggcctaacacgtggacgcggcccataacccgccccggctgctgctttcgcctgaaggcggac

SEQ ID NO: 94392 - DNA, 157 bp, Homo sapiens
  misc_feature 1..157: note = chr5:87985895-87986052
  misc_feature 1..157: note = hyper
  source 1..157: mol_type = genomic DNA
taaggcaaaagaccccgagccttgtaaacccttttgtcagaacgcgaattaatgtttccaagattttttctcaaaagaattaagagctctagaggcgcctcttccactcactagggcaccatgtcaaagggactcgtcatggcgatttacaaatatc

SEQ ID NO: 94393 - DNA, 83 bp, Homo sapiens
  misc_feature 1..83: note = chr5:87986310-87986393
  misc_feature 1..83: note = hyper
  source 1..83: mol_type = genomic DNA
cacccccctagctcccgcgttaaaatcaccagagtcaattcccggcgtcggtctccacagtcaacccccgccccttccccatt

SEQ ID NO: 94394 - DNA, 30 bp, Homo sapiens
  misc_feature 1..30: note = chr5:87987135-87987165
  misc_feature 1..30: note = hyper
  source 1..30: mol_type = genomic DNA
tatctgaaatctaaacgcaatttaagcgcg

SEQ ID NO: 94395 - DNA, 499 bp, Homo sapiens
  misc_feature 1..499: note = chr5:87988152-87988651
  misc_feature 1..499: note = hyper
  source 1..499: mol_type = genomic DNA
actgtgagcacagcccgcttggggttggtttcacatcgctcaggactggggttccacgcctggagcgcagttaccttgttgcgcccgcatgtgcctcgggaagtgcatctgcgaccctaggtcggggaccaccgcgttagtgagggacagccgagtcggggggcagtctcccctggtggacagtatgaagtttggacagcaggggaaggaagagaggaactggaggttgggggaggctagagagcaacgtttgctctctgaacttttccttctcccctttgcgccttctgaaatggcctgggagttagcagaggtcgggaagctgctgtaagagcgaaacgttgccccacttggcggtgtccaggtctcgcagtaggctcgggtcacaggagggagggggtaggggttcagctccgccgaaagagttagctaccgtcccctcctttctcggccggagacgttaagagttcccggtgaatgacaccgtccagggtcagaa

SEQ ID NO: 94396 - DNA, 144 bp, Homo sapiens
  misc_feature 1..144: note = chr5:87990308-87990452
  misc_feature 1..144: note = hyper
  source 1..144: mol_type = genomic DNA
atataaaaaagaacccgaaaagcctcgcgttttttctcttgtgttttcctcacttttctttttctcaaactgcaaaattttagtgcctgaatggcgaatggggaaaaggactggccggagagtgaggcacggaagggaggtctg

SEQ ID NO: 94397 - DNA, 30 bp, Homo sapiens
  misc_feature 1..30: note = chr5:87991044-87991074
  misc_feature 1..30: note = hyper
  source 1..30: mol_type = genomic DNA
aaaacccttgtgagccgcctaaaaaccgtc

SEQ ID NO: 94398 - DNA, 30 bp, Homo sapiens; identical to SEQ ID NO: 29777
  misc_feature 1..30: note = chr5:87991432-87991462
  misc_feature 1..30: note = hyper
  source 1..30: mol_type = genomic DNA

SEQ ID NO: 94399 - DNA, 30 bp, Homo sapiens
  misc_feature 1..30: note = chr5:88015167-88015197
  misc_feature 1..30: note = hypo
  source 1..30: mol_type = genomic DNA
aataaacagcctccacgcagcaatgcatac

SEQ ID NO: 94400 - DNA, 259 bp, Homo sapiens
  misc_feature 1..259: note = chr5:88178852-88179111
  misc_feature 1..259: note = hyper
  source 1..259: mol_type = genomic DNA
caataatctttacttcgtccagcgttgaagtgcttctccacctgattcaaacatgcagccacggcgacccacacagaaccttcaaagtcaatccaatagcagcccgaagatgtctgggtgtacgcgtgtgctcaagtgtctgtgactgcgagcagagcgagcagagagctggagacgatgtgtgcgtgtgtgcgcgcgcgcgaggggagcgcgcgcgagggggggggcgcggggccgcgcattcgcgcgcgccgaggcc

SEQ ID NO: 94401 - DNA, 258 bp, Homo sapiens
  misc_feature 1..258: note = chr5:88179171-88179429
  misc_feature 1..258: note = hyper
  source 1..258: mol_type = genomic DNA
gaggagaaagtggctctcagcggccggtcggattaaaagtaaccagactcgtccagaaaactgcgtccaggaaggaagtgacagaagacgaatgggaaaaggagaacagctcacagcgtttgaaacatcgcgtaaaaaagactgggggtggtgggggcgggggggattgaaggatactgggaggggaggcgggggtggtagggaagacggagcacgaatggttggggttctaagcagcacgtccgatgaaatgtcttt

SEQ ID NO: 94402 - DNA, 495 bp, Homo sapiens
  misc_feature 1..495: note = chr5:88179851-88180346
  misc_feature 1..495: note = hyper
  source 1..495: mol_type = genomic DNA
caattctttattgcacgaaatgaagacaacacggcgagctgcggctccctgctcctctcgcggcgcctctgcggaggacgctcggagagaacctagtctcccgctgcggcgcgctcgcttgctctccggggacgctgcgagccagccagcaggaaagtccttctaaagtcgggatctttcctctgaccaataggagcgcgaccctaatagttgctcttgtgacttttcccccttttggacacgcgttagccacttctctcttccaccggtcggtgcgctcctccgttactcacgcgtaaaaaccacggtccaggatgtctgcagcactcgattccagcgtgcttttcctgcacgcccagaagtcgcggttttcaccctgagaggttggagcgctagaaagcgagccgaaaggtttctctaatgttagtaatgtacgaaataataaaataattaccagtatttgagatctcgacttcatcgcggggccatgaactt

SEQ ID NO: 94403 - DNA, 534 bp, Homo sapiens; identical to SEQ ID NO: 29780
  misc_feature 1..534: note = chr5:88184853-88185387
  misc_feature 1..534: note = hyper
  source 1..534: mol_type = genomic DNA

SEQ ID NO: 94404 - DNA, 613 bp, Homo sapiens; identical to SEQ ID NO: 29781
  misc_feature 1..613: note = chr5:88185388-88186001
  misc_feature 1..613: note = hyper
  source 1..613: mol_type = genomic DNA

SEQ ID NO: 94405 - DNA, 26 bp, Homo sapiens
  misc_feature 1..26: note = chr5:88371468-88371494
  misc_feature 1..26: note = hypo
  source 1..26: mol_type = genomic DNA
aatcttgcttaggggcggatctcctg

SEQ ID NO: 94406 - DNA, 32 bp, Homo sapiens
  misc_feature 1..32: note = chr5:88391487-88391519
  misc_feature 1..32: note = hypo
  source 1..32: mol_type = genomic DNA
aatggaaaataaggccgggtgcggtggcttac

SEQ ID NO: 94407 - DNA, 30 bp, Homo sapiens
  misc_feature 1..30: note = chr5:88427549-88427579
  misc_feature 1..30: note = hypo
  source 1..30: mol_type = genomic DNA
aagaatcacctggggcgggtggggtggtgg

SEQ ID NO: 94408 - DNA, 30 bp, Homo sapiens
  misc_feature 1..30: note = chr5:89073758-89073788
  misc_feature 1..30: note = hypo
  source 1..30: mol_type = genomic DNA
aggggcgacagccaacgctcggactgatag

SEQ ID NO: 94409 - DNA, 622 bp, Homo sapiens
  misc_feature 1..622: note = chr5:891065-891687
  misc_feature 1..622: note = hypo
  source 1..622: mol_type = genomic DNA
agtggtaactggccacgccttgctctagacattcagagacaccggaggaaacctcaggccagaggacacctgggatgaggccctggaaataccagctctcctccctcccatgcttctccccaaagcaacaggacacggtgccgacccctcatttacaacgatgagctgtgaacaccaggagagtctctaaaagtgcacccttgcctggctgtgtccggcacgctcggactggccgatctgggggcggctccacctccaccttcttcccaggatcaaagtcgtcagcctctccctccgtgtcacagtgctccctctctcgcttccgcttcttctcttcctgggcggcagagtcaagggagtgagaaaggcaggagtaggcgggatccggacaggtctgcccaatcccctcgcagttctcaggggagggacagaactaagggaaaccccctccgagatcctcctcatgccaggctccctcctcacagagaccctggcagggtctgctgaggaacagcacacccaggatcctggaactgagtctgcgggcctcagcggttcgcgttttgctaccaacggaacaccccctcccctcctccagccacgcaggcgcactctgcctggg

SEQ ID NO: 94410 - DNA, 26 bp, Homo sapiens
  misc_feature 1..26: note = chr5:89504166-89504192
  misc_feature 1..26: note = hypo
  source 1..26: mol_type = genomic DNA
tggcagaataggaaccgctccaatct

SEQ ID NO: 94411 - DNA, 30 bp, Homo sapiens
  misc_feature 1..30: note = chr5:89854111-89854141
  misc_feature 1..30: note = hyper
  source 1..30: mol_type = genomic DNA
acattctcttaggaacgaaaaaagactcag

SEQ ID NO: 94412 - DNA, 446 bp, Homo sapiens; identical to SEQ ID NO: 29782
  misc_feature 1..446: note = chr5:89854523-89854969
  misc_feature 1..446: note = hyper
  source 1..446: mol_type = genomic DNA

SEQ ID NO: 94413 - DNA, 248 bp, Homo sapiens
  misc_feature 1..248: note = chr5:91876-92124
  misc_feature 1..248: note = hyper
  source 1..248: mol_type = genomic DNA
aatctggagctggtccgcctagaccaggggaaatcggggtcccgtccgggtacactggcagaactcaggggtcagatcctctgccctggagcattcagatttgtgcctctacgttatggaaaccaggggcccgtccgggtgcaacgtggcatccacaaaatggcaggtccccgagctccgggctccgagagaacaaaagcagaagccactgccgcccgcgctcggggaggagccgcccaggtgggcgc

SEQ ID NO: 94414 - DNA, 23 bp, Homo sapiens
  misc_feature 1..23: note = chr5:9227669-9227692
  misc_feature 1..23: note = hypo
  source 1..23: mol_type = genomic DNA
tttttttttttgagacggagtct

SEQ ID NO: 94415 - DNA, 220 bp, Homo sapiens
  misc_feature 1..220: note = chr5:926707-926927
  misc_feature 1..220: note = hyper
  source 1..220: mol_type = genomic DNA
cgcttcttccccgcccgcccctcctgggcccctcgcgtcccccttccctgtcacccgagcttcgtttgtgactgaaactctgctgcgtctgtcatcttggtgtcctctatgaaaaccttcccagagctcttcacactccacacgtggcttttatttagtgttttctacctactcggcagcgtttcctggggagggaaggcacccagagcctccggagcca

SEQ ID NO: 94416 - DNA, 52 bp, Homo sapiens
  misc_feature 1..52: note = chr5:927008-927060
  misc_feature 1..52: note = hyper
  source 1..52: mol_type = genomic DNA
cgaatatttccccgggaacgcggacttgccggccctgcgaggcacccggcgg

SEQ ID NO: 94417 - DNA, 37 bp, Homo sapiens
  misc_feature 1..37: note = chr5:92906137-92906174
  misc_feature 1..37: note = hyper
  source 1..37: mol_type = genomic DNA
ttgtaaaagcggcttcgttcgacggtggatctctgaa

SEQ ID NO: 94418 - skipped

SEQ ID NO: 94419 - DNA, 29 bp, Homo sapiens
  misc_feature 1..29: note = chr5:92915099-92915128
  misc_feature 1..29: note = hyper
  source 1..29: mol_type = genomic DNA
cgctagggtcacgccgggtcccaggggcc

SEQ ID NO: 94420 - DNA, 150 bp, Homo sapiens
  misc_feature 1..150: note = chr5:92915445-92915595
  misc_feature 1..150: note = hyper
  source 1..150: mol_type = genomic DNA
cccacccctgggaggcgaccccctccccgcccccagccggctggcagcggcgcagggagtctggctcggctgctaggctgcgaatcccggtgctctctcgccgccgccgcaggttgtctgctcgggagagcggctcgatgtcccttttaa

SEQ ID NO: 94421 - DNA, 328 bp, Homo sapiens; identical to SEQ ID NO: 29785
  misc_feature 1..328: note = chr5:92915837-92916165
  misc_feature 1..328: note = hyper
  source 1..328: mol_type = genomic DNA

SEQ ID NO: 94422 - DNA, 30 bp, Homo sapiens
  misc_feature 1..30: note = chr5:92921022-92921052
  misc_feature 1..30: note = hyper
  source 1..30: mol_type = genomic DNA
cggccaattcacctgcgagggctgcaaaag

SEQ ID NO: 94423 - DNA, 57 bp, Homo sapiens
  misc_feature 1..57: note = chr5:92939780-92939837
  misc_feature 1..57: note = hyper
  source 1..57: mol_type = genomic DNA
ggtgtttgggggctgcgtggtgagccgaggcaaagccagggtaccccgatcgtcttc

SEQ ID NO: 94424 - DNA, 30 bp, Homo sapiens
  misc_feature 1..30: note = chr5:92940177-92940207
  misc_feature 1..30: note = hyper
  source 1..30: mol_type = genomic DNA
ggggtgggccggggccggctgcgaggctga

SEQ ID NO: 94425 - DNA, 43 bp, Homo sapiens
  misc_feature 1..43: note = chr5:92948358-92948401
  misc_feature 1..43: note = hyper
  source 1..43: mol_type = genomic DNA
ggggggggggtggggcgcgcgcgctgggcgctgtccatggtgc

SEQ ID NO: 94426 - DNA, 173 bp, Homo sapiens
  misc_feature 1..173: note = chr5:931145-931318
  misc_feature 1..173: note = hypo
  source 1..173: mol_type = genomic DNA
aacaggaggaaagcacggaagcttatttaaaggaagctctatatggtgggagagcctcccatggaaggaatgccctaaagccacagagttggacactcacacccatgtgagcaaacaggacttgcaagaagtggatgggtggatctctagtggctcaccggccctaaatcctc

SEQ ID NO: 94427 - DNA, 805 bp, Homo sapiens
  misc_feature 1..805: note = chr5:94620329-94621134
  misc_feature 1..805: note = hyper
  source 1..805: mol_type = genomic DNA
cttctcctccctcttcggctgcacctcctcccgggtccccgcggcgctggcggtggcggcggcggcggcggcgggcgcagcagcagaaaccgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccccaggccgcgccctggctccctcttctctctgaccgagctcgggaagctgcacgcaccggggcgtgcgcgtccagctgcgccagggaccgcacccggcgccctctgggcagcacctgtcagcggcgggggcggctgcctccaaattgggcgcgcacgcggctcacacaacaaggcgcgtctggctggagactccggggaccagcagtccccctggggcgccccgggaccatcctccagctcctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtcca

SEQ ID NO: 94428 - DNA, 215 bp, Homo sapiens
  misc_feature 1..215: note = chr5:9479707-9479922
  misc_feature 1..215: note = hypo
  source 1..215: mol_type = genomic DNA
aatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactc

SEQ ID NO: 94429 - DNA, 1724 bp, Homo sapiens
  misc_feature 1..1724: note = chr5:94955559-94957283
  misc_feature 1..1724: note = hyper
  source 1..1724: mol_type = genomic DNA
aatggccaagcaaagcgacattctgtcctgctgtgctttacacgtaaatagagaatggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttcta

SEQ ID NO: 94430 - DNA, 90 bp, Homo sapiens; identical to SEQ ID NO: 40573
  misc_feature 1..90: note = chr5:94982142-94982232
  misc_feature 1..90: note = hypo
  source 1..90: mol_type = genomic DNA

SEQ ID NO: 94431 - DNA, 80 bp, Homo sapiens
  misc_feature 1..80: note = chr5:95067652-95067732
  misc_feature 1..80: note = hyper
  source 1..80: mol_type = genomic DNA
aagccctctggtctccggggacgagagcagcttgttgctgaacgcggccagcacggtcgcgcgtccggtgttcaccgagt

SEQ ID NO: 94432 - DNA, 21 bp, Homo sapiens
  misc_feature 1..21: note = chr5:95117541-95117562
  misc_feature 1..21: note = hypo
  source 1..21: mol_type = genomic DNA
agactccgtctcaaaaaaaga

SEQ ID NO: 94433 - DNA, 435 bp, Homo sapiens
  misc_feature 1..435: note = chr5:9544685-9545120
  misc_feature 1..435: note = hyper
  source 1..435: mol_type = genomic DNA
ggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtg

SEQ ID NO: 94434 - DNA, 355 bp, Homo sapiens
  misc_feature 1..355: note = chr5:9545496-9545851
  misc_feature 1..355: note = hyper
  source 1..355: mol_type = genomic DNA
gcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaa

SEQ ID NO: 94435 - DNA, 124 bp, Homo sapiens; identical to SEQ ID NO: 29466
  misc_feature 1..124: note = chr5:9546564-9546688
  misc_feature 1..124: note = hyper
  source 1..124: mol_type = genomic DNA

SEQ ID NO: 94436 - DNA, 98 bp, Homo sapiens
  misc_feature 1..98: note = chr5:95551329-95551427
  misc_feature 1..98: note = hypo
  source 1..98: mol_type = genomic DNA
tacctccttattcaccgcctctacttcttctgcctcaaccactcatgagtcagcaagaccaaccgttcctcttcctccttcttctcaatctgctcagc

SEQ ID NO: 94437 - DNA, 30 bp, Homo sapiens
  misc_feature 1..30: note = chr5:95767930-95767960
  misc_feature 1..30: note = hyper
  source 1..30: mol_type = genomic DNA
ggggatagatggtcccgtgtctttcaccca

SEQ ID NO: 94438 - DNA, 161 bp, Homo sapiens
  misc_feature 1..161: note = chr5:95768166-95768327
  misc_feature 1..161: note = hyper
  source 1..161: mol_type = genomic DNA
agaccgcctcagtcccgggggatggagcgcactgcttctcccgggggcgcttggttggtaagagcttgagtgtatctcaagttccctgaacaagcgtggagggatttttcttccaaaccgcgcgggaacggatttcaattctagagcggccaacagtaagc

SEQ ID NO: 94439 - DNA, 200 bp, Homo sapiens
  misc_feature 1..200: note = chr5:95768893-95769093
  misc_feature 1..200: note = hyper
  source 1..200: mol_type = genomic DNA
agaggagaggctgggcggcggcgagcgctcagtgaagcgcttcggtctccaggctgagtggagccccagcccttcccagccagaatggaaatgagtgtttacacgtcaaatcgacgaaagccatctcttgacgtcagatctacctggactaagatccgaatggtattcccggcggggcggagaagcggctaaaataagca

SEQ ID NO: 94440 - DNA, 116 bp, Homo sapiens
  misc_feature 1..116: note = chr5:95769953-95770069
  misc_feature 1..116: note = hyper
  source 1..116: mol_type = genomic DNA
atggtggagcctattcgaaccctgagggattgaacctggcgggagataccagtgcctagtattcagcaccgaggtctggacagcgacacacgcaggactgccgcaggagctgctct

SEQ ID NO: 94441 - DNA, 43 bp, Homo sapiens
  misc_feature 1..43: note = chr5:96038372-96038415
  misc_feature 1..43: note = hyper
  source 1..43: mol_type = genomic DNA
atgccaggcgcatgacgagtccacggagcgggacctccctccc

SEQ ID NO: 94442 - DNA, 45 bp, Homo sapiens
  misc_feature 1..45: note = chr5:98104846-98104891
  misc_feature 1..45: note = hyper
  source 1..45: mol_type = genomic DNA
gatccaggacctggacgcgggggtctgcggcgcccctacgccccc

SEQ ID NO: 94443 - DNA, 110 bp, Homo sapiens
  misc_feature 1..110: note = chr5:98200994-98201104
  misc_feature 1..110: note = hypo
  source 1..110: mol_type = genomic DNA
ggtgactagatgctacgaggctggtttcaggctaagaatcttttctcctaaatgagatggaaagccactggagtgttgtaggcacagaaatataacggtgtgactttatt

SEQ ID NO: 94444 - DNA, 30 bp, Homo sapiens
  misc_feature 1..30: note = chr5:99383200-99383230
  misc_feature 1..30: note = hypo
  source 1..30: mol_type = genomic DNA
gtgagaagaattattcgagtgctgtaggca

SEQ ID NO: 94445 - DNA, 150 bp, Homo sapiens
  misc_feature 1..150: note = chr5:99389805-99389955
  misc_feature 1..150: note = hypo
  source 1..150: mol_type = genomic DNA
cgacgtagtatgtatcgtgtagtatgatatctaatgatgagtttgctaatacaatgccggttaggccacctacagtgaagagaaaaatgaaccctagggctcagagtactgcagcagatcatttggtattgcttccgtggagtgtagcga

SEQ ID NO: 94446 - DNA, 70 bp, Homo sapiens
  misc_feature 1..70: note = chr6:100036662-100036732
  misc_feature 1..70: note = hyper
  source 1..70: mol_type = genomic DNA
tcctgctgcgtgagccgatctgcagatccagcaaaagacccgagagcggcttgaacgccagatgattcct

SEQ ID NO: 94447 - DNA, 201 bp, Homo sapiens
  misc_feature 1..201: note = chr6:100036959-100037160
  misc_feature 1..201: note = hyper
  source 1..201: mol_type = genomic DNA
acccagcccgctctgcggatgggtcgtagattccggctggaagccggaggaagtgcatagagggcagcttcaaaagccaaggctgcgctgctttgcgcggggcttcttccctcgcgtgcccgcgccgggtgccggagcagcctccgcaagctgctttcatctcggtctgccggggcagggtcgaaccgcagctgtggggct

SEQ ID NO: 94448 - DNA, 67 bp, Homo sapiens; identical to SEQ ID NO: 30684
  misc_feature 1..67: note = chr6:100038640-100038707
  misc_feature 1..67: note = hyper
  source 1..67: mol_type = genomic DNA

SEQ ID NO: 94449 - DNA, 369 bp, Homo sapiens; identical to SEQ ID NO: 578
  misc_feature 1..369: note = chr6:100038785-100039154
  misc_feature 1..369: note = hyper
  source 1..369: mol_type = genomic DNA

SEQ ID NO: 94450 - DNA, 200 bp, Homo sapiens
  misc_feature 1..200: note = chr6:100039274-100039474
  misc_feature 1..200: note = hyper
  source 1..200: mol_type = genomic DNA
cggtggtccagcagagtcttctggctcccgggaaagcagcgtggcgccgccccagcccccagtccccagactagggattgggacgtcagtcattggctgcaggttactggtctgggctgggcccgcagagatcccaagcgctcctctgtcggtgcttcctcagcgtctgcgtttccgcagatgcccgaggtcagacagtt

SEQ ID NO: 94451 - DNA, 121 bp, Homo sapiens
  misc_feature 1..121: note = chr6:100050341-100050462
  misc_feature 1..121: note = hyper
  source 1..121: mol_type = genomic DNA
agaacacctttatttcgccttttaactctccgcctttctgattaaagagttcagacctgctccccggcccgcgttcaattattccccagcatcttttctcagaagctgtcaccaccacttg

SEQ ID NO: 94452 - DNA, 20 bp, Homo sapiens
  misc_feature 1..20: note = chr6:100050505-100050525
  misc_feature 1..20: note = hyper
  source 1..20: mol_type = genomic DNA
cgtttcgcttttctttcctc

SEQ ID NO: 94453 - DNA, 57 bp, Homo sapiens; identical to SEQ ID NO: 30688
  misc_feature 1..57: note = chr6:100050754-100050811
  misc_feature 1..57: note = hyper
  source 1..57: mol_type = genomic DNA

SEQ ID NO: 94454 - DNA, 251 bp, Homo sapiens; identical to SEQ ID NO: 579
  misc_feature 1..251: note = chr6:100050858-100051109
  misc_feature 1..251: note = hyper
  source 1..251: mol_type = genomic DNA

SEQ ID NO: 94455 - DNA, 149 bp, Homo sapiens; identical to SEQ ID NO: 580
  misc_feature 1..149: note = chr6:100051359-100051508
  misc_feature 1..149: note = hyper
  source 1..149: mol_type = genomic DNA

SEQ ID NO: 94456 - DNA, 380 bp, Homo sapiens
  misc_feature 1..380: note = chr6:100051771-100052151
  misc_feature 1..380: note = hyper
  source 1..380: mol_type = genomic DNA
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctatttaatttcatttaattttccatcccatttgctgcacagcccgcttttacttttaa

SEQ ID NO: 94457 - DNA, 293 bp, Homo sapiens
  misc_feature 1..293: note = chr6:100052449-100052742
  misc_feature 1..293: note = hyper
  source 1..293: mol_type = genomic DNA
ttcgcgtgtcgttcacgctttttcactcattaaggagggccagggaggcgccccgaacccaggcccagcgctcgccccttcccgcttgcagtgctggtaatttaaactgggtgtcatcccagagtcgccaggccagaggttagagggacatgttcatggcttaaatttattgccctgactcttcggagcggcttcctctcctcctccccaccccccggcttttgccattcatgggccgctggatcaaagcctccctctgctctgttgagggcagtcttcgcagccctcagaag

SEQ ID NO: 94458 - DNA, 222 bp, Homo sapiens; identical to SEQ ID NO: 30693
  misc_feature 1..222: note = chr6:100053289-100053511
  misc_feature 1..222: note = hyper
  source 1..222: mol_type = genomic DNA

SEQ ID NO: 94459 - DNA, 393 bp, Homo sapiens; identical to SEQ ID NO: 30694
  misc_feature 1..393: note = chr6:100054839-100055232
  misc_feature 1..393: note = hyper
  source 1..393: mol_type = genomic DNA

SEQ ID NO: 94460 - DNA, 516 bp, Homo sapiens
  misc_feature 1..516: note = chr6:100055269-100055785
  misc_feature 1..516: note = hyper
  source 1..516: mol_type = genomic DNA
cgacagccctgggtggggtgcactgagcgctgtaggtgccgggaccattcgcagcttgtgttttcccctgcgctctcgggtctcctcagtcagaagccagaagcccacccccgcacgctgtccgcagctctctctgcaaaagcaccctctttctgggggctcagggcatcgagaccctttcttcccttctgcccttcaatatgttaatttgaggcctaatttcgccttaaagtaattttttttcctgaaaaaaaaaatctttgggaggctctcagttcctagaacctcctcagatatttttttttcccttgccgatgtcggcttgtgggtatgcggcatatggagagaggatgagcaaggtactggctctgacgcgggctccaagggcgaggcgcgcccattcgcgcggggcacagggtcagagcgtctgcagcggggctctgagagtccagaggcccaaccgggaggcgccagggccaaaccactagctttgactcccacactccacacaccgtc

SEQ ID NO: 94461 - DNA, 45 bp, Homo sapiens
  misc_feature 1..45: note = chr6:100055786-100055831
  misc_feature 1..45: note = hyper
  source 1..45: mol_type = genomic DNA
cgacccctgaccagagagacttatagcactcgcccgctttggggg

SEQ ID NO: 94462 - DNA, 722 bp, Homo sapiens
  misc_feature 1..722: note = chr6:100060975-100061697
  misc_feature 1..722: note = hyper
  source 1..722: mol_type = genomic DNA
cctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 94463 - DNA, 1100 bp, Homo sapiens
  misc_feature 1..1100: note = chr6:100061988-100063088
  misc_feature 1..1100: note = hyper
  source 1..1100: mol_type = genomic DNA
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 94464 - DNA, 411 bp, Homo sapiens
  misc_feature 1..411: note = chr6:100066608-100067019
  misc_feature 1..411: note = hyper
  source 1..411: mol_type = genomic DNA
tgagccgcgttactccgagcgctcccattggtgcattccttggagccagggttgctattggtggcgagctggccgcggcgaaagaaccccggccgcttgggctagtgcggcggcggccaggcggagccggaggtgagagtgcgagcagcgtcctgtggcgtggcgacccctgggctcacagcctcgcgctccctgggctcacagcctcgggctccctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggagga

SEQ ID NO: 94465 - DNA, 283 bp, Homo sapiens; identical to SEQ ID NO: 30701
  misc_feature 1..283: note = chr6:100067144-100067427
  misc_feature 1..283: note = hyper
  source 1..283: mol_type = genomic DNA

SEQ ID NO: 94466 - DNA, 237 bp, Homo sapiens
  misc_feature 1..237: note = chr6:1004078-1004315
  misc_feature 1..237: note = hypo
  source 1..237: mol_type = genomic DNA
gctcctccctgaggacgacagaccccccggcgatcaggaccctggccacttctcagactttagcgcatccactcccagcaccccgcaagaccctcgctcgcccgcctgctcacccactaagtcctgcgggctcccagcaccccgcaagaccctcgctcgcccgcctgctcccggcaccccgcaagaccctcactcgcccgcctgctcacccactaagtcctgcggagctcctgctgc

SEQ ID NO: 94467 - DNA, 17 bp, Homo sapiens
  misc_feature 1..17: note = chr6:100441291-100441308
  misc_feature 1..17: note = hyper
  source 1..17: mol_type = genomic DNA
aaggccgtccggaggcg

SEQ ID NO: 94468 - DNA, 241 bp, Homo sapiens; identical to SEQ ID NO: 583
  misc_feature 1..241: note = chr6:100441497-100441738
  misc_feature 1..241: note = hyper
  source 1..241: mol_type = genomic DNA

SEQ ID NO: 94469 - DNA, 404 bp, Homo sapiens; identical to SEQ ID NO: 30704
  misc_feature 1..404: note = chr6:100441761-100442165
  misc_feature 1..404: note = hyper
  source 1..404: mol_type = genomic DNA

SEQ ID NO: 94470 - DNA, 353 bp, Homo sapiens
  misc_feature 1..353: note = chr6:100729492-100729845
  misc_feature 1..353: note = hyper
  source 1..353: mol_type = genomic DNA
ggcatgcctgctggacgacttaattgtggagcctgaagggccatcatgaaccggcgtgcggagaccgcctcgccactgctgcattacaaatgctctttattaacagcgatctgtaatcaatgggctcaggctttttgccagagcccccaaatcagacaggcgggcccctgcgtcagggtgggcggagccacggggcccagctatcgagctgggaagagaaagctgtgttgtccctgcctgactcttgggtgcgatggtaaatcagaaagggaccctagtaatcattccaggggcgccctcctctcactactggttgaatattcattagcccgggtgagcgcagctcactgtac

SEQ ID NO: 94471 - DNA, 152 bp, Homo sapiens
  misc_feature 1..152: note = chr6:100903253-100903405
  misc_feature 1..152: note = hyper
  source 1..152: mol_type = genomic DNA
ggggtcctcctggaccgttctggaagggcccccgccacagccacctgtacacaccccttggccttatcacatttatcgctcttcccctttcagccaacctattctccttcgtttctgtcacgacctgctcttctctttctaaatcccggctc

SEQ ID NO: 94472 - DNA, 221 bp, Homo sapiens; identical to SEQ ID NO: 30707
  misc_feature 1..221: note = chr6:100903560-100903781
  misc_feature 1..221: note = hyper
  source 1..221: mol_type = genomic DNA

SEQ ID NO: 94473 - DNA, 649 bp, Homo sapiens
  misc_feature 1..649: note = chr6:100903832-100904481
  misc_feature 1..649: note = hyper
  source 1..649: mol_type = genomic DNA
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaaaggattttcctcagctaaagtggccgaagacaaaggaaa

SEQ ID NO: 94474 - DNA, 41 bp, Homo sapiens
  misc_feature 1..41: note = chr6:100905267-100905308
  misc_feature 1..41: note = hyper
  source 1..41: mol_type = genomic DNA
aaagccctcctaggccgaggccactgcggttcctgaacagc

SEQ ID NO: 94475 - DNA, 92 bp, Homo sapiens
  misc_feature 1..92: note = chr6:100905783-100905875
  misc_feature 1..92: note = hyper
  source 1..92: mol_type = genomic DNA
ccgggccagagacaccgcggccgcacccagggaatccactaatgttactgtaaatgtggggtggaggccgaaggtcacaccgctgtctgtct

SEQ ID NO: 94476 - DNA, 232 bp, Homo sapiens
  misc_feature 1..232: note = chr6:100905935-100906167
  misc_feature 1..232: note = hyper
  source 1..232: mol_type = genomic DNA
ctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 94477 - DNA, 81 bp, Homo sapiens
  misc_feature 1..81: note = chr6:100906245-100906326
  misc_feature 1..81: note = hyper
  source 1..81: mol_type = genomic DNA
cgggcgaatcccacttaggttctacttggcgcagggactcggacgatggcacctaacccgccttcccgggaactgcccaaa

SEQ ID NO: 94478 - DNA, 449 bp, Homo sapiens
  misc_feature 1..449: note = chr6:100911997-100912446
  misc_feature 1..449: note = hyper
  source 1..449: mol_type = genomic DNA
ctcacccatgccagccgcatcctccagacccctgggaagttgcccaaacaacaaaatacatatttctgaagacccgcaagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctg

SEQ ID NO: 94479 - DNA, 586 bp, Homo sapiens
  misc_feature 1..586: note = chr6:100912465-100913051
  misc_feature 1..586: note = hyper
  source 1..586: mol_type = genomic DNA
cggggcgtcttctgcttcacctaccttcagtccccacaagcggcagaggtttcgggggcgcccatctcttaactgttctcatgcctaccgtccaacccagcgacaccgccggcctctccgcttcccaccggcagagaggagcagagcattcccggctcccttttctggatcatgaattggaggaggggtgcgtggcagaaagaggaggatgcaagctttgggacgagtgaggtgattttagaatcctggtcctccgtagttgctacgaagccagttcactattattcctaattggaagccgaaaactgccccccgtaacttctttatagcttaagggtttagcttcaacttcactccggggccgcctctctcccgccctccctcaatgccactcacaagccccctcgcctcccattggcctggcgcggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 94480 - DNA, 30 bp, Homo sapiens
  misc_feature 1..30: note = chr6:100913748-100913778
  misc_feature 1..30: note = hyper
  source 1..30: mol_type = genomic DNA
ccctctaatttgaaccgccttctctttctc

SEQ ID NO: 94481 - DNA, 118 bp, Homo sapiens
  misc_feature 1..118: note = chr6:100914823-100914941
  misc_feature 1..118: note = hyper
  source 1..118: mol_type = genomic DNA
gtaaggaagtcttcacgcttaaggctgacgtcctggggggctgggcgggctgttccaatgtcccagtgaagctcagttgtcaatgagccaagtagatgtcgtttaataaacaaagtga

SEQ ID NO: 94482 - DNA, 340 bp, Homo sapiens
  misc_feature 1..340: note = chr6:100915441-100915781
  misc_feature 1..340: note = hyper
  source 1..340: mol_type = genomic DNA
atcctgatgtgggagaaaacccatgcggggctgcaaaaaagtgtctccctccttcccccaccaagcagggcgaacagcctagtgtgatggcgacactgttcccccaagagtccctgccacttctggggcaacccaggatgctgccctcatggagcctgccccggaccccggaggccaggacatgcaggcgtccgtgactctaccccaggggagccaggccgggtagattctggaaccaacgcgcctttgtgagcaatgtctagcatgccgcgcgcacccagaaagaagggggagcgggcacctcaagggccttctgacccctccccgcaaaaggcaaaat

SEQ ID NO: 94483 - DNA, 115 bp, Homo sapiens
  misc_feature 1..115: note = chr6:100917195-100917310
  misc_feature 1..115: note = hyper
  source 1..115: mol_type = genomic DNA
aatccctgtccgaatcgggaattggcattccgtaagggagcggagggcctcaggccactaggcagctccgaacgcggggaagcgggagcaaagatgagctcagagcgagggttgc

SEQ ID NO: 94484 - DNA, 32 bp, Homo sapiens
  misc_feature 1..32: note = chr6:10113557-10113589
  misc_feature 1..32: note = hyper
  source 1..32: mol_type = genomic DNA
tgagccgctgataaccggccgactggggagcc

SEQ ID NO: 94485 - DNA, 133 bp, Homo sapiens
  misc_feature 1..133: note = chr6:10113619-10113752
  misc_feature 1..133: note = hyper
  source 1..133: mol_type = genomic DNA
cgggtgcgcaggcctggcccagcgggggcgccgggagagccggcccaattatgatgttgggagggatgttgtgatcctcggaggcggctctcgctaacaggcaggggcctgggggtcccgaggcaaggccggt

SEQ ID NO: 94486 - DNA, 1433 bp, Homo sapiens
  misc_feature 1..1433: note = chr6:101840541-101841974
  misc_feature 1..1433: note = hyper
  source 1..1433: mol_type = genomic DNA
agggagagcctggtgcgctcaccgccgccagcccctccctggaagccaagctgcgggaagactctgggactcagttgcccctccccatctctggcctttaaaagagtcctcccgagaacttggaccagtggccgccaaaccagggctgcttcccagactcctgtctccaatcttggagtctgcgacctcaggttcggcgcccactagatctcgaatccaacttctttctgaaatgtgtttaggttgagagttccggggcctgggcgggagtttggtggggagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 94487 - DNA, 272 bp, Homo sapiens
  misc_feature 1..272: note = chr6:101849938-101850210
  misc_feature 1..272: note = hyper
  source 1..272: mol_type = genomic DNA
gctaggactgtgattcgacccagcgtcctcctgtcacctcctgcgaggtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggca

SEQ ID NO: 94488 - DNA, 64 bp, Homo sapiens
  misc_feature 1..64: note = chr6:101850475-101850539
  misc_feature 1..64: note = hyper
  source 1..64: mol_type = genomic DNA
tcttggttgtcaccccgcctttgatcctgtgttgggacaacttgggttttcctgggtgcccacc

SEQ ID NO: 94489 - DNA, 31 bp, Homo sapiens
  misc_feature 1..31: note = chr6:103355599-103355630
  misc_feature 1..31: note = hypo
  source 1..31: mol_type = genomic DNA
cccctggagtagggccgcccagcggctgcac

SEQ ID NO: 94490 - DNA, 91 bp, Homo sapiens
  misc_feature 1..91: note = chr6:103355690-103355781
  misc_feature 1..91: note = hypo
  source 1..91: mol_type = genomic DNA
ctgctggtgtctgtcggtgtgctcttctgctcctctcagtgtccagccacttgtttgtgtgcctgctaaggcctgtcgggtctatgtgggc

SEQ ID NO: 94491 - DNA, 86 bp, Homo sapiens; identical to SEQ ID NO: 529
  misc_feature 1..86: note = chr6:10381507-10381593
  misc_feature 1..86: note = hyper
  source 1..86: mol_type = genomic DNA

SEQ ID NO: 94492 - DNA, 275 bp, Homo sapiens; identical to SEQ ID NO: 30280
  misc_feature 1..275: note = chr6:10381694-10381969
  misc_feature 1..275: note = hyper
  source 1..275: mol_type = genomic DNA

SEQ ID NO: 94493 - DNA, 46 bp, Homo sapiens; identical to SEQ ID NO: 30281
  misc_feature 1..46: note = chr6:10382321-10382367
  misc_feature 1..46: note = hyper
  source 1..46: mol_type = genomic DNA

SEQ ID NO: 94494 - DNA, 389 bp, Homo sapiens
  misc_feature 1..389: note = chr6:10382722-10383111
  misc_feature 1..389: note = hyper
  source 1..389: mol_type = genomic DNA
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgtcaacttggtagtgtaattattgttttgttttctaatatgtaattactctttgtcgttgctattatgaatccaccgagcttgactcttgagcagcaagatggattcaagtttgaagttaggatttgatgcgtggggaaaactggcttctccccatgcgtaggacactataggggcccacgcgtgtcttccccgcagcccagcaaga

SEQ ID NO: 94495 - DNA, 347 bp, Homo sapiens
  misc_feature 1..347: note = chr6:10383727-10384074
  misc_feature 1..347: note = hyper
  source 1..347: mol_type = genomic DNA
cagctcagctacccacgctcccagccacgtcgcgggtggatattcccgcctgggctgggcaccgcggaatcagcaccgcctgctgcgcaggccccgcccagaggctgcaccacccaggccctgcccgccgccctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagctgtcaggttagcgtggcctcctcggccgcccagagaagaatgtgttaaaattctttgcacgggagcctttccca

SEQ ID NO: 94496 - DNA, 75 bp, Homo sapiens
  misc_feature 1..75: note = chr6:10384438-10384513
  misc_feature 1..75: note = hyper
  source 1..75: mol_type = genomic DNA
tgcccctgcgggtcccgattacagatgaatttttattccgaggtggggcacgtaatggaacggaaaagatatgat

SEQ ID NO: 94497 - DNA, 154 bp, Homo sapiens
  misc_feature 1..154: note = chr6:10384821-10384975
  misc_feature 1..154: note = hyper
  source 1..154: mol_type = genomic DNA
tgcttctgcatattgcgttggtcgtggttttgtttaaaaagacgtaagaagggaagagaaagactgagatgatggggagatggtatttgcttgtttcatcttttatttttaaaagtaaatagggaagggggaaggagggggagccgtggcgggc

SEQ ID NO: 94498 - DNA, 994 bp, Homo sapiens; identical to SEQ ID NO: 30286
  misc_feature 1..994: note = chr6:10385279-10386273
  misc_feature 1..994: note = hyper
  source 1..994: mol_type = genomic DNA

SEQ ID NO: 94499 - DNA, 1307 bp, Homo sapiens; identical to SEQ ID NO: 30287
  misc_feature 1..1307: note = chr6:10389909-10391216
  misc_feature 1..1307: note = hyper
  source 1..1307: mol_type = genomic DNA

SEQ ID NO: 94500 - DNA, 132 bp, Homo sapiens; identical to SEQ ID NO: 30288
  misc_feature 1..132: note = chr6:10391324-10391456
  misc_feature 1..132: note = hyper
  source 1..132: mol_type = genomic DNA

SEQ ID NO: 94501 - DNA, 44 bp, Homo sapiens
  misc_feature 1..44: note = chr6:10404465-10404509
  misc_feature 1..44: note = hyper
  source 1..44: mol_type = genomic DNA
ggaggactccgcgagcgcgcggcagcgaacgaagcgcgcaccag

SEQ ID NO: 94502 - DNA, 111 bp, Homo sapiens
  misc_feature 1..111: note = chr6:10404879-10404990
  misc_feature 1..111: note = hyper
  source 1..111: mol_type = genomic DNA
cgttggggttcaccacgccgccgaagaggttgtccttgttaatagggatggcggagacggcattgctgttggacttggacagggacacggggcctgcggagacagagggga

SEQ ID NO: 94503 - DNA, 504 bp, Homo sapiens
  misc_feature 1..504: note = chr6:10410444-10410948
  misc_feature 1..504: note = hyper
  source 1..504: mol_type = genomic DNA
atgggggctggaagtcggcattgggggtgtgggacagcggcggggcgctcgtgtagggagattgacctacagtgcccagctggggcaaccgtgccgtcccgttgctggtgccgtcgtgacggtcctagaagagagcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 94504 - DNA, 783 bp, Homo sapiens
  misc_feature 1..783: note = chr6:10411253-10412036
  misc_feature 1..783: note = hyper
  source 1..783: mol_type = genomic DNA
gagagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacacgccttgggaagccgcggcgaggtaggtctgcgtgctcggagaggtcgagcgggggctggggtagggggtaatgcactcgatttagggatggaaaagagcgagagaaaggcggaaggtggggtgggggatgcaaatggagagggtgtcctgaaggaaagctgggcgtgaaacccgaggtttcgggcagctccacggcaccaggtttccagaatccaattcctaaagaaacagcaacgggggtggggatgggactcaccatggctgaaaaactgtgaactaacatctgcgaagagtctggggtaacgagtcagggtggaaaaaaacaagcaagcctggagcgcccggctgccccgccgcccgagcgcgccccacacaaaaggcgccgagagccccgcgccacccaggactccagtcacggcgccgacgctccccggagcgcgggagcccggctcggatccatccgaacttgaaccaccgattcgcgcggcgc

SEQ ID NO: 94505 - DNA, 299 bp, Homo sapiens
  misc_feature 1..299: note = chr6:10413015-10413314
  misc_feature 1..299: note = hyper
  source 1..299: mol_type = genomic DNA
acccggcgccctgcccgggaccggcccgctcgctgcactggtcctctcctcggcctcctcttgagctttcctcggacaggggcaccgtgcgctccccggccaccgtcgctctgccctcggctctctggggccggggattccggatcgggagccgggatgcgggccggggcgcgcacagacgctaggcggcccagcccgggcgccgctggcaccggctcgcggctcccggcaaaaacccgtccgactggctgggccactcccgcctgacgcccccccagatgacacgactagctctcccg

SEQ ID NO: 94506 - DNA, 348 bp, Homo sapiens
  misc_feature 1..348: note = chr6:10414201-10414549
  misc_feature 1..348: note = hyper
  source 1..348: mol_type = genomic DNA
agtgttggttgtaaccgttcccagcgcctcctgcgggtggacaggtcgcgctagggtctcccttgctgcctcaagaaggcgagctcaggggactctgcgttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagagg

SEQ ID NO: 94507 - DNA, 508 bp, Homo sapiens
  misc_feature 1..508: note = chr6:10414821-10415329
  misc_feature 1..508: note = hyper
  source 1..508: mol_type = genomic DNA
tcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctgggtgagcgcaaagtgctggctgccggcggtgagcgcaggaggagga

SEQ ID NO: 94508 - DNA, 447 bp, Homo sapiens
  misc_feature 1..447: note = chr6:10415389-10415836
  misc_feature 1..447: note = hyper
  source 1..447: mol_type = genomic DNA
ggaggaggaagaggagggcgaggaggaggaggagggcgaggagaagggcgaggaggaggagagaagggaaagagctcccgtgtgcgctcggagatctccctctaatggtagaaacttttcccttttccagctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggc

SEQ ID NO: 94509 - DNA, 260 bp, Homo sapiens
  misc_feature 1..260: note = chr6:10416118-10416378
  misc_feature 1..260: note = hyper
  source 1..260: mol_type = genomic DNA
atcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgca

SEQ ID NO: 94510 - DNA, 372 bp, Homo sapiens; identical to SEQ ID NO: 30296
  misc_feature 1..372: note = chr6:10417158-10417530
  misc_feature 1..372: note = hyper
  source 1..372: mol_type = genomic DNA

SEQ ID NO: 94511 - DNA, 363 bp, Homo sapiens; identical to SEQ ID NO: 533
  misc_feature 1..363: note = chr6:10419077-10419440
  misc_feature 1..363: note = hyper
  source 1..363: mol_type = genomic DNA

SEQ ID NO: 94512 - DNA, 526 bp, Homo sapiens
  misc_feature 1..526: note = chr6:10419476-10420002
  misc_feature 1..526: note = hyper
  source 1..526: mol_type = genomic DNA
cgtttttcctgtcttcgctgtctcctgggagctctcctgggcgctgccaggcgcgcctcacctacgactcccctgccctgggccacggcgcttcctctcctcctccccgctccggccccctcccctactccacccctgcccacctcaaccccagccaaggcaaaccccccgtacctgccagtcccccattttggcaagtatggacatcgcggctctgcgctcctggcgactggtccccgccgggcatgggctggagggctcggtcgggccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaac

SEQ ID NO: 94513 - DNA, 150 bp, Homo sapiens; identical to SEQ ID NO: 30300
  misc_feature 1..150: note = chr6:10420118-10420268
  misc_feature 1..150: note = hyper
  source 1..150: mol_type = genomic DNA

SEQ ID NO: 94514 - DNA, 37 bp, Homo sapiens; identical to SEQ ID NO: 30301
  misc_feature 1..37: note = chr6:10420718-10420755
  misc_feature 1..37: note = hyper
  source 1..37: mol_type = genomic DNA

SEQ ID NO: 94515 - DNA, 207 bp, Homo sapiens; identical to SEQ ID NO: 30302
  misc_feature 1..207: note = chr6:10420876-10421083
  misc_feature 1..207: note = hyper
  source 1..207: mol_type = genomic DNA

SEQ ID NO: 94516 - DNA, 96 bp, Homo sapiens; identical to SEQ ID NO: 535
  misc_feature 1..96: note = chr6:10421356-10421452
  misc_feature 1..96: note = hyper
  source 1..96: mol_type = genomic DNA

SEQ ID NO: 94517 - DNA, 1159 bp, Homo sapiens
  misc_feature 1..1159: note = chr6:10421548-10422707
  misc_feature 1..1159: note = hyper
  source 1..1159: mol_type = genomic DNA
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcactagctaacagggcctgggacactgagccgtgtcgcaaacttttctgt

SEQ ID NO: 94518 - DNA, 169 bp, Homo sapiens
  misc_feature 1..169: note = chr6:10423918-10424087
  misc_feature 1..169: note = hyper
  source 1..169: mol_type = genomic DNA
taaatcgctggaacgcgtggtgtcccaaccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 94519 - DNA, 96 bp, Homo sapiens
  misc_feature 1..96: note = chr6:10425382-10425478
  misc_feature 1..96: note = hyper
  source 1..96: mol_type = genomic DNA
agggaaagtctgcctcgatctgtagcagagttttgggattgactttctaaactgcagccactcctcatctttggccttgtgaaaaacttgagaccc

SEQ ID NO: 94520 - DNA, 161 bp, Homo sapiens; identical to SEQ ID NO: 2765
  misc_feature 1..161: note = chr6:10425629-10425790
  misc_feature 1..161: note = hyper
  source 1..161: mol_type = genomic DNA

SEQ ID NO: 94521 - DNA, 1119 bp, Homo sapiens
  misc_feature 1..1119: note = chr6:10425838-10426957
  misc_feature 1..1119: note = hyper
  source 1..1119: mol_type = genomic DNA
cgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccctttgtgcaggcccggaagtgtccgcccggttttcccactgcctggaggggcccagggtcgcggatagactcggacaaggctccgtttactttcagtttgtcttagttgactaatggcgggactggttgtaatgcgtgctctgagattt

SEQ ID NO: 94522 - DNA, 19 bp, Homo sapiens
  misc_feature 1..19: note = chr6:105143888-105143907
  misc_feature 1..19: note = hypo
  source 1..19: mol_type = genomic DNA
ccaccgtgcctggccctcc

SEQ ID NO: 94523 - DNA, 40 bp, Homo sapiens
  misc_feature 1..40: note = chr6:105384637-105384677
  misc_feature 1..40: note = hypo
  source 1..40: mol_type = genomic DNA
ggtctcctaatgtgccgggattacaggcatgagccactgc

SEQ ID NO: 94524 - skipped

SEQ ID NO: 94525 - DNA, 85 bp, Homo sapiens
  misc_feature 1..85: note = chr6:105388632-105388717
  misc_feature 1..85: note = hyper
  source 1..85: mol_type = genomic DNA
ggcgacagcggattccgtgcccggtggccgcgcgccgcccggctgttccgcgtccccttgccggctcacaatgtgctgaccctcc

SEQ ID NO: 94526 - DNA, 201 bp, Homo sapiens
  misc_feature 1..201: note = chr6:105389509-105389710
  misc_feature 1..201: note = hyper
  source 1..201: mol_type = genomic DNA
gggcaggcgtcggggatcgtttttgctttggtatcggtgatgtaaattcatgaattaaaattaaggattttgaaaagaacggggaagaacgcacttggatttaggttgtttttgaaaaggaaaaaccaaagaggaaatgatacgtttgcaggagcattaactgactactgactggaacattggatgcgggtgctttgtgaa

SEQ ID NO: 94527 - DNA, 30 bp, Homo sapiens
  misc_feature 1..30: note = chr6:105389920-105389950
  misc_feature 1..30: note = hyper
  source 1..30: mol_type = genomic DNA
gggtttgttttcatccgtaggtttttaagg

SEQ ID NO: 94528 - DNA, 362 bp, Homo sapiens
  misc_feature 1..362: note = chr6:105400890-105401252
  misc_feature 1..362: note = hyper
  source 1..362: mol_type = genomic DNA
catttgtctccatgtcgtaggaatgtcaagaaagttaccgccaagtggtttaccaaaacgcggcggaaggaatcaggacagtttgcccgacgggcgggtcggcggctttcaggcgggagagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaagacagctcagttttaggcatggcccggtgggggtgggggtgctcattttcttgggttcggattccctctctttgaccgcacttatcttagc

SEQ ID NO: 94529 - DNA, 234 bp, Homo sapiens; identical to SEQ ID NO: 30722
  misc_feature 1..234: note = chr6:105401581-105401815
  misc_feature 1..234: note = hyper
  source 1..234: mol_type = genomic DNA

SEQ ID NO: 94530 - DNA, 35 bp, Homo sapiens
  misc_feature 1..35: note = chr6:105404005-105404040
  misc_feature 1..35: note = hyper
  source 1..35: mol_type = genomic DNA
accccaccccctgcccgcgccggctttttttctct

SEQ ID NO: 94531 - DNA, 155 bp, Homo sapiens; identical to SEQ ID NO: 30723
  misc_feature 1..155: note = chr6:105404519-105404674
  misc_feature 1..155: note = hyper
  source 1..155: mol_type = genomic DNA

SEQ ID NO: 94532 - DNA, 268 bp, Homo sapiens
  misc_feature 1..268: note = chr6:105404877-105405145
  misc_feature 1..268: note = hyper
  source 1..268: mol_type = genomic DNA
agccccttaaggatacgaggtgaaattagtagcaagaaagcatgtaattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggttaattttc

SEQ ID NO: 94533 - DNA, 895 bp, Homo sapiens
  misc_feature 1..895: note = chr6:105405570-105406465
  misc_feature 1..895: note = hyper
  source 1..895: mol_type = genomic DNA
tttctctttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 94534 - DNA, 42 bp, Homo sapiens
  misc_feature 1..42: note = chr6:10541735-10541777
  misc_feature 1..42: note = hypo
  source 1..42: mol_type = genomic DNA
atttatattcctttggatctatgggatcgctgggtcaaattc

SEQ ID NO: 94535 - DNA, 139 bp, Homo sapiens; identical to SEQ ID NO: 30726
  misc_feature 1..139: note = chr6:105584077-105584216
  misc_feature 1..139: note = hyper
  source 1..139: mol_type = genomic DNA

SEQ ID NO: 94536 - DNA, 103 bp, Homo sapiens; identical to SEQ ID NO: 588
  misc_feature 1..103: note = chr6:105584217-105584320
  misc_feature 1..103: note = hyper
  source 1..103: mol_type = genomic DNA

SEQ ID NO: 94537 - DNA, 185 bp, Homo sapiens; identical to SEQ ID NO: 589
  misc_feature 1..185: note = chr6:105584366-105584551
  misc_feature 1..185: note = hyper
  source 1..185: mol_type = genomic DNA

SEQ ID NO: 94538 - DNA, 1082 bp, Homo sapiens
  misc_feature 1..1082: note = chr6:105584552-105585634
  misc_feature 1..1082: note = hyper
  source 1..1082: mol_type = genomic DNA
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcgccactgtttttgt

SEQ ID NO: 94539 - DNA, 715 bp, Homo sapiens
  misc_feature 1..715: note = chr6:105627368-105628083
  misc_feature 1..715: note = hyper
  source 1..715: mol_type = genomic DNA
tctgggaggaatattcgcccagaagcctctagggcatacgactcgcgttcttcaggggtcggcgcggataggaaccgcagcaaaggatcccctagacctccgagctgtgagcggcgacacagccgggaccccagaccccggaccccagggcgcggagttgaccggagccgggaagggagcggcgcgggcagcgcggggcagcgagacgcaagcgctcgcaggggtcggcggcccagcagaagccgcgcccgctaagttgcccgaagcggccgcgaggtgcgagggtgcggacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaacataca

SEQ ID NO: 94540 - DNA, 257 bp, Homo sapiens
  misc_feature 1..257: note = chr6:105750389-105750646
  misc_feature 1..257: note = hypo
  source 1..257: mol_type = genomic DNA
tcttcaggttctcctcgtgcttgctgggccagtggcgcaggcgcatgttttctcaggccgcaggtccaggggcttgtacctcttgcccttgtagaatttcctgaggttttctttgtgtgagtctggttaattacggtgagaacacgggcaatggaattgtggatgacacggatcttagagagcttggagaccgcgccgcctgtcagtggcgatgcgcagctgggacagctccaccttcaggtcgtccagctgtttga

SEQ ID NO: 94541 - DNA, 30 bp, Homo sapiens
  misc_feature 1..30: note = chr6:10591675-10591705
  misc_feature 1..30: note = hypo
  source 1..30: mol_type = genomic DNA
tcctgaaagaattagcgagccccactttat

SEQ ID NO: 94542 - DNA, 78 bp, Homo sapiens
  misc_feature 1..78: note = chr6:10595774-10595852
  misc_feature 1..78: note = hypo
  source 1..78: mol_type = genomic DNA
gctgggattacaggcgtgccactctgcccggccggttggttgggttgctttcttttcttaagccgtaccatgttccag

SEQ ID NO: 94543 - DNA, 42 bp, Homo sapiens
  misc_feature 1..42: note = chr6:106114044-106114086
  misc_feature 1..42: note = hypo
  source 1..42: mol_type = genomic DNA
taaaaattaaaactccggtcccgctcacgaggggtcggggcc

SEQ ID NO: 94544 - DNA, 473 bp, Homo sapiens; identical to SEQ ID NO: 30731
  misc_feature 1..473: note = chr6:106429003-106429476
  misc_feature 1..473: note = hyper
  source 1..473: mol_type = genomic DNA

SEQ ID NO: 94545 - DNA, 35 bp, Homo sapiens; identical to SEQ ID NO: 592
  misc_feature 1..35: note = chr6:106429589-106429624
  misc_feature 1..35: note = hyper
  source 1..35: mol_type = genomic DNA

SEQ ID NO: 94546 - DNA, 127 bp, Homo sapiens; identical to SEQ ID NO: 30733
  misc_feature 1..127: note = chr6:106434152-106434279
  misc_feature 1..127: note = hyper
  source 1..127: mol_type = genomic DNA

SEQ ID NO: 94547 - DNA, 1307 bp, Homo sapiens; identical to SEQ ID NO: 30734
  misc_feature 1..1307: note = chr6:106441813-106443120
  misc_feature 1..1307: note = hyper
  source 1..1307: mol_type = genomic DNA

SEQ ID NO: 94548 - DNA, 30 bp, Homo sapiens
  misc_feature 1..30: note = chr6:106534045-106534075
  misc_feature 1..30: note = hyper
  source 1..30: mol_type = genomic DNA
gttgaaatacacatgcgaagagaggaagct

SEQ ID NO: 94549 - DNA, 30 bp, Homo sapiens
  misc_feature 1..30: note = chr6:10659521-10659551
  misc_feature 1..30: note = hypo
  source 1..30: mol_type = genomic DNA
aagggaaggaggggccgggcgaggtggcta

SEQ ID NO: 94550 - DNA, 329 bp, Homo sapiens
  misc_feature 1..329: note = chr6:106808855-106809184
  misc_feature 1..329: note = hyper
  source 1..329: mol_type = genomic DNA
accttccacctctggcgctccaaaaagaagcagcagccggcgccgcctgactgtggggtgttcgttccgcacccgctcccggcgcctgccggagaggccaggtgagctcctcgcccgagccctccagtcccacctcctcctcctcctccttctcctgctgcgctagcccttggactcctgaccccacttggaggaggggaaagccccggggtctgtttcagtccgcaggagggtacccgggtccggaggggagcgatcgtagccgctggggttgacgaggttcctcgcggcttttggttcagaccaagcaccggcgagaggaacttgtg

SEQ ID NO: 94551 - DNA, 97 bp, Homo sapiens; identical to SEQ ID NO: 30736
  misc_feature 1..97: note = chr6:106958240-106958337
  misc_feature 1..97: note = hyper
  source 1..97: mol_type = genomic DNA

SEQ ID NO: 94552 - DNA, 87 bp, Homo sapiens
  misc_feature 1..87: note = chr6:106959519-106959606
  misc_feature 1..87: note = hyper
  source 1..87: mol_type = genomic DNA
gcaaacggacacaagcgaggagggctccccgcgggagaatccccgagaggcagagggcgagctccccgagagcggtggccccgcagc

SEQ ID NO: 94553 - DNA, 107 bp, Homo sapiens
  misc_feature 1..107: note = chr6:106959939-106960046
  misc_feature 1..107: note = hyper
  source 1..107: mol_type = genomic DNA
ccccagtgtgtgtgccgaagaaggctccctggggccccgcaacgcccgcagccagccccccaagggcgcgtctgatttgccaggtgagcctccggccgagggcgcag

SEQ ID NO: 94554 - DNA, 715 bp, Homo sapiens
  misc_feature 1..715: note = chr6:106960308-106961023
  misc_feature 1..715: note = hyper
  source 1..715: mol_type = genomic DNA
gagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaa

SEQ ID NO: 94555 - DNA, 44 bp, Homo sapiens; identical to SEQ ID NO: 40866
  misc_feature 1..44: note = chr6:107075561-107075605
  misc_feature 1..44: note = hypo
  source 1..44: mol_type = genomic DNA

SEQ ID NO: 94556 - DNA, 41 bp, Homo sapiens
  misc_feature 1..41: note = chr6:10776289-10776330
  misc_feature 1..41: note = hypo
  source 1..41: mol_type = genomic DNA
agattacaggtgtaagccaccacacccgacccaacatgaca

SEQ ID NO: 94557 - DNA, 332 bp, Homo sapiens
  misc_feature 1..332: note = chr6:107809976-107810308
  misc_feature 1..332: note = hyper
  source 1..332: mol_type = genomic DNA
ccaccactgtcataacgaacactccacagtaacatgcagtggaacaatggacacccccatatcgcattgtgtcaggtaattatgaagtgtcgaggcgcgggaaggagaagccgggaacgtcaatgtgtcctctgcaacgtgtgggagcgctcagagccgcgcgtatcacagaaacatcatccagtcgtcacccccaatgcctcaacccagggacagggacagactcaatcagacctcggccccaggcgtggcaggagagggccaaagaggggacttgtgagcgcagagggagcgagcaccgctccatggagggcaggcgctagctgggaagt

SEQ ID NO: 94558 - DNA, 43 bp, Homo sapiens
  misc_feature 1..43: note = chr6:107810622-107810665
  misc_feature 1..43: note = hyper
  source 1..43: mol_type = genomic DNA
attgccattgcagtccgaggcagcgccgcgtggaggaccggcc

SEQ ID NO: 94559 - DNA, 126 bp, Homo sapiens
  misc_feature 1..126: note = chr6:107812382-107812508
  misc_feature 1..126: note = hyper
  source 1..126: mol_type = genomic DNA
ccaaccaaccagctgcgacggcgtgaagagcccgtcagtgcccggcgagctgcggcccgagaggcgcgggtctgggcacggtcctgaccgctctcctcgcccgcccccgcccgcacctcaccactg

SEQ ID NO: 94560 - DNA, 165 bp, Homo sapiens
  misc_feature 1..165: note = chr6:107886594-107886759
  misc_feature 1..165: note = hypo
  source 1..165: mol_type = genomic DNA
catggtagagttctacgttgctccacctcttcgtggaatccagtacaaggcaggtgcaaaggattggacccagattgcatgataggtggatggagtgggtgtgtggcggctggggagggacgggggtgggcggagagagaaagagagagacgtaaagctgaccca

SEQ ID NO: 94561 - DNA, 88 bp, Homo sapiens
  misc_feature 1..88: note = chr6:108274499-108274587
  misc_feature 1..88: note = hypo
  source 1..88: mol_type = genomic DNA
cccaaaactgtactacgggggtcctcatcttttacttaaaatccttaagaacaaatgtgcttcagaatttttcagatttgccccgtcc

SEQ ID NO: 94562 - DNA, 80 bp, Homo sapiens
  misc_feature 1..80: note = chr6:108280340-108280420
  misc_feature 1..80: note = hypo
  source 1..80: mol_type = genomic DNA
tctccactgggcgacagatttgaatctacgctgtgcccatcttgcagatgaagatttccccaagccgttacagatggttc

SEQ ID NO: 94563 - DNA, 179 bp, Homo sapiens
  misc_feature 1..179: note = chr6:108323266-108323445
  misc_feature 1..179: note = hypo
  source 1..179: mol_type = genomic DNA
atggggggcagaaaacgctcaatttccaacatgggggaaattcaacaagacgccataggctagggcgtatctaagttaggtactggaagaatttcaaaggcaaagactggaaagaacagtgtgtggcaggacagattttgaatttcaacctctctaccatctctcgcagaactttcaat

SEQ ID NO: 94564 - DNA, 324 bp, Homo sapiens
  misc_feature 1..324: note = chr6:108434925-108435249
  misc_feature 1..324: note = hyper
  source 1..324: mol_type = genomic DNA
aggtgtgggagatgccgtggtcagcccaagggcgagatgcgcctcggggtcggagtcgcccgagtggagactggacactccatgggggaggctggaaccccctgtgccacagataaatgctcgttctccaccacatgtgaggcatttgaataggagcaagtctcccgggttgggaatactaggaagtgctgggggacaggcaaggtcacggcatccaggctgcaatgcaaatgcctaggtagtgcgcacggcagcggtaatccagaatcctgcccaaagagggtcccgcaatcaccgcccacttccaggcgggcttggggagcc

SEQ ID NO: 94565 - DNA, 795 bp, Homo sapiens
  misc_feature 1..795: note = chr6:108436034-108436829
  misc_feature 1..795: note = hyper
  source 1..795: mol_type = genomic DNA
cagcccttccccccacgtgtcattaaaaaaaaaaaaaaggcttagcctgcctgcgatttccaacttctctttccacggatcgaccgcggccttggcaaggacttgagtctgcgttccagccccttccgctcccagcgcgcacgcagcctctcgcctttgcgtcggcgggttgctggttgccggtacccgctcagcagctaggagccttggggaaccctagctcttagcttccccgtctggcgaggccagagggccaagttgctcactgggctgtgctgagggataaggggagaaaagaacggaaatcgcagctacgagggctagagggacggcgcggctgcttgaggacgggtcgcctagcggtgggcgagtagggctgtgcgtaaaaggatctagacagacagtcgtgcgcccgcagggttgcaggacaggggcaggccgagttgtggcgcgtgtgtgtttgtgtgtgctcgcctccgggttgcgcgctttcagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcccactctacccgagacgaaactcagagccgaggtgggggcgaa

SEQ ID NO: 94566 - DNA, 50 bp, Homo sapiens
  misc_feature 1..50: note = chr6:108438107-108438157
  misc_feature 1..50: note = hyper
  source 1..50: mol_type = genomic DNA
cactcccgccctctacgacgtcctccctggcccgggcagcccaactgggg

SEQ ID NO: 94567 - DNA, 317 bp, Homo sapiens; identical to SEQ ID NO: 30743
  misc_feature 1..317: note = chr6:108438260-108438577
  misc_feature 1..317: note = hyper
  source 1..317: mol_type = genomic DNA

SEQ ID NO: 94568 - DNA, 98 bp, Homo sapiens; identical to SEQ ID NO: 30744
  misc_feature 1..98: note = chr6:108438779-108438877
  misc_feature 1..98: note = hyper
  source 1..98: mol_type = genomic DNA

SEQ ID NO: 94569 - DNA, 1150 bp, Homo sapiens; identical to SEQ ID NO: 30745
  misc_feature 1..1150: note = chr6:108439495-108440645
  misc_feature 1..1150: note = hyper
  source 1..1150: mol_type = genomic DNA

SEQ ID NO: 94570 - DNA, 415 bp, Homo sapiens
  misc_feature 1..415: note = chr6:108440744-108441159
  misc_feature 1..415: note = hyper
  source 1..415: mol_type = genomic DNA
cgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtgttacaggcaggaggagggaaaactgagtccttcctgggatggggcaggaccctcacacgcaagaccccactgagctggactggcgcgggggcggatcccttctcccaaatgcttctgaatggcgcgcgacctggtcccctctgccacacggaccctgcgcgcacgccctggccctggcggcctctggggaca

SEQ ID NO: 94571 - DNA, 21 bp, Homo sapiens
  misc_feature 1..21: note = chr6:108475755-108475776
  misc_feature 1..21: note = hypo
  source 1..21: mol_type = genomic DNA
ttccatctggccaggcgcggt

SEQ ID NO: 94572 - DNA, 30 bp, Homo sapiens
  misc_feature 1..30: note = chr6:108478521-108478551
  misc_feature 1..30: note = hyper
  source 1..30: mol_type = genomic DNA
tgcgcttcccccagccgggtgccccagcct

SEQ ID NO: 94573 - DNA, 890 bp, Homo sapiens; identical to SEQ ID NO: 30747
  misc_feature 1..890: note = chr6:108478806-108479696
  misc_feature 1..890: note = hyper
  source 1..890: mol_type = genomic DNA

SEQ ID NO: 94574 - DNA, 324 bp, Homo sapiens
  misc_feature 1..324: note = chr6:108484872-108485196
  misc_feature 1..324: note = hyper
  source 1..324: mol_type = genomic DNA
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcctttcgccagggctgaatggggtgtgtgtgtattccgtaggcatcttcttgacaccatgcttgatcggggactggtgaca

SEQ ID NO: 94575 - DNA, 494 bp, Homo sapiens; identical to SEQ ID NO: 2891
  misc_feature 1..494: note = chr6:108485513-108486007
  misc_feature 1..494: note = hyper
  source 1..494: mol_type = genomic DNA

SEQ ID NO: 94576 - DNA, 998 bp, Homo sapiens
  misc_feature 1..998: note = chr6:108486008-108487006
  misc_feature 1..998: note = hyper
  source 1..998: mol_type = genomic DNA
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcac

SEQ ID NO: 94577 - DNA, 405 bp, Homo sapiens
  misc_feature 1..405: note = chr6:108487077-108487482
  misc_feature 1..405: note = hyper
  source 1..405: mol_type = genomic DNA
cgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttcct

SEQ ID NO: 94578 - DNA, 819 bp, Homo sapiens
  misc_feature 1..819: note = chr6:108487779-108488598
  misc_feature 1..819: note = hyper
  source 1..819: mol_type = genomic DNA
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagc

SEQ ID NO: 94579 - DNA, 180 bp, Homo sapiens
  misc_feature 1..180: note = chr6:108488821-108489001
  misc_feature 1..180: note = hyper
  source 1..180: mol_type = genomic DNA
cggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttcc

SEQ ID NO: 94580 - DNA, 148 bp, Homo sapiens; identical to SEQ ID NO: 30755
  misc_feature 1..148: note = chr6:108489661-108489809
  misc_feature 1..148: note = hyper
  source 1..148: mol_type = genomic DNA

SEQ ID NO: 94581 - DNA, 180 bp, Homo sapiens; identical to SEQ ID NO: 600
  misc_feature 1..180: note = chr6:108490066-108490246
  misc_feature 1..180: note = hyper
  source 1..180: mol_type = genomic DNA

SEQ ID NO: 94582 - DNA, 219 bp, Homo sapiens; identical to SEQ ID NO: 601
  misc_feature 1..219: note = chr6:108490296-108490515
  misc_feature 1..219: note = hyper
  source 1..219: mol_type = genomic DNA

SEQ ID NO: 94583 - DNA, 464 bp, Homo sapiens; identical to SEQ ID NO: 30758
  misc_feature 1..464: note = chr6:108490537-108491001
  misc_feature 1..464: note = hyper
  source 1..464: mol_type = genomic DNA

SEQ ID NO: 94584 - DNA, 339 bp, Homo sapiens
  misc_feature 1..339: note = chr6:108491107-108491446
  misc_feature 1..339: note = hyper
  source 1..339: mol_type = genomic DNA
cgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaac

SEQ ID NO: 94585 - DNA, 346 bp, Homo sapiens
  misc_feature 1..346: note = chr6:108492203-108492549
  misc_feature 1..346: note = hyper
  source 1..346: mol_type = genomic DNA
atccctggttccagccgtgtttgtttttcttcttttcccttttacatttcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgctaatccctt

SEQ ID NO: 94586 - DNA, 179 bp, Homo sapiens; identical to SEQ ID NO: 30761
  misc_feature 1..179: note = chr6:108495639-108495818
  misc_feature 1..179: note = hyper
  source 1..179: mol_type = genomic DNA

SEQ ID NO: 94587 - DNA, 551 bp, Homo sapiens; identical to SEQ ID NO: 603
  misc_feature 1..551: note = chr6:108495915-108496466
  misc_feature 1..551: note = hyper
  source 1..551: mol_type = genomic DNA

SEQ ID NO: 94588 - DNA, 342 bp, Homo sapiens
  misc_feature 1..342: note = chr6:108497125-108497467
  misc_feature 1..342: note = hyper
  source 1..342: mol_type = genomic DNA
tttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatc

SEQ ID NO: 94589 - DNA, 386 bp, Homo sapiens; identical to SEQ ID NO: 30309
  misc_feature 1..386: note = chr6:10881854-10882240
  misc_feature 1..386: note = hyper
  source 1..386: mol_type = genomic DNA

SEQ ID NO: 94590 - DNA, 172 bp, Homo sapiens
  misc_feature 1..172: note = chr6:10882241-10882413
  misc_feature 1..172: note = hyper
  source 1..172: mol_type = genomic DNA
gtgctgaacgttctccacccgaacggcagcatcgacctctggcagctgccccctcctttataaagatatacctccggggggctccgccctgtctcgcctacctcgctagcgcccacgctccaggggccggtcgccccctccaccacagtcccaggaacggaggtggaggtta

SEQ ID NO: 94591 - DNA, 15 bp, Homo sapiens
  misc_feature 1..15: note = chr6:10883008-10883023
  misc_feature 1..15: note = hyper
  source 1..15: mol_type = genomic DNA
ttgggcctccactgc

SEQ ID NO: 94592 - DNA, 279 bp, Homo sapiens
  misc_feature 1..279: note = chr6:10883114-10883393
  misc_feature 1..279: note = hyper
  source 1..279: mol_type = genomic DNA
cgagcccaggcgccttcacgctcccggggacttcggagggacctggccctgcaggaacggagtcctacaaagtgaacctggaggaggtggggggcggaaatgagcccggggtaggtgggagcctggggtaggtgggagcctggggaaggagggaaaggggagaggggaaaagtcccaaagaactcgctttctccactgctttggctccctctgggtctcagcttccttatctgtttatctgttaaataagaggttgtggttcggcgagctctcagttgc

SEQ ID NO: 94593 - DNA, 268 bp, Homo sapiens; identical to SEQ ID NO: 30313
  misc_feature 1..268: note = chr6:10886917-10887185
  misc_feature 1..268: note = hyper
  source 1..268: mol_type = genomic DNA

SEQ ID NO: 94594 - DNA, 530 bp, Homo sapiens; identical to SEQ ID NO: 30314
  misc_feature 1..530: note = chr6:10887186-10887716
  misc_feature 1..530: note = hyper
  source 1..530: mol_type = genomic DNA

SEQ ID NO: 94595 - DNA, 131 bp, Homo sapiens
  misc_feature 1..131: note = chr6:109038572-109038703
  misc_feature 1..131: note = hypo
  source 1..131: mol_type = genomic DNA
aaggctgccctgacccgaagagggtgcccgaggcttcggtgtgctgaggccggggcagctgctggacttcgggtcttcggtgcggaccctggacctgcctcagatccgttcctagccgcccctctgctctg

SEQ ID NO: 94596 - DNA, 24 bp, Homo sapiens
  misc_feature 1..24: note = chr6:109057736-109057760
  misc_feature 1..24: note = hypo
  source 1..24: mol_type = genomic DNA
tgttaggaatattctcggcccggt

SEQ ID NO: 94597 - DNA, 82 bp, Homo sapiens; identical to SEQ ID NO: 14879
  misc_feature 1..82: note = chr6:109059835-109059917
  misc_feature 1..82: note = hypo
  source 1..82: mol_type = genomic DNA

SEQ ID NO: 94598 - DNA, 39 bp, Homo sapiens
  misc_feature 1..39: note = chr6:109578459-109578498
  misc_feature 1..39: note = hypo
  source 1..39: mol_type = genomic DNA
attacaagtgtgagccactgtgcccggcctgtatagtct

SEQ ID NO: 94599 - DNA, 139 bp, Homo sapiens
  misc_feature 1..139: note = chr6:110299095-110299234
  misc_feature 1..139: note = hyper
  source 1..139: mol_type = genomic DNA
aacctcccccttctccggggtttcttttttgacctgatccctcagtgatctttgacgctgggctttgctgcccggcaggtgtcactcatccttcacccctcccctcccagctcaccctcttcgccgcctggtctcaggg

SEQ ID NO: 94600 - DNA, 193 bp, Homo sapiens
  misc_feature 1..193: note = chr6:110299501-110299694
  misc_feature 1..193: note = hyper
  source 1..193: mol_type = genomic DNA
actgtatctctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccaggtgagtggccgagttcccagggaa

SEQ ID NO: 94601 - DNA, 30 bp, Homo sapiens; identical to SEQ ID NO: 30765
  misc_feature 1..30: note = chr6:110299948-110299978
  misc_feature 1..30: note = hyper
  source 1..30: mol_type = genomic DNA

SEQ ID NO: 94602 - DNA, 405 bp, Homo sapiens
  misc_feature 1..405: note = chr6:11043701-11044106
  misc_feature 1..405: note = hyper
  source 1..405: mol_type = genomic DNA
cacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 94603 - DNA, 434 bp, Homo sapiens; identical to SEQ ID NO: 30316
  misc_feature 1..434: note = chr6:11044107-11044541
  misc_feature 1..434: note = hyper
  source 1..434: mol_type = genomic DNA

SEQ ID NO: 94604 - DNA, 388 bp, Homo sapiens
  misc_feature 1..388: note = chr6:11044542-11044930
  misc_feature 1..388: note = hyper
  source 1..388: mol_type = genomic DNA
ctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaatacccacccgctgcccagatcgg

SEQ ID NO: 94605 - DNA, 526 bp, Homo sapiens
  misc_feature 1..526: note = chr6:110678874-110679400
  misc_feature 1..526: note = hyper
  source 1..526: mol_type = genomic DNA
cttcttcacgggatgcgcggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 94606 - DNA, 342 bp, Homo sapiens
  misc_feature 1..342: note = chr6:110679401-110679743
  misc_feature 1..342: note = hyper
  source 1..342: mol_type = genomic DNA
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggccctctccgcccctccggaggtgccagggcccggctgtacagggtc

SEQ ID NO: 94607 - DNA, 325 bp, Homo sapiens
  misc_feature 1..325: note = chr6:110797490-110797815
  misc_feature 1..325: note = hyper
  source 1..325: mol_type = genomic DNA
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctcccccatacctgccgaagtgccccacgtggtcataaatcccctcgaagtggcgggaccccatggtgcggccgtgcactgggcgccgagttagccgagctc

SEQ ID NO: 94608 - DNA, 52 bp, Homo sapiens
  misc_feature 1..52: note = chr6:111409316-111409368
  misc_feature 1..52: note = hyper
  source 1..52: mol_type = genomic DNA
cgaggccagcctgggcgacccgcgtggggcccccgagcgcatcccgcgtgtg

SEQ ID NO: 94609 - DNA, 217 bp, Homo sapiens; identical to SEQ ID NO: 30769
  misc_feature 1..217: note = chr6:111409641-111409858
  misc_feature 1..217: note = hyper
  source 1..217: mol_type = genomic DNA

SEQ ID NO: 94610 - DNA, 16 bp, Homo sapiens
  misc_feature 1..16: note = chr6:111581391-111581407
  misc_feature 1..16: note = hypo
  source 1..16: mol_type = genomic DNA
gcgtgagccacggcgc

SEQ ID NO: 94611 - DNA, 30 bp, Homo sapiens
  misc_feature 1..30: note = chr6:111874444-111874474
  misc_feature 1..30: note = hypo
  source 1..30: mol_type = genomic DNA
tatgctaaagtgcctcgtgcagcctccctc

SEQ ID NO: 94612 - DNA, 30 bp, Homo sapiens
  misc_feature 1..30: note = chr6:11288375-11288405
  misc_feature 1..30: note = hypo
  source 1..30: mol_type = genomic DNA
gctcagtcaaaattacgcaggctggttcag

SEQ ID NO: 94613 - DNA, 53 bp, Homo sapiens
  misc_feature 1..53: note = chr6:114177562-114177615
  misc_feature 1..53: note = hyper
  source 1..53: mol_type = genomic DNA
caaaaagagtccattcgattctggcagtaggctgaaaacgatccatattgacg

SEQ ID NO: 94614 - DNA, 872 bp, Homo sapiens
  misc_feature 1..872: note = chr6:114663003-114663875
  misc_feature 1..872: note = hyper
  source 1..872: mol_type = genomic DNA
ggcgagcgcagtaaacgcgtgttccctttctccctcaaagagagcgctacccagcgctctgggagagactgagagagaaacagacaggcaggctgactgacaccttctgtctaattttaccccaggaattgcccccgccgtttctcatctcgcactagtttaacctctggtcctaagcaaacctctcaaaagtcttccccaggcagcgcccaggagaaccgaaccccacaaagtgcttttttgctggcatcacccggatgcttccctttggcgatttgccccttctcatttccccccaaatctagaggtctcaaagcccctcccccgcgcgaggcgggcagcgcgccttgctcaccgtggtccccggcggtggcggcgcgggcgggagcctcagggcgcgggggtcggcggcgggtcgcgtgggggtcacccggccgctgctgcggtccggacggcagttggtccagtagtttcggatgcccgggctaggctcggcggagagcgagtcggcgtgaatgagagcaaaccaacagggctgtgcgtggcgcgtgtgagtaagacgcgagcgggccccacacgcaggcggcggcggcggcggcggcggcggcgaggtctgaggcggggagccgggcgggggggcaggcgggcgagaagtagtggagtttagggcgcgtttcctgcacttccccgagaggctggaaccaggtgcggcagggcgcgctcccgtggcgcgggcacggcacgggcggccgcaggagccggagtccgcgcagtgccggagaccgcagccgctctgcggggggaggtgcgcatcctccttgccccacgagggcaccggcgcagccccggaccctgcgcgcagagggcgagac

SEQ ID NO: 94615 - DNA, 268 bp, Homo sapiens
  misc_feature 1..268: note = chr6:114664337-114664605
  misc_feature 1..268: note = hyper
  source 1..268: mol_type = genomic DNA
gggtggggaaggaagcgcaggtgtcttcggcggagagacgggcgcacgcaccggagcggcttgctgcagggggagggcagggccttaggcggagaaaggggaggaggaggatttacccggaggcggaggtcccgcagctgagccactgcgcgtcccacccaggcgctggaaccgcgggcgagcagcgcagtggggctgccgggtgggcgcgcagggctcccagttggactgaggtcgcagcttggggaacctgcggaggtgaccaggg

SEQ ID NO: 94616 - DNA, 137 bp, Homo sapiens; identical to SEQ ID NO: 40872
  misc_feature 1..137: note = chr6:116574057-116574194
  misc_feature 1..137: note = hypo
  source 1..137: mol_type = genomic DNA

SEQ ID NO: 94617 - DNA, 61 bp, Homo sapiens
  misc_feature 1..61: note = chr6:116783506-116783567
  misc_feature 1..61: note = hyper
  source 1..61: mol_type = genomic DNA
tgcctcggccgcaaccgcagctgcgccgcggagctgccgctggtgccgtgcaaccaggcca

SEQ ID NO: 94618 - DNA, 158 bp, Homo sapiens
  misc_feature 1..158: note = chr6:116937904-116938062
  misc_feature 1..158: note = hyper
  source 1..158: mol_type = genomic DNA
ctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcc

SEQ ID NO: 94619 - DNA, 30 bp, Homo sapiens
  misc_feature 1..30: note = chr6:117001154-117001184
  misc_feature 1..30: note = hypo
  source 1..30: mol_type = genomic DNA
actcatgattggcaacgctttctggtaaca

SEQ ID NO: 94620 - DNA, 283 bp, Homo sapiens
  misc_feature 1..283: note = chr6:117086196-117086479
  misc_feature 1..283: note = hyper
  source 1..283: mol_type = genomic DNA
tgttggcactgcggccgctttcgctcctaggtggccgcggtcggaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 94621 - DNA, 160 bp, Homo sapiens; identical to SEQ ID NO: 605
  misc_feature 1..160: note = chr6:117086480-117086640
  misc_feature 1..160: note = hyper
  source 1..160: mol_type = genomic DNA

SEQ ID NO: 94622 - DNA, 21 bp, Homo sapiens
  misc_feature 1..21: note = chr6:117089618-117089639
  misc_feature 1..21: note = hypo
  source 1..21: mol_type = genomic DNA
ccaccacgcctagccagcaca

SEQ ID NO: 94623 - DNA, 74 bp, Homo sapiens
  misc_feature 1..74: note = chr6:117197631-117197705
  misc_feature 1..74: note = hyper
  source 1..74: mol_type = genomic DNA
acttaagcaaacgtccgttgccgtactgctaggtatgagatgagtaatcgtcagggacgcgtttaaattacaaa

SEQ ID NO: 94624 - DNA, 84 bp, Homo sapiens
  misc_feature 1..84: note = chr6:117198137-117198221
  misc_feature 1..84: note = hyper
  source 1..84: mol_type = genomic DNA
tgtgggcgcccagggcgtgacaggcgcaggtgagaaagtgagtttcgcgggagcatctgccgggaccgcagacaggtggagaaa

SEQ ID NO: 94625 - DNA, 30 bp, Homo sapiens; identical to SEQ ID NO: 30778
  misc_feature 1..30: note = chr6:117198544-117198574
  misc_feature 1..30: note = hyper
  source 1..30: mol_type = genomic DNA

SEQ ID NO: 94626 - DNA, 798 bp, Homo sapiens
  misc_feature 1..798: note = chr6:117585846-117586644
  misc_feature 1..798: note = hyper
  source 1..798: mol_type = genomic DNA
aactttaaaggaccccggccaaggagaccccagcatgaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggtacccggactcccacatcctgtctgccacgacccggactccctaggggattccaagggacagcaccgtcctccccatacatcatcaggaaccgaaagcagagaatttgccccacctcggcacttctggaagcacccactcaactacagtatgagacaagggctttcctaagagacctttctccaactttctttctctgcgtgtatgagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcc

SEQ ID NO: 94627 - DNA, 167 bp, Homo sapiens
  misc_feature 1..167: note = chr6:117587123-117587290
  misc_feature 1..167: note = hyper
  source 1..167: mol_type = genomic DNA
ggcgcagccgggatgcggggattgccggagccgcccccagttggtagtgcaattagctaacccctttagctcgcctgtttgctctcgggaagcagctaagccctgctaatgtgagcctaggtcttccctggaataatcagaggaagatggcacgggctggattttct

SEQ ID NO: 94628 - DNA, 101 bp, Homo sapiens
  misc_feature 1..101: note = chr6:117587547-117587648
  misc_feature 1..101: note = hyper
  source 1..101: mol_type = genomic DNA
tttcaaagagcaccgcgcagttttataattttttcctttgcgaagttctgggagcattatccggagtgcgaatgacccggcagaggcgagcctgatagaca

SEQ ID NO: 94629 - DNA, 461 bp, Homo sapiens
  misc_feature 1..461: note = chr6:117591136-117591597
  misc_feature 1..461: note = hyper
  source 1..461: mol_type = genomic DNA
gacttcaaaatatgtcgatggactttcagtctgtcagagacgttaggtggtggggggcacattttctggagcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcc

SEQ ID NO: 94630 - DNA, 524 bp, Homo sapiens
  misc_feature 1..524: note = chr6:117591683-117592207
  misc_feature 1..524: note = hyper
  source 1..524: mol_type = genomic DNA
cgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtct

SEQ ID NO: 94631 - DNA, 20 bp, Homo sapiens
  misc_feature 1..20: note = chr6:117913241-117913261
  misc_feature 1..20: note = hypo
  source 1..20: mol_type = genomic DNA
gcacaaggctgggcacggtg

SEQ ID NO: 94632 - DNA, 30 bp, Homo sapiens; identical to SEQ ID NO: 40873
  misc_feature 1..30: note = chr6:118113403-118113433
  misc_feature 1..30: note = hypo
  source 1..30: mol_type = genomic DNA

SEQ ID NO: 94633 - DNA, 237 bp, Homo sapiens
  misc_feature 1..237: note = chr6:118227995-118228232
  misc_feature 1..237: note = hyper
  source 1..237: mol_type = genomic DNA
ccaggccaattatggcgaatgtagtaggagcaacatctaggattctccgtttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 94634 - DNA, 546 bp, Homo sapiens; identical to SEQ ID NO: 30787
  misc_feature 1..546: note = chr6:118228323-118228869
  misc_feature 1..546: note = hyper
  source 1..546: mol_type = genomic DNA

SEQ ID NO: 94635 - DNA, 520 bp, Homo sapiens; identical to SEQ ID NO: 30788
  misc_feature 1..520: note = chr6:118228870-118229390
  misc_feature 1..520: note = hyper
  source 1..520: mol_type = genomic DNA

SEQ ID NO: 94636 - DNA, 157 bp, Homo sapiens
  misc_feature 1..157: note = chr6:118229416-118229573
  misc_feature 1..157: note = hyper
  source 1..157: mol_type = genomic DNA
cggggggacgcggggacccggccagggctgaggagggaggcgcggggctgcagagatggcgtggaagtcctgggcctcgtgctgtcctccgccccgccccgcccgggggcttcgaccccttgccgggggaatggggtcgcagcgacagcctagcagg

SEQ ID NO: 94637 - DNA, 116 bp, Homo sapiens
  misc_feature 1..116: note = chr6:118229616-118229732
  misc_feature 1..116: note = hyper
  source 1..116: mol_type = genomic DNA
cggactcttcctggctgggagcagcgaagagagggctagaggcctggaacagacccagcaaagtgcaaaacattgcgggcagggtgtgagccggcggcgcccagttattccgaagc

SEQ ID NO: 94638 - DNA, 117 bp, Homo sapiens; identical to SEQ ID NO: 30790
  misc_feature 1..117: note = chr6:118229733-118229850
  misc_feature 1..117: note = hyper
  source 1..117: mol_type = genomic DNA

SEQ ID NO: 94639 - DNA, 304 bp, Homo sapiens; identical to SEQ ID NO: 30791
  misc_feature 1..304: note = chr6:118241005-118241309
  misc_feature 1..304: note = hyper
  source 1..304: mol_type = genomic DNA

SEQ ID NO: 94640 - DNA, 132 bp, Homo sapiens
  misc_feature 1..132: note = chr6:118241394-118241526
  misc_feature 1..132: note = hyper
  source 1..132: mol_type = genomic DNA
cggggcttgggtggtggctggaaaagggagaaccaggaggcgggggaggggcgctcggactacagaggaccggacgggggcgagtgttccgcggggtgtgtggagtaagagctgggacggacctttgtagct

SEQ ID NO: 94641 - DNA, 143 bp, Homo sapiens
  misc_feature 1..143: note = chr6:118971559-118971702
  misc_feature 1..143: note = hyper
  source 1..143: mol_type = genomic DNA
tacacaacttctgagcgacgcaagcatgaaatggctgtccgatacaaacagaccccttcagatacggaatgcagcaaacccctaattttccttgaaggggccacggaaagccaaacggattcgtaacccggttgctcaatggt

SEQ ID NO: 94642 - DNA, 152 bp, Homo sapiens
  misc_feature 1..152: note = chr6:119030526-119030678
  misc_feature 1..152: note = hyper
  source 1..152: mol_type = genomic DNA
ggagttgagtgtgtacgccagattgggaagtgacacatgctggcatttctcagcgcatgcggctccccactcggctttctggagctctgccttttggcgacagagcagctagagctcctctcccctcccccatttcctctcataaagataac

SEQ ID NO: 94643 - DNA, 30 bp, Homo sapiens; identical to SEQ ID NO: 40874
  misc_feature 1..30: note = chr6:119240714-119240744
  misc_feature 1..30: note = hypo
  source 1..30: mol_type = genomic DNA

SEQ ID NO: 94644 - DNA, 30 bp, Homo sapiens; identical to SEQ ID NO: 40875
  misc_feature 1..30: note = chr6:119254223-119254253
  misc_feature 1..30: note = hypo
  source 1..30: mol_type = genomic DNA

SEQ ID NO: 94645 - DNA, 149 bp, Homo sapiens
  misc_feature 1..149: note = chr6:119254660-119254809
  misc_feature 1..149: note = hypo
  source 1..149: mol_type = genomic DNA
ctccgcctcaaaaaaaaaaaaaaagagagaaacacttatttcgtttggaaagagattgaggactggagaagaggtgtacttaaatttgacttacttcatttgtccaacatttattgtactggactctacaaatacgaatattaaaggag

SEQ ID NO: 94646 - DNA, 543 bp, Homo sapiens
  misc_feature 1..543: note = chr6:119399076-119399619
  misc_feature 1..543: note = hyper
  source 1..543: mol_type = genomic DNA
ggtgcaagtcccttacgcgcaccgtgccgctgtgctgtctagcttaaattcatgttgccagcgttccaccaaagtttgcagggttttggaggtgtctccggctgttgcttcggcggaggagtagagttcccctcgctgcgggcgcagggcgcactgcctcccggggagacaggtgagtccggcgcggcccgcacggggtcgccacctgccccgtcgctgccccccttaccttggtgagctgggcgattttcttgctcattttcaggtgcatctcctggctgtagtccatgctgtgcccagccagctgtgcggtggccggcgagggcgcgaatttggccgccgagccgccgtaatagtgctgctgccagctcatgcccggggtcgccatcttcccaacagaccccagccggggcacctgtccccgcgggtggaggcaggcccgtggagcaacgacgcccgggaggcaagagtcgcggcggccgcttcccgacccgacacccggcgccccccagactcggccgcaggcgccgtcccacccgcgac

SEQ ID NO: 94647 - DNA, 36 bp, Homo sapiens
  misc_feature 1..36: note = chr6:119510906-119510942
  misc_feature 1..36: note = hypo
  source 1..36: mol_type = genomic DNA
gagctgcatcagccccgagtgcgaacatgccccccg

SEQ ID NO: 94648 - DNA, 157 bp, Homo sapiens
  misc_feature 1..157: note = chr6:119527110-119527267
  misc_feature 1..157: note = hypo
  source 1..157: mol_type = genomic DNA
acacatgatgaatgccgagataaatgtgtgaagagttctctgagcatctaaagctgggacacacaatccagcgtagtggggatggatcacagaagacttcttcaaggaagagactcctgagttgattcttgaagggcaagtacgagttggtgaggaa

SEQ ID NO: 94649 - DNA, 45 bp, Homo sapiens
  misc_feature 1..45: note = chr6:119538695-119538740
  misc_feature 1..45: note = hypo
  source 1..45: mol_type = genomic DNA
cggcctcccaaaggcgtgagccactgcgctcggcagcaaatggaa

SEQ ID NO: 94650 - DNA, 20 bp, Homo sapiens
  misc_feature 1..20: note = chr6:119560062-119560082
  misc_feature 1..20: note = hypo
  source 1..20: mol_type = genomic DNA
ttattatttttgagacggag

SEQ ID NO: 94651 - DNA, 32 bp, Homo sapiens
  misc_feature 1..32: note = chr6:119584473-119584505
  misc_feature 1..32: note = hypo
  source 1..32: mol_type = genomic DNA
ctgtccctctaagagcgccctaactaatacaa

SEQ ID NO: 94652 - DNA, 147 bp, Homo sapiens
  misc_feature 1..147: note = chr6:119590025-119590172
  misc_feature 1..147: note = hypo
  source 1..147: mol_type = genomic DNA
gtaagccaatgtgcccggccctcatttttctaaaacaactctctcatgaacgagtaggccatagacaaactacgcctgaacaattcttagagtcatttaaagtaacaatatagaaaggcagttgaataatgccgtttccttaccccc

SEQ ID NO: 94653 - DNA, 151 bp, Homo sapiens
  misc_feature 1..151: note = chr6:119604968-119605119
  misc_feature 1..151: note = hypo
  source 1..151: mol_type = genomic DNA
taggccaaatcaaaacgactcaacttttaaggccacatggaccagtggtggtttgcaagaagactgtgtggagtgatgacaactttccttagtgccacagtggggaagagactgaagaggggagacgctggcagtacgaaggtcagttgga

SEQ ID NO: 94654 - DNA, 42 bp, Homo sapiens; identical to SEQ ID NO: 40878
  misc_feature 1..42: note = chr6:119689647-119689689
  misc_feature 1..42: note = hypo
  source 1..42: mol_type = genomic DNA

SEQ ID NO: 94655 - DNA, 30 bp, Homo sapiens
  misc_feature 1..30: note = chr6:119714970-119715000
  misc_feature 1..30: note = hypo
  source 1..30: mol_type = genomic DNA
aggatgtttccctgacgccttcccaggtgg

SEQ ID NO: 94656 - DNA, 30 bp, Homo sapiens; identical to SEQ ID NO: 40879
  misc_feature 1..30: note = chr6:119824210-119824240
  misc_feature 1..30: note = hypo
  source 1..30: mol_type = genomic DNA

SEQ ID NO: 94657 - DNA, 30 bp, Homo sapiens
  misc_feature 1..30: note = chr6:119849249-119849279
  misc_feature 1..30: note = hypo
  source 1..30: mol_type = genomic DNA
gaataaatgagataacgttatgtaagagag

SEQ ID NO: 94658 - DNA, 280 bp, Homo sapiens
  misc_feature 1..280: note = chr6:119888178-119888458
  misc_feature 1..280: note = hypo
  source 1..280: mol_type = genomic DNA
tataaaatccggtgcactctgctgcaggccggaattcccagtccggcgtccctctctctcgcaagagagagagtcgttctcctttctctttcttttgactattatatatctgctctgaaactcactacctgcgtgtgctccttccctaattttcttggcgcgagataacgaacctcgggtatttaccccagacaaagatgcggctgcactactctctttcagtctggtcatgcacattaacgtattataactctgagaatttcttcgtaaaacacttatt

SEQ ID NO: 94659 - DNA, 45 bp, Homo sapiens
  misc_feature 1..45: note = chr6:119958265-119958310
  misc_feature 1..45: note = hypo
  source 1..45: mol_type = genomic DNA
aaaattacatgatgccgggtgcggtggctcacgcctgtaatccca

SEQ ID NO: 94660 - DNA, 30 bp, Homo sapiens; identical to SEQ ID NO: 40882
  misc_feature 1..30: note = chr6:119989053-119989083
  misc_feature 1..30: note = hypo
  source 1..30: mol_type = genomic DNA

SEQ ID NO: 94661 - DNA, 30 bp, Homo sapiens
  misc_feature 1..30: note = chr6:121193323-121193353
  misc_feature 1..30: note = hypo
  source 1..30: mol_type = genomic DNA
cacccagggcagcaccgacacaccagtccc

SEQ ID NO: 94662 - DNA, 29 bp, Homo sapiens
  misc_feature 1..29: note = chr6:121370472-121370501
  misc_feature 1..29: note = hypo
  source 1..29: mol_type = genomic DNA
tgctggccagatcccgcaataataaataa

SEQ ID NO: 94663 - DNA, 30 bp, Homo sapiens
  misc_feature 1..30: note = chr6:121654694-121654724
  misc_feature 1..30: note = hypo
  source 1..30: mol_type = genomic DNA
agtgagtaattcgtgcggccacttaaaata

SEQ ID NO: 94664 - DNA, 57 bp, Homo sapiens
  misc_feature 1..57: note = chr6:121758249-121758306
  misc_feature 1..57: note = hyper
  source 1..57: mol_type = genomic DNA
ctcctgccatcttagcgtctgccgggatccttcccgcgccttcgctgcccgaaccag

SEQ ID NO: 94665 - DNA, 417 bp, Homo sapiens
  misc_feature 1..417: note = chr6:121758539-121758956
  misc_feature 1..417: note = hyper
  source 1..417: mol_type = genomic DNA
gaatcccactatctccgcgttggtaagaaaacctgaataccttgggaattgtgcttaaattgcacttgcaactcccctggaagttcctgaaacttcccgagaatgaggcggggcggctcaaggggaaagggcagggaggagagaccctcgggaagctgatgacgcgtccggggcaagtcagcctgtttccgagacgcgcgcctcacggtcgtagcagcgctgcgcccaccctgcccctttagtgacccagccagcctttgctgggggtttctgataacgctcatcgataagctctccttgctcccaaaaggcgtgcttctctttctctccaggtacaaagtaggggtgggaaggggagagctacacaatgttgtaaaaagaagcgtggctttatttggaagacggttgaatttcttt

SEQ ID NO: 94666 - DNA, 17 bp, Homo sapiens
  misc_feature 1..17: note = chr6:12194739-12194756
  misc_feature 1..17: note = hypo
  source 1..17: mol_type = genomic DNA
aaaggacaaacaggccg

SEQ ID NO: 94667 - DNA, 30 bp, Homo sapiens
  misc_feature 1..30: note = chr6:122021822-122021852
  misc_feature 1..30: note = hypo
  source 1..30: mol_type = genomic DNA
ggaaaatgaacagatcgtcaaagaaatatt

SEQ ID NO: 94668 - DNA, 48 bp, Homo sapiens
  misc_feature 1..48: note = chr6:12222846-12222894
  misc_feature 1..48: note = hypo
  source 1..48: mol_type = genomic DNA
aagcctaaccctgcccgggcctgtgtctgatggcgaggcttggtatat

SEQ ID NO: 94669 - DNA, 142 bp, Homo sapiens
  misc_feature 1..142: note = chr6:12287999-12288141
  misc_feature 1..142: note = hypo
  source 1..142: mol_type = genomic DNA
cgcgcgcaggcacacgtcttgcaaattcaggattcaaagagacaggggcaccattatatttggcacggtggggcccttccaggtctgaaatcctgcattcttccttactatttactttccccgagctcgagaagggccaggt

SEQ ID NO: 94670 - DNA, 349 bp, Homo sapiens; identical to SEQ ID NO: 40747
  misc_feature 1..349: note = chr6:12288379-12288728
  misc_feature 1..349: note = hypo
  source 1..349: mol_type = genomic DNA

SEQ ID NO: 94671 - DNA, 36 bp, Homo sapiens
  misc_feature 1..36: note = chr6:122931170-122931206
  misc_feature 1..36: note = hyper
  source 1..36: mol_type = genomic DNA
acagaaaacacgatgcgacgtcggaaagcaggaagg

SEQ ID NO: 94672 - DNA, 411 bp, Homo sapiens
  misc_feature 1..411: note = chr6:122932059-122932470
  misc_feature 1..411: note = hyper
  source 1..411: mol_type = genomic DNA
gtgcttaccaagccccgggtagtcacgagcggccgcggggttagcagagacccgagtactaacccgctcggccagcgtccggctgtgtggctttagccaagtcacctcacctcactggcctccgtccattctttggataaaatatggaggtgggtagaccgagtaaactcaagggtcgcccgtagctattggattttccctgctcctaggaccccggcaggccgcagggagggacacgagtgccaggtggtcgcgggctgagggagcggagggcctgtgttccggttggtgctgatgctagccccttggggaaattcctgaaggtgcatttcggagccaaatgaccctgccttgcagcaggtcccttccaagggagctgagagggccaggtcagaccggtcttcgtagagc

SEQ ID NO: 94673 - DNA, 114 bp, Homo sapiens; identical to SEQ ID NO: 30795
  misc_feature 1..114: note = chr6:123316893-123317007
  misc_feature 1..114: note = hyper
  source 1..114: mol_type = genomic DNA

SEQ ID NO: 94674 - DNA, 642 bp, Homo sapiens; identical to SEQ ID NO: 2911
  misc_feature 1..642: note = chr6:123317072-123317714
  misc_feature 1..642: note = hyper
  source 1..642: mol_type = genomic DNA

SEQ ID NO: 94675 - DNA, 198 bp, Homo sapiens
  misc_feature 1..198: note = chr6:123317715-123317913
  misc_feature 1..198: note = hyper
  source 1..198: mol_type = genomic DNA
gctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttctt

SEQ ID NO: 94676 - DNA, 30 bp, Homo sapiens
  misc_feature 1..30: note = chr6:124012649-124012679
  misc_feature 1..30: note = hypo
  source 1..30: mol_type = genomic DNA
tttttttttttgaaacggagtctcggctct

SEQ ID NO: 94677 - DNA, 793 bp, Homo sapiens
  misc_feature 1..793: note = chr6:124124293-124125086
  misc_feature 1..793: note = hyper
  source 1..793: mol_type = genomic DNA
gccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtgaggcgagcggcgcggagagcggcaggggcgaaacttcgcgggccagatgcccgagggcgcggcggcgctgccaggctgccgctgctgcccctgcgggccccgagcgcgcctccgcaggcgg

SEQ ID NO: 94678 - DNA, 79 bp, Homo sapiens
  misc_feature 1..79: note = chr6:124734409-124734488
  misc_feature 1..79: note = hypo
  source 1..79: mol_type = genomic DNA
ctctttttgtttaagaattgacgttcattcttttaagtatgcagattttcaattgttgtggcaccgtttattgaaaagc

SEQ ID NO: 94679 - DNA, 30 bp, Homo sapiens
  misc_feature 1..30: note = chr6:125013668-125013698
  misc_feature 1..30: note = hypo
  source 1..30: mol_type = genomic DNA
acgtaacatgagggccgggtgcggtggttc

SEQ ID NO: 94680 - DNA, 77 bp, Homo sapiens; identical to SEQ ID NO: 40885
  misc_feature 1..77: note = chr6:125081173-125081250
  misc_feature 1..77: note = hypo
  source 1..77: mol_type = genomic DNA

SEQ ID NO: 94681 - DNA, 20 bp, Homo sapiens
  misc_feature 1..20: note = chr6:125088325-125088345
  misc_feature 1..20: note = hypo
  source 1..20: mol_type = genomic DNA
caccgcgcccggccctattt

SEQ ID NO: 94682 - DNA, 61 bp, Homo sapiens; identical to SEQ ID NO: 30799
  misc_feature 1..61: note = chr6:125282732-125282793
  misc_feature 1..61: note = hyper
  source 1..61: mol_type = genomic DNA

SEQ ID NO: 94683 - DNA, 357 bp, Homo sapiens
  misc_feature 1..357: note = chr6:125283133-125283490
  misc_feature 1..357: note = hyper
  source 1..357: mol_type = genomic DNA
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggc

SEQ ID NO: 94684 - DNA, 705 bp, Homo sapiens
  misc_feature 1..705: note = chr6:125283600-125284305
  misc_feature 1..705: note = hyper
  source 1..705: mol_type = genomic DNA
cgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttcccc

SEQ ID NO: 94685 - DNA, 39 bp, Homo sapiens
  misc_feature 1..39: note = chr6:125286425-125286464
  misc_feature 1..39: note = hypo
  source 1..39: mol_type = genomic DNA
atacacattattggccgggtgcggtggctcacgcctgta

SEQ ID NO: 94686 - DNA, 162 bp, Homo sapiens
  misc_feature 1..162: note = chr6:125397724-125397886
  misc_feature 1..162: note = hypo
  source 1..162: mol_type = genomic DNA
gtttcataaaatttgcgattttgctttttaaaaactcagctaactctttccttctccttccctctcttgctgatacagatccacatccagcgaactgaaggatgtgaccatatgacctgctcacaatgtaacactaatttttgttaccgatgtggtgagaga

SEQ ID NO: 94687 - DNA, 366 bp, Homo sapiens
  misc_feature 1..366: note = chr6:125420809-125421175
  misc_feature 1..366: note = hyper
  source 1..366: mol_type = genomic DNA
gcgaaaaccttccttcgggaacgcggagctagtgcacgggggcatgttcttcccccgcagccctggcaagcagaggccggcggcctgtggcgcggggcagttgtgctggctgccgggcggggctgctctgggtctgggtgcacggagaggagcgcggagtgaagcgcacggtgcacactgcggggcgctgcttgtcacctccctgcccctccctctgccctcccccgctgtccggagcacagtcccgggagggcggatgtcccctgggaagatgcgcgaggagagcgactgggaggcagctagcagcacctgcgtgtgggcaacacgacccgaggctgtctccattgcctgcgtgctgaaagcata

SEQ ID NO: 94688 - DNA, 241 bp, Homo sapiens
  misc_feature 1..241: note = chr6:125474789-125475030
  misc_feature 1..241: note = hyper
  source 1..241: mol_type = genomic DNA
gttatgcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctggg

SEQ ID NO: 94689 - DNA, 43 bp, Homo sapiens; identical to SEQ ID NO: 30803
  misc_feature 1..43: note = chr6:125475547-125475590
  misc_feature 1..43: note = hyper
  source 1..43: mol_type = genomic DNA

SEQ ID NO: 94690 - DNA, 168 bp, Homo sapiens; identical to SEQ ID NO: 30804
  misc_feature 1..168: note = chr6:125684529-125684697
  misc_feature 1..168: note = hyper
  source 1..168: mol_type = genomic DNA

SEQ ID NO: 94691 - DNA, 29 bp, Homo sapiens
  misc_feature 1..29: note = chr6:125737982-125738011
  misc_feature 1..29: note = hypo
  source 1..29: mol_type = genomic DNA
atcctctcagccaggcgcagtggctcaca

SEQ ID NO: 94692 - DNA, 15 bp, Homo sapiens
  misc_feature 1..15: note = chr6:126068007-126068022
  misc_feature 1..15: note = hyper
  source 1..15: mol_type = genomic DNA
ctaagccttcccttt

SEQ ID NO: 94693 - DNA, 184 bp, Homo sapiens
  misc_feature 1..184: note = chr6:126068068-126068252
  misc_feature 1..184: note = hyper
  source 1..184: mol_type = genomic DNA
cgttccctcattctttctcttttctttctctccacataacgcctcccctacacctccccacctccaatccactaccgtatttaagtcggcgggggcgctttaaagggtttcctgtgtctgtttctgtctctctgacccgaaacgcactttcggttatagacagacaaggcgctcaaccaaggga

SEQ ID NO: 94694 - DNA, 1162 bp, Homo sapiens
  misc_feature 1..1162: note = chr6:126068780-126069942
  misc_feature 1..1162: note = hyper
  source 1..1162: mol_type = genomic DNA
ttgaattcagaaaaacgtgcagccctcacggaaagttgtgacggtcgagcttgagcctggcgggccgcggagcgttcacctgcggccgggaggtactggcccagggcgctcggggcgggaggtggcaggcgaccggcgcgcgtcaggctcgtcacccgctggattgcggggccggagcggggacggggtctgggtcctggcccgccctcgtgcagccgatcggaggccccgaaccccgcgccgacccagccatccgccctgaggccgacaggggagctggggttcaccgacccccgcggccccgccgtcgggcgcggaccccatccagccccacctggccccgccgagtgtgtgctttgcctggggttaagtttcagaagccaagatggaacgattcgggtttctattcacaaggttattgaaggcatggcggtggggaccgcgcaaaagagatgagagtgtggggggaaaggggtttctgttctaataagggcttagcacgctggccgcaggtcctccgcgccgaccgggctccttcccgctctcccccgggccaaaccccgccagggtcccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaacccagccgccgccagtctcccggcgcccctggctgggtctcgctcagtccctgccctcgcagacgcacagcggggtggccagttcaaaagtcctacataacttggagagaaccagcagctagaaaacctgttttaaacacacagcttgagttttatacaacccacgttgtccaaggcacgaactgttggacacgaattcatactttagaaaccaaatctaatttccaagcgccaatcttcacctcccggactctaactctgcggctgcgagtgcatacaccagggggactggaggagactggaggcaattatctggataatccaagcccgaaaaactcgaacttgaaaatatacgattatgtcctgaa

SEQ ID NO: 94695 - DNA, 30 bp, Homo sapiens
  misc_feature 1..30: note = chr6:126070219-126070249
  misc_feature 1..30: note = hyper
  source 1..30: mol_type = genomic DNA
gcaaatgtgaccactcgggtcagccagtca

SEQ ID NO: 94696 - DNA, 148 bp, Homo sapiens
  misc_feature 1..148: note = chr6:126071185-126071333
  misc_feature 1..148: note = hyper
  source 1..148: mol_type = genomic DNA
gatgtggattttcaccgtaggggtggagtagccaggatgggagacgccactgaaaggcagagcgcaggagttggcgagggagggtcctggctgtcacagttggacgcgcgaacggcagcgtctgggcgacaggcgatgtcccagccac

SEQ ID NO: 94697 - DNA, 193 bp, Homo sapiens
  misc_feature 1..193: note = chr6:126235500-126235693
  misc_feature 1..193: note = hypo
  source 1..193: mol_type = genomic DNA
agaaagctgtataaacgatgtacacttgtggacaagaacagataggaatgtagaaaccttaaaaatggtttgatctgttaggatatcagaattgtcggtggtatttctgtttttgttttagtcctattaatattattgcaattttatgtaattataaattttaaaaatcataagttaacgttatcccaacagt

SEQ ID NO: 94698 - DNA, 30 bp, Homo sapiens
  misc_feature 1..30: note = chr6:12626382-12626412
  misc_feature 1..30: note = hypo
  source 1..30: mol_type = genomic DNA
ctgcacatgtacccccgaatctaaaagttg

SEQ ID NO: 94699 - DNA, 30 bp, Homo sapiens
  misc_feature 1..30: note = chr6:126274515-126274545
  misc_feature 1..30: note = hypo
  source 1..30: mol_type = genomic DNA
aacccctacttgctgcgctgcagtagatgt

SEQ ID NO: 94700 - DNA, 225 bp, Homo sapiens
  misc_feature 1..225: note = chr6:1271441-1271666
  misc_feature 1..225: note = hypo
  source 1..225: mol_type = genomic DNA
taagacaaactttaacgacagtcaacttggcctcatttttctatgtgctctgtctgacacattcagaaaacttgcacctgggcacaaagttgttcgtccaaactcactgcccctgttattggctaactggaagggctaggatccagccgtgcttggaattaggcaattgccattgtaattcctttactaagaacaatgaccattttacatcgcacttagagtttt

SEQ ID NO: 94701 - DNA, 83 bp, Homo sapiens; identical to SEQ ID NO: 30810
  misc_feature 1..83: note = chr6:127439190-127439273
  misc_feature 1..83: note = hyper
  source 1..83: mol_type = genomic DNA

SEQ ID NO: 94702 - DNA, 206 bp, Homo sapiens
  misc_feature 1..206: note = chr6:127439321-127439527
  misc_feature 1..206: note = hyper
  source 1..206: mol_type = genomic DNA
cggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtc

SEQ ID NO: 94703 - DNA, 727 bp, Homo sapiens; identical to SEQ ID NO: 30812
  misc_feature 1..727: note = chr6:127439783-127440510
  misc_feature 1..727: note = hyper
  source 1..727: mol_type = genomic DNA

SEQ ID NO: 94704 - DNA, 452 bp, Homo sapiens; identical to SEQ ID NO: 2915
  misc_feature 1..452: note = chr6:127440511-127440963
  misc_feature 1..452: note = hyper
  source 1..452: mol_type = genomic DNA

SEQ ID NO: 94705 - DNA, 1041 bp, Homo sapiens; identical to SEQ ID NO: 30814
  misc_feature 1..1041: note = chr6:127441030-127442071
  misc_feature 1..1041: note = hyper
  source 1..1041: mol_type = genomic DNA

SEQ ID NO: 94706 - DNA, 249 bp, Homo sapiens
  misc_feature 1..249: note = chr6:127442089-127442338
  misc_feature 1..249: note = hyper
  source 1..249: mol_type = genomic DNA
cggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttg

SEQ ID NO: 94707 - DNA, 50 bp, Homo sapiens; identical to SEQ ID NO: 30816
  misc_feature 1..50: note = chr6:127442649-127442699
  misc_feature 1..50: note = hyper
  source 1..50: mol_type = genomic DNA

SEQ ID NO: 94708 - DNA, 164 bp, Homo sapiens
  misc_feature 1..164: note = chr6:12749336-12749500
  misc_feature 1..164: note = hyper
  source 1..164: mol_type = genomic DNA
gcacggagctgggaccgcgggcgcggcacgctcacatagagcagcctgtgggtgaaggagaccgtagtgtgcacttgggcagcgtaagcgcgtttggcgggagagggcacagtgctgactgggcatctctgcgttggagtcgtccctttcgcaagagcctatct

SEQ ID NO: 94709 - DNA, 121 bp, Homo sapiens; identical to SEQ ID NO: 30318
  misc_feature 1..121: note = chr6:12749820-12749941
  misc_feature 1..121: note = hyper
  source 1..121: mol_type = genomic DNA

SEQ ID NO: 94710 - DNA, 105 bp, Homo sapiens
  misc_feature 1..105: note = chr6:12750364-12750469
  misc_feature 1..105: note = hyper
  source 1..105: mol_type = genomic DNA
gggcgaggttggctggcgcggctactacggggtggaacttgttggtgacattcagactctgttggctttgacgggttgacgccgccgctgcggtgttggagtggg

SEQ ID NO: 94711 - DNA, 30 bp, Homo sapiens
  misc_feature 1..30: note = chr6:12770884-12770914
  misc_feature 1..30: note = hypo
  source 1..30: mol_type = genomic DNA
tgatctgcagtgcaccgaactggccgtggc

SEQ ID NO: 94712 - DNA, 213 bp, Homo sapiens
  misc_feature 1..213: note = chr6:127836013-127836226
  misc_feature 1..213: note = hyper
  source 1..213: mol_type = genomic DNA
ccggtctgggcgtagcggagccttttgcgctcggctttgcggaggcggtactgcaggatccggcagtttttgttggctctctccaactcgtggcgcatttcctgcagttgacaggcatcctcctcgaagaaagtgtccctcatctcgtccatctcggttctcagctcatcgatctcgttctgaggcggtgacaggccgcgtgtcaaaatcaaa

SEQ ID NO: 94713 - DNA, 1084 bp, Homo sapiens
  misc_feature 1..1084: note = chr6:127836665-127837749
  misc_feature 1..1084: note = hyper
  source 1..1084: mol_type = genomic DNA
gtctcgttttcctctcgcagcttctccatctcctcttgcatttcttcctgctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccgcaacgccgcttccggagtttctgctgccggttcctggggttttgcccgcagaagaggaggatggagaaggggaggccccctccccgccgctgccgcccctctgctgagcgcgtacgcctttccctcgccagcccctgggcggcggcggctgcggagcgcccccctccctttccccggagccgccgccggctcctcctccttccccgccccctcctcccccttctccgagcggagggggttccccgagtttcgagggcacggactctagctcccgaggcggctcctcgggcggtccgggcctcctgccgcccaaagcggccagggtcgcggcgggggccgcttcagcaccagccacaggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtccctcggtctagcgggtgactgagctcgctgctgctttctgctgctgccctccgggtgcagacgagcctcagtggctgcagcggcgggagaagctgctgctgtggcaggggcagcgcccccgattggtg

SEQ ID NO: 94714 - DNA, 100 bp, Homo sapiens
  misc_feature 1..100: note = chr6:127839721-127839821
  misc_feature 1..100: note = hyper
  source 1..100: mol_type = genomic DNA
acttctcagcagaggcgaggtttccaagtagctgaacaaatcaacagcactttccttctgatattccggggatctcagggtttattattgtgcctttctg

SEQ ID NO: 94715 - DNA, 764 bp, Homo sapiens
  misc_feature 1..764: note = chr6:127839929-127840693
  misc_feature 1..764: note = hyper
  source 1..764: mol_type = genomic DNA
cggtaacgtcaagattcagctgcccccagagcgggtgacttcccggcggtccgcggctgggctggagctgcagctctcagcaggctaacacgcgaggtaccaagctgggccagacgctccccaggaagtgcagagatgttcatgagctgacctcaccgaactgggcaggagagaaggcgggattgcaagggacgatagggtagaagtaaccaaagagaggttactttcaagaggaaagagaagaaggcggggagggggacgggggacgggggtggggagtggcgggataaagagacaaaaaggccagagccacgcccgagatggaagattggcagcagcgctcaaactccttgctctattctcttatcccgtacttggcagaggatcccaaaaccgctcgaacacggatgcactggtttcctgcaaagctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 94716 - DNA, 48 bp, Homo sapiens
  misc_feature 1..48: note = chr6:128840325-128840373
  misc_feature 1..48: note = hyper
  source 1..48: mol_type = genomic DNA
aggtagacaagtgctcgggagcccgctccccagcgtccacctggtgaa

SEQ ID NO: 94717 - DNA, 64 bp, Homo sapiens
  misc_feature 1..64: note = chr6:128841037-128841101
  misc_feature 1..64: note = hyper
  source 1..64: mol_type = genomic DNA
agacagcaacaaacccgcaccacaagcaacagagtgccgtcacgggagtcgtaactactttttc

SEQ ID NO: 94718 - DNA, 142 bp, Homo sapiens
  misc_feature 1..142: note = chr6:128841577-128841719
  misc_feature 1..142: note = hyper
  source 1..142: mol_type = genomic DNA
gagcgggccgggcctcgcggggtgaggacggtgagaggacagccgcccgcccgccctttttccttcttcgcggtcgccaaactacctcaggggcgaaagcgtcgccagcgtcgccggccggccgcggcggcagctctccatg

SEQ ID NO: 94719 - DNA, 390 bp, Homo sapiens
  misc_feature 1..390: note = chr6:128901705-128902095
  misc_feature 1..390: note = hypo
  source 1..390: mol_type = genomic DNA
ggcgcatgggagacacgtgctgtgtctgcgggactgtggaccatggccaggcgagctcttctctcttctccggcatgttcagccaggcctccaggttggagaccgcctgctgcagctcctgcaccacgccgcgcaggctctggttctccacttccaggctggcgatctggaggacgagctcgctgtggtcttccctggggccgagctctggcgggaggcgctggccacaggcccattcatctgcttgtagaatttcctttctgtatcttcatatttgaatttgtcgagccagatcttctcatgtgctaggaattttgtagccatttttctgacgcctgccaagaatgcggctaccagaaatgaggaatcggtagacgcaggacgcctaag

SEQ ID NO: 94720 - DNA, 15 bp, Homo sapiens
  misc_feature 1..15: note = chr6:129204289-129204304
  misc_feature 1..15: note = hyper
  source 1..15: mol_type = genomic DNA
ccagcagctgctgct

SEQ ID NO: 94721 - DNA, 328 bp, Homo sapiens
  misc_feature 1..328: note = chr6:129204360-129204688
  misc_feature 1..328: note = hyper
  source 1..328: mol_type = genomic DNA
cgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtaggggga

SEQ ID NO: 94722 - DNA, 57 bp, Homo sapiens
  misc_feature 1..57: note = chr6:129480603-129480660
  misc_feature 1..57: note = hypo
  source 1..57: mol_type = genomic DNA
gccgggaggatctgccggggagagcggctttcctcatcgattcgggagcacccacca

SEQ ID NO: 94723 - DNA, 30 bp, Homo sapiens
  misc_feature 1..30: note = chr6:129958014-129958044
  misc_feature 1..30: note = hypo
  source 1..30: mol_type = genomic DNA
aacaccatctagatccgctgattttttacc

SEQ ID NO: 94724 - DNA, 248 bp, Homo sapiens
  misc_feature 1..248: note = chr6:130088218-130088466
  misc_feature 1..248: note = hyper
  source 1..248: mol_type = genomic DNA
ttcaaagctgatatgcgttgcaaagagaaaagcatgcaaagatgctctccttaccggaggtgaaagcattgtgccagctctgtcactactataaccatcttccgcaagtggagagcagggaacgccagggtcccaagaagtgacgaaaagcgataattagatctcctgcaagaatcttccctaagcactttcttccgtgacacacctactttgtggcatctacgcgctcttcacggctaaccacaatc

SEQ ID NO: 94725 - DNA, 506 bp, Homo sapiens; identical to SEQ ID NO: 30320
  misc_feature 1..506: note = chr6:13013570-13014076
  misc_feature 1..506: note = hyper
  source 1..506: mol_type = genomic DNA

SEQ ID NO: 94726 - DNA, 30 bp, Homo sapiens; identical to SEQ ID NO: 40889
  misc_feature 1..30: note = chr6:130182604-130182634
  misc_feature 1..30: note = hypo
  source 1..30: mol_type = genomic DNA

SEQ ID NO: 94727 - DNA, 30 bp, Homo sapiens; identical to SEQ ID NO: 40890
  misc_feature 1..30: note = chr6:130241934-130241964
  misc_feature 1..30: note = hypo
  source 1..30: mol_type = genomic DNA

SEQ ID NO: 94728 - DNA, 114 bp, Homo sapiens
  misc_feature 1..114: note = chr6:130339570-130339684
  misc_feature 1..114: note = hyper
  source 1..114: mol_type = genomic DNA
gctgcatttgccacccggctttattgctgctttccagcggcgaaggcgcagcagcagtaacagggaagccagagcgagcctccccggcagcggcggcggcggcggcggcaccgg

SEQ ID NO: 94729 - DNA, 30 bp, Homo sapiens
  misc_feature 1..30: note = chr6:13044971-13045001
  misc_feature 1..30: note = hypo
  source 1..30: mol_type = genomic DNA
tttttcccctatacacgatggttagcattt

SEQ ID NO: 94730 - DNA, 30 bp, Homo sapiens
  misc_feature 1..30: note = chr6:130465678-130465708
  misc_feature 1..30: note = hypo
  source 1..30: mol_type = genomic DNA
gctgaaatcctacttcgttttccttttctt

SEQ ID NO: 94731 - DNA, 39 bp, Homo sapiens
  misc_feature 1..39: note = chr6:130499389-130499428
  misc_feature 1..39: note = hypo
  source 1..39: mol_type = genomic DNA
ggattacaggcgtgagccaccacgcgcccggctggccca

SEQ ID NO: 94732 - DNA, 149 bp, Homo sapiens; identical to SEQ ID NO: 40891
  misc_feature 1..149: note = chr6:130530028-130530177
  misc_feature 1..149: note = hypo
  source 1..149: mol_type = genomic DNA

SEQ ID NO: 94733 - DNA, 30 bp, Homo sapiens
  misc_feature 1..30: note = chr6:130608796-130608826
  misc_feature 1..30: note = hypo
  source 1..30: mol_type = genomic DNA
agttacaggtgtggccgggcgcagtggctc

SEQ ID NO: 94734 - DNA, 816 bp, Homo sapiens
  misc_feature 1..816: note = chr6:130686377-130687193
  misc_feature 1..816: note = hyper
  source 1..816: mol_type = genomic DNA
gtaacctgaacctctcgttggctttgatgtttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 94735 - DNA, 694 bp, Homo sapiens
  misc_feature 1..694: note = chr6:130687224-130687918
  misc_feature 1..694: note = hyper
  source 1..694: mol_type = genomic DNA
cggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccagactccccagtcccgggagcgcgagagaagccgtgcggggcagcctccaagaacccggagtactggagcg

SEQ ID NO: 94736 - DNA, 30 bp, Homo sapiens; identical to SEQ ID NO: 40892
  misc_feature 1..30: note = chr6:130808098-130808128
  misc_feature 1..30: note = hypo
  source 1..30: mol_type = genomic DNA

SEQ ID NO: 94737 - DNA, 92 bp, Homo sapiens
  misc_feature 1..92: note = chr6:1310870-1310962
  misc_feature 1..92: note = hyper
  source 1..92: mol_type = genomic DNA
agtcagtctaatctccgaacgcgatccttccccaaatacaaaaataacagagctgtggctggggctgtcatgttgcccgccccattgtgaat

SEQ ID NO: 94738 - DNA, 227 bp, Homo sapiens
  misc_feature 1..227: note = chr6:1311771-1311998
  misc_feature 1..227: note = hyper
  source 1..227: mol_type = genomic DNA
acaggggtttgctttcgtaagcagcatcgttttcactactacagaagcacatacgccgcgtgcagcttaggcccgagcaaagtccctgctcccctagacccagtcccttcaggtgtccccctaggggaactgtggcgtgtccccccaaccaggcgcactcgcctaaactgcgtccccgaactccagggcgcagggagccctcgcgggctgcccggggctggggccca

SEQ ID NO: 94739 - DNA, 178 bp, Homo sapiens
  misc_feature 1..178: note = chr6:13118018-13118196
  misc_feature 1..178: note = hypo
  source 1..178: mol_type = genomic DNA
tccatcatcccctggcgattgtaatctccttccttagccatctcctttcctgtgcttttatcccacctaacgcagagctctgcaggtgctaagcatgcaacagacgtctcacataaatgagtgcaaccacaccctctccactcaacttttgctttttacaagccggagcataatttta

SEQ ID NO: 94740 - DNA, 30 bp, Homo sapiens
  misc_feature 1..30: note = chr6:131269546-131269576
  misc_feature 1..30: note = hypo
  source 1..30: mol_type = genomic DNA
agatggggaaagaggcgagtaggcatagtg

SEQ ID NO: 94741 - DNA, 30 bp, Homo sapiens; identical to SEQ ID NO: 30223
  misc_feature 1..30: note = chr6:1312754-1312784
  misc_feature 1..30: note = hyper
  source 1..30: mol_type = genomic DNA

SEQ ID NO: 94742 - DNA, 35 bp, Homo sapiens
  misc_feature 1..35: note = chr6:1313267-1313302
  misc_feature 1..35: note = hyper
  source 1..35: mol_type = genomic DNA
gcagcaagccatatacgcggcggcccaagcccccc

SEQ ID NO: 94743 - DNA, 18 bp, Homo sapiens
  misc_feature 1..18: note = chr6:131389805-131389823
  misc_feature 1..18: note = hypo
  source 1..18: mol_type = genomic DNA
cctcgggaggctgaggca

SEQ ID NO: 94744 - DNA, 62 bp, Homo sapiens; identical to SEQ ID NO: 30224
  misc_feature 1..62: note = chr6:1314000-1314062
  misc_feature 1..62: note = hyper
  source 1..62: mol_type = genomic DNA

SEQ ID NO: 94745 - DNA, 69 bp, Homo sapiens
  misc_feature 1..69: note = chr6:131455780-131455849
  misc_feature 1..69: note = hypo
  source 1..69: mol_type = genomic DNA
gcatcagaaactcaacgtgttagaattatttgaaaatcagagtaactagtttgccgacttctagtgtgc

SEQ ID NO: 94746 - DNA, 21 bp, Homo sapiens
  misc_feature 1..21: note = chr6:131532615-131532636
  misc_feature 1..21: note = hypo
  source 1..21: mol_type = genomic DNA
tgtaatccagatgggcgcggt

SEQ ID NO: 94747 - DNA, 181 bp, Homo sapiens
  misc_feature 1..181: note = chr6:131602777-131602958
  misc_feature 1..181: note = hyper
  source 1..181: mol_type = genomic DNA
agaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagtt

SEQ ID NO: 94748 - DNA, 89 bp, Homo sapiens
  misc_feature 1..89: note = chr6:131616389-131616478
  misc_feature 1..89: note = hypo
  source 1..89: mol_type = genomic DNA
tcacgccctttgcagcggggaggagcctggcatctctctcctgttccggggtgtggtacctgggattgcatctgcgaggtgggaagtgc

SEQ ID NO: 94749 - DNA, 40 bp, Homo sapiens
  misc_feature 1..40: note = chr6:1316770-1316810
  misc_feature 1..40: note = hyper
  source 1..40: mol_type = genomic DNA
tcacacacccagccccggggagtttcggtttctcagtgct

SEQ ID NO: 94750 - DNA, 30 bp, Homo sapiens
  misc_feature 1..30: note = chr6:1317677-1317707
  misc_feature 1..30: note = hypo
  source 1..30: mol_type = genomic DNA
gtttggtttgggactcgccctttgacacct

SEQ ID NO: 94751 - DNA, 145 bp, Homo sapiens
  misc_feature 1..145: note = chr6:13180876-13181021
  misc_feature 1..145: note = hypo
  source 1..145: mol_type = genomic DNA
catcaagaatcaaagcggtttcctagagatgtgttaggctgaatgacagctgcatcattattccaccaactgggaaattgaaacagagttacttcccacggcatctgtttgaacatgctaaataaaggcacgttaagaagactgg

SEQ ID NO: 94752 - DNA, 41 bp, Homo sapiens
  misc_feature 1..41: note = chr6:131884134-131884175
  misc_feature 1..41: note = hypo
  source 1..41: mol_type = genomic DNA
ttaaaatgagtaggccgggtgtggtggctcatgcctgtaca

SEQ ID NO: 94753 - DNA, 86 bp, Homo sapiens
  misc_feature 1..86: note = chr6:132017843-132017929
  misc_feature 1..86: note = hypo
  source 1..86: mol_type = genomic DNA
tgaacactgccaggccgcgtccttcaaaggcacctttttttctctcaatgatctacccagagcaccttttttttttttttttttga

SEQ ID NO: 94754 - DNA, 158 bp, Homo sapiens
  misc_feature 1..158: note = chr6:132128512-132128670
  misc_feature 1..158: note = hyper
  source 1..158: mol_type = genomic DNA
gaaaccacataaaaccgtgggaatcgaaatatcccttacgtgtgttcagtacatgtgaacccacgtattttaagtggacgatttctctctcagagtaccgtaggtagtgggggacggggcgcagagggggagaaacagaaagtcgccttcctccatgg

SEQ ID NO: 94755 - DNA, 30 bp, Homo sapiens; identical to SEQ ID NO: 30828
  misc_feature 1..30: note = chr6:132271740-132271770
  misc_feature 1..30: note = hyper
  source 1..30: mol_type = genomic DNA

SEQ ID NO: 94756 - DNA, 113 bp, Homo sapiens
  misc_feature 1..113: note = chr6:132722029-132722142
  misc_feature 1..113: note = hyper
  source 1..113: mol_type = genomic DNA
gtctattaagtggggcgctggggacaggaaagtgttcaaagaaggaaacctgcctggggtcatccgtgctcggcttccctaccgcgcgccttctggggctccgggagagcagg

SEQ ID NO: 94757 - DNA, 890 bp, Homo sapiens
  misc_feature 1..890: note = chr6:132722157-132723047
  misc_feature 1..890: note = hyper
  source 1..890: mol_type = genomic DNA
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagg

SEQ ID NO: 94758 - DNA, 159 bp, Homo sapiens; identical to SEQ ID NO: 40748
  misc_feature 1..159: note = chr6:13288514-13288673
  misc_feature 1..159: note = hypo
  source 1..159: mol_type = genomic DNA

SEQ ID NO: 94759 - DNA, 51 bp, Homo sapiens
  misc_feature 1..51: note = chr6:13293172-13293223
  misc_feature 1..51: note = hypo
  source 1..51: mol_type = genomic DNA
tgtcccctacagcatcgcaggtttgagggtgctctgcggatgtagctactt

SEQ ID NO: 94760 - DNA, 302 bp, Homo sapiens; identical to SEQ ID NO: 30831
  misc_feature 1..302: note = chr6:133561966-133562268
  misc_feature 1..302: note = hyper
  source 1..302: mol_type = genomic DNA

SEQ ID NO: 94761 - DNA, 89 bp, Homo sapiens; identical to SEQ ID NO: 30832
  misc_feature 1..89: note = chr6:133562348-133562437
  misc_feature 1..89: note = hyper
  source 1..89: mol_type = genomic DNA

SEQ ID NO: 94762 - DNA, 421 bp, Homo sapiens; identical to SEQ ID NO: 30833
  misc_feature 1..421: note = chr6:133562674-133563095
  misc_feature 1..421: note = hyper
  source 1..421: mol_type = genomic DNA

SEQ ID NO: 94763 - DNA, 1084 bp, Homo sapiens
  misc_feature 1..1084: note = chr6:133563157-133564241
  misc_feature 1..1084: note = hyper
  source 1..1084: mol_type = genomic DNA
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgt

SEQ ID NO: 94764 - DNA, 30 bp, Homo sapiens
  misc_feature 1..30: note = chr6:133894955-133894985
  misc_feature 1..30: note = hypo
  source 1..30: mol_type = genomic DNA
gaagaaagatcattccgaagtgtttaaaaa

SEQ ID NO: 94765 - DNA, 93 bp, Homo sapiens; identical to SEQ ID NO: 40896
  misc_feature 1..93: note = chr6:134067455-134067548
  misc_feature 1..93: note = hypo
  source 1..93: mol_type = genomic DNA

SEQ ID NO: 94766 - DNA, 170 bp, Homo sapiens
  misc_feature 1..170: note = chr6:134175884-134176054
  misc_feature 1..170: note = hyper
  source 1..170: mol_type = genomic DNA
gcaggggatgggctgcgaccgctcccagtgaccccacgaaacccagaggggaggctgaggctctgaggccagccaggggagctgacgatctcgcagaagccgcggcgagtctcccccggaggtctaggaggcagagccattaaagccaggctgcccgctgaaacgcacag

SEQ ID NO: 94767 - DNA, 462 bp, Homo sapiens; identical to SEQ ID NO: 30836
  misc_feature 1..462: note = chr6:134210557-134211019
  misc_feature 1..462: note = hyper
  source 1..462: mol_type = genomic DNA

SEQ ID NO: 94768 - DNA, 256 bp, Homo sapiens
  misc_feature 1..256: note = chr6:134211111-134211367
  misc_feature 1..256: note = hyper
  source 1..256: mol_type = genomic DNA
cgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacactgacaagacgctgcgagcggacaggcattttg

SEQ ID NO: 94769 - DNA, 113 bp, Homo sapiens
  misc_feature 1..113: note = chr6:134212308-134212421
  misc_feature 1..113: note = hyper
  source 1..113: mol_type = genomic DNA
caaagccggtgtttgcgatggaagaaacgaaagtcggactagggaaatagatggtgatgaaaggcgatgaaagcgacagggccctgaaacccgaccaccgcctcagaaggagg

SEQ ID NO: 94770 - DNA, 72 bp, Homo sapiens
  misc_feature 1..72: note = chr6:134213916-134213988
  misc_feature 1..72: note = hyper
  source 1..72: mol_type = genomic DNA
ttctaacaataaacccgcatgcctgccttttggttgctgttagcgggtgcgtttagctcccgccacgacttc

SEQ ID NO: 94771 - DNA, 326 bp, Homo sapiens
  misc_feature 1..326: note = chr6:134214076-134214402
  misc_feature 1..326: note = hyper
  source 1..326: mol_type = genomic DNA
cgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtccc

SEQ ID NO: 94772 - DNA, 97 bp, Homo sapiens; identical to SEQ ID NO: 8736
  misc_feature 1..97: note = chr6:134216904-134217001
  misc_feature 1..97: note = hyper
  source 1..97: mol_type = genomic DNA

SEQ ID NO: 94773 - DNA, 91 bp, Homo sapiens; identical to SEQ ID NO: 30841
  misc_feature 1..91: note = chr6:134217370-134217461
  misc_feature 1..91: note = hyper
  source 1..91: mol_type = genomic DNA

SEQ ID NO: 94774 - DNA, 299 bp, Homo sapiens; identical to SEQ ID NO: 30842
  misc_feature 1..299: note = chr6:134499553-134499852
  misc_feature 1..299: note = hyper
  source 1..299: mol_type = genomic DNA

SEQ ID NO: 94775 - DNA, 86 bp, Homo sapiens; identical to SEQ ID NO: 40897
  misc_feature 1..86: note = chr6:134589500-134589586
  misc_feature 1..86: note = hypo
  source 1..86: mol_type = genomic DNA

SEQ ID NO: 94776 - DNA, 86 bp, Homo sapiens; identical to SEQ ID NO: 40898
  misc_feature 1..86: note = chr6:134589886-134589972
  misc_feature 1..86: note = hypo
  source 1..86: mol_type = genomic DNA

SEQ ID NO: 94777 - DNA, 296 bp, Homo sapiens
  misc_feature 1..296: note = chr6:134638707-134639003
  misc_feature 1..296: note = hyper
  source 1..296: mol_type = genomic DNA
ggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggt

SEQ ID NO: 94778 - DNA, 207 bp, Homo sapiens
  misc_feature 1..207: note = chr6:13488388-13488595
  misc_feature 1..207: note = hyper
  source 1..207: mol_type = genomic DNA
aggctaagggacttgcgcaaggtgacatatataagcaacaggcctgcgattggaatccaggccccagagtctgggcacggaaccgcagacttctacggtctccttccaagctagcctgctccaatcgcgcgcccccgctccggccgcgcacgcacggttcagccgccttcttccaagacagtccagtcttggcgggctcccatctgc

SEQ ID NO: 94779 - DNA, 18 bp, Homo sapiens
  misc_feature 1..18: note = chr6:13510401-13510419
  misc_feature 1..18: note = hypo
  source 1..18: mol_type = genomic DNA
tggagtacaatggtgcga

SEQ ID NO: 94780 - DNA, 17 bp, Homo sapiens
  misc_feature 1..17: note = chr6:13510479-13510496
  misc_feature 1..17: note = hypo
  source 1..17: mol_type = genomic DNA
accgacttcaagaatga

SEQ ID NO: 94781 - DNA, 39 bp, Homo sapiens
  misc_feature 1..39: note = chr6:136443399-136443438
  misc_feature 1..39: note = hypo
  source 1..39: mol_type = genomic DNA
tgggattacaggcgtgagccaccacgcccagctataatt

SEQ ID NO: 94782 - DNA, 20 bp, Homo sapiens
  misc_feature 1..20: note = chr6:136556311-136556331
  misc_feature 1..20: note = hypo
  source 1..20: mol_type = genomic DNA
gccaccgcacctggcctgat

SEQ ID NO: 94783 - DNA, 137 bp, Homo sapiens; identical to SEQ ID NO: 40899
  misc_feature 1..137: note = chr6:137144480-137144617
  misc_feature 1..137: note = hypo
  source 1..137: mol_type = genomic DNA

SEQ ID NO: 94784 - DNA, 244 bp, Homo sapiens; identical to SEQ ID NO: 30844
  misc_feature 1..244: note = chr6:137241818-137242062
  misc_feature 1..244: note = hyper
  source 1..244: mol_type = genomic DNA

SEQ ID NO: 94785 - DNA, 1183 bp, Homo sapiens
  misc_feature 1..1183: note = chr6:137242063-137243246
  misc_feature 1..1183: note = hyper
  source 1..1183: mol_type = genomic DNA
cctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttcatctttgcctcagttcgaatgtgtccccgccaccaggccccgctgctgggcgagaccactgaaccccctgaaagcttccccggagccgcgcgcataatcccgggaccctctctggaaggcgtgcggagagcggtgcgcgtggcctggcaccggaaggagccagcttccgggctccgaggcaccccctggacagcgccccgggccgcgggttcctcctccgatgcccgggcgtcgtcgccgggatcgggagcttcgggggcccgccggcaccgacggttttcgcttccctggcgggcagctggacgaggtcccgccgctgcaccgggagggacagtgggtggaaaaagccgctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 94786 - DNA, 691 bp, Homo sapiens
  misc_feature 1..691: note = chr6:137243458-137244149
  misc_feature 1..691: note = hyper
  source 1..691: mol_type = genomic DNA
cgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggt

SEQ ID NO: 94787 - DNA, 231 bp, Homo sapiens; identical to SEQ ID NO: 613
  misc_feature 1..231: note = chr6:137244235-137244466
  misc_feature 1..231: note = hyper
  source 1..231: mol_type = genomic DNA

SEQ ID NO: 94788 - DNA, 89 bp, Homo sapiens
  misc_feature 1..89: note = chr6:137310853-137310942
  misc_feature 1..89: note = hyper
  source 1..89: mol_type = genomic DNA
gtgactatgaagggacgcagtcagtccaaagccaccccgggaaagatgtggcccgcagcctggcaggctgaggacgtgtagggggctgc

SEQ ID NO: 94789 - DNA, 222 bp, Homo sapiens; identical to SEQ ID NO: 30851
  misc_feature 1..222: note = chr6:137311158-137311380
  misc_feature 1..222: note = hyper
  source 1..222: mol_type = genomic DNA

SEQ ID NO: 94790 - DNA, 46 bp, Homo sapiens
  misc_feature 1..46: note = chr6:137365956-137366002
  misc_feature 1..46: note = hyper
  source 1..46: mol_type = genomic DNA
gcgcctggggctctgcgtgccacgctccaggcgacctgagtcccag

SEQ ID NO: 94791 - DNA, 40 bp, Homo sapiens
  misc_feature 1..40: note = chr6:137366320-137366360
  misc_feature 1..40: note = hypo
  source 1..40: mol_type = genomic DNA
acggatgaaatagagcgttatttctcgatatacagttagg

SEQ ID NO: 94792 - DNA, 105 bp, Homo sapiens
  misc_feature 1..105: note = chr6:13767864-13767969
  misc_feature 1..105: note = hyper
  source 1..105: mol_type = genomic DNA
tcatctctcccaccacgtttcctgcctcctctggtgcccccctctgacagtcatgtggctaattttaaaccgtaatctgaagcccagaaccgggaaagtcccatg

SEQ ID NO: 94793 - DNA, 142 bp, Homo sapiens
  misc_feature 1..142: note = chr6:137808752-137808894
  misc_feature 1..142: note = hyper
  source 1..142: mol_type = genomic DNA
ggaggagaaaggagtcgccataaaatgcacccgcgccaccctccatgtcccccagtggaattgaggatcttgcttgtggcaaaagtgcgttcttggcaccacagccccgcagctggggaggggggcctcagtacccggcttc

SEQ ID NO: 94794 - DNA, 366 bp, Homo sapiens; identical to SEQ ID NO: 30853
  misc_feature 1..366: note = chr6:137809000-137809366
  misc_feature 1..366: note = hyper
  source 1..366: mol_type = genomic DNA

SEQ ID NO: 94795 - DNA, 472 bp, Homo sapiens; identical to SEQ ID NO: 615
  misc_feature 1..472: note = chr6:137809445-137809917
  misc_feature 1..472: note = hyper
  source 1..472: mol_type = genomic DNA

SEQ ID NO: 94796 - DNA, 1262 bp, Homo sapiens
  misc_feature 1..1262: note = chr6:137810032-137811294
  misc_feature 1..1262: note = hyper
  source 1..1262: mol_type = genomic DNA
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggatttcgccatccatttaaacgtaaggcggggtttaatctggaatgaaaggatcgtcgtggtgtttccagattgaatgaaaaactaaacttgcaaaatttcgagaaagtgacaagtttacaacgaaaaaaaatcccggccgaaacccattttcacctttgcggtcatgaaatctt

SEQ ID NO: 94797 - DNA, 1083 bp, Homo sapiens
  misc_feature 1..1083: note = chr6:137813536-137814619
  misc_feature 1..1083: note = hyper
  source 1..1083: mol_type = genomic DNA
agagagagccaaccccgcatgcagaataactgagcgagggggggtggcgcaagctactagagggagcccaggcttttacaatagcggccccagaacagcaaaggaaggttccgaataaagtttgaagggggtgggggtgggagaagaagcgcgtgtgcgtgagtgtgggtctttgcactctgccccttttttcatttcatacaaccacagacagatatatggagtacttgggataattcactaataaatccttgttacaaggaaaacggcaccacagcctgcacgacatattcagacaagattcatttagaagcgtgcatgcattcttttgacctacactgcgtcgaaaggaaaacccacataggaggtgtcatgccctggacctcggttgagattcaaaacttgggtcttgatctctctcgcgctctctctctctttctctctccattgtctctagaaaaactgtggcaaggacagagacaatcataatcgcatccatctcaagaaaatatttacatttgttttgcacaaaagggatggccgtctttttccaaagcgagaacacagagtcagagaaagccaactcaaaagtcccttcgcaagtttttaactacaccgatcccatctttatacaacaaatgcagttttgacaagagcatatggcagtgaaaaatactggcgcggcatggggaaaagaagcatgcatgcaaaacacacgacatctggttcgagtccccctttgctaccacctagaaattgcggtttgattttggtcctttccctccgggggtcaagtggagtctgagatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagc

SEQ ID NO: 94798 - DNA, 518 bp, Homo sapiens; identical to SEQ ID NO: 30858
  misc_feature 1..518: note = chr6:137814653-137815171
  misc_feature 1..518: note = hyper
  source 1..518: mol_type = genomic DNA

SEQ ID NO: 94799 - DNA, 727 bp, Homo sapiens; identical to SEQ ID NO: 30859
  misc_feature 1..727: note = chr6:137815224-137815951
  misc_feature 1..727: note = hyper
  source 1..727: mol_type = genomic DNA

SEQ ID NO: 94800 - DNA, 815 bp, Homo sapiens
  misc_feature 1..815: note = chr6:137816459-137817274
  misc_feature 1..815: note = hyper
  source 1..815: mol_type = genomic DNA
cttcctggaccttggcgctggcgcaaaacggtgggacggtccgcgcccgaagctccgccgggcctcctctggccgctgtgctgacgtgccccgagctccgggaactcagcggcaccccggcctgcgcgggtgggtccaccaggctggggccgccgtacggcgtcggacagggaaatcagaagctcataataaactatctgatgtcggggtggtggggcgggggggtggggtgcgtgggcaaagaagcacgggggaagggaaacaacgaaaggacctagaaagccccttgtgcgtgcccgggcactgcggttcagcgcagagtcgtttctgggaataaagaggaggtcggagtttggagccttcggtgcgagtgcggaggtgggcgtagatctttcttcccccttgctgtgtttttgtgatcaagactttagctcagcagcacgaggggcgggaaggcagaaatcccgggaagggagagagccccaggagtggtctctagaagaacccggacaccgcccctctcccggcttggtggaacgggaaacaaacgctagctagtgactgagagtctcggtggaagtgtgaaatcgaatcaatcgcggaacctcgggcacttggggcctcttgcgccgctgagtcacttcgaagaacaggatgcccccctttcccttgactcaaaccgagcggtcagtgggagagggatgcgcgcccaggtccggagtttgcacgctctgaggctgtgccccactgacagtcacgctgcgaaggcagctctggccaataccagaaggatgggcaaacgcaacattggcatg

SEQ ID NO: 94801 - DNA, 981 bp, Homo sapiens
  misc_feature 1..981: note = chr6:137817618-137818599
  misc_feature 1..981: note = hyper
  source 1..981: mol_type = genomic DNA
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctggcccccgccgtcctcctgagccacctccctgaccctaggtcgtcggcggcgtctgtccttcccacacccagactgaaaacgctgcacctgagttttgatttggggaagtagaattgtctggtcagagcagaagggttgcaaatgaaggagtggaaaaatcatgttgctacaagatattttaccctttaaaaaaagtcttgattttcccagtggacaatgtaaaataaagttttaaaatctcccccaaattagtaacgaaggtggcaagccgtgggcggggggaggggagggaaggagggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagt

SEQ ID NO: 94802 - DNA, 649 bp, Homo sapiens; identical to SEQ ID NO: 621
  misc_feature 1..649: note = chr6:137818618-137819267
  misc_feature 1..649: note = hyper
  source 1..649: mol_type = genomic DNA

SEQ ID NO: 94803 - DNA, 493 bp, Homo sapiens
  misc_feature 1..493: note = chr6:137819268-137819761
  misc_feature 1..493: note = hyper
  source 1..493: mol_type = genomic DNA
ccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctgtgggcttcacctttcaacccaaccaccctccaagacaaaacagaacaaaaaaaggaaacctaaacatttctaactatgtttcctcatgtgcaaacaaggaatagcctaaaaattagttgaccacgcggagaaacttctcaaaaagtgcattctttagcagagtagaacgataacttcacaacaatagcagtgggggtccggtcaccagggccg

SEQ ID NO: 94804 - DNA, 277 bp, Homo sapiens; identical to SEQ ID NO: 2742
  misc_feature 1..277: note = chr6:1378199-1378476
  misc_feature 1..277: note = hyper
  source 1..277: mol_type = genomic DNA

SEQ ID NO: 94805 - DNA, 711 bp, Homo sapiens
  misc_feature 1..711: note = chr6:1379267-1379978
  misc_feature 1..711: note = hyper
  source 1..711: mol_type = genomic DNA
cgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaaaccgaggtgcagaaacaaagtaacttgttccagatcacgtaggtggtaagtgcagggtattctggagcaggagggagggtggaaagcacagaaaaaaaaaaatgaactgggaaaagcgttgacgtgcttagtatttcatactgcaggttccactttcagagccaggctgcgagcctacagggtagagtaggggtgccgggccccctggtgtcctggcgtactcggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttccactgcactttcacgttctgccggatgg

SEQ ID NO: 94806 - DNA, 785 bp, Homo sapiens
  misc_feature 1..785: note = chr6:1381866-1382651
  misc_feature 1..785: note = hyper
  source 1..785: mol_type = genomic DNA
aagacacagagcccccgtcccttgcttcagagaaccaaataacggaactgaatgatcgtttcttcagcaaagcctaaagacgcttgcgtcccgcggagaggtgcccacgcgcgactcggctgccccctcttcttgcgggtccgggtagggtagggcgggaacgcgggacgtgccctaagcgggccagccgagcgcgagacaggcgatgctgcagaagcctgcccgcctgcgggtcacacaccggccggcctcggctgcaggggttgcggggccacgggtcgcggggcgccgggagccgcgagcaggtgacggccgcgccgggcagccccgcgggccgcgattcccgagagcctggcgccaccccgcggaagccggaggaactgcggcttcttcccgctcccgcgcggaggggagagggaggcgcagcgcggaggggagagggaggcgcagcgcggaggggagagggaggcgcagcgcggaggggagagggaggcgcagcccgcaccgcgcaatcccggggctctggcgggagggaaggtgacttgcgtgggacgactccaagaggccaggcccggccttcgcagttcacccacgaggataccgcgaccaagccaccaaagcactctctggccaggccgagaccccttttcccccgggccccaagagaaaaaagcactttctcctaaaacacgaactccccgcggaggggcccggggctgcctggcacggggcagggtgtgcggctgccgtgcgggcgcgggccagagtcacgtggaggcaggcgg

SEQ ID NO: 94807 - DNA, 22 bp, Homo sapiens
  misc_feature 1..22: note = chr6:13829036-13829058
  misc_feature 1..22: note = hypo
  source 1..22: mol_type = genomic DNA
cctactgggggaactcgccccc

SEQ ID NO: 94808 - DNA, 457 bp, Homo sapiens
  misc_feature 1..457: note = chr6:1382993-1383450
  misc_feature 1..457: note = hyper
  source 1..457: mol_type = genomic DNA
gtgtggggcacagggcgtgaggggaggatgagctccccctgagcagatggagatttctccttgcctgggccgtttgacccccaaagccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgccccaggccagtg

SEQ ID NO: 94809 - DNA, 32 bp, Homo sapiens; identical to SEQ ID NO: 30231
  misc_feature 1..32: note = chr6:1383677-1383709
  misc_feature 1..32: note = hyper
  source 1..32: mol_type = genomic DNA

SEQ ID NO: 94810 - DNA, 123 bp, Homo sapiens
  misc_feature 1..123: note = chr6:1383859-1383982
  misc_feature 1..123: note = hyper
  source 1..123: mol_type = genomic DNA
ggggcccggggcctttggccaggctgcggggaggggtggggttggggggctccccaaagcagcttctcggaggcggcgtcggggcgccctgaggtccctagtcggcctctgggcgccgagcac

SEQ ID NO: 94811 - DNA, 197 bp, Homo sapiens
  misc_feature 1..197: note = chr6:1383983-1384180
  misc_feature 1..197: note = hyper
  source 1..197: mol_type = genomic DNA
ttttatttatccccacagaggatgctggaggacaaaagaaatatttggacgtcagagctgatttatatttttggaagagctacgtttccttttctgaagagaagcgagcgcgccccatatcctgagctcggcggggaggacgagaggggagttttgatgcgccaggaagttcatctatcgcccaggcgctcaggacc

SEQ ID NO: 94812 - DNA, 31 bp, Homo sapiens
  misc_feature 1..31: note = chr6:1384625-1384656
  misc_feature 1..31: note = hyper
  source 1..31: mol_type = genomic DNA
cgagcgttgccacagccgggagggcggaggg

SEQ ID NO: 94813 - DNA, 715 bp, Homo sapiens
  misc_feature 1..715: note = chr6:1384971-1385686
  misc_feature 1..715: note = hyper
  source 1..715: mol_type = genomic DNA
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatcccaaggttttggtctcgcaaccgaggggacccgcgcccggcaatttgggaagtgcggaaatggggtgaggccggtcttcgcttgagggtctcgtagattggacccctttttcccccttcaagcaccctcagacctggccagtgggtcatcgagtcgtgcccaccgcccaggccaggagatctggggctactgggagatctctcatgaaggtggctataaaaagagccctgaccgggacacaagcctttggagagcggaagactctatccaaataaacactgggaactgggtggctggtgttcaggcccggaggtctgggggtttctggacctaggaaggagagcagactccaggagaggtgtgaaattcccactcccggccaccttgctctctccaacccccgcctccgcgcgtcctcctattgctgttcccgtccgcatcttctgctgttatgtgaagtttctaaagaggcctctgcagcgtgcaggctggtgctcttccagcatttcctcaatcacgctgacacccccaggccccagcactgagttctcgccgtccacatttagaa

SEQ ID NO: 94814 - DNA, 35 bp, Homo sapiens; identical to SEQ ID NO: 30237
  misc_feature 1..35: note = chr6:1386121-1386156
  misc_feature 1..35: note = hyper
  source 1..35: mol_type = genomic DNA

SEQ ID NO: 94815 - DNA, 38 bp, Homo sapiens
  misc_feature 1..38: note = chr6:138753177-138753215
  misc_feature 1..38: note = hypo
  source 1..38: mol_type = genomic DNA
gtcactctgcgatggcgtggccccgcacagggagtaga

SEQ ID NO: 94816 - DNA, 157 bp, Homo sapiens
  misc_feature 1..157: note = chr6:138790419-138790576
  misc_feature 1..157: note = hypo
  source 1..157: mol_type = genomic DNA
caacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaac

SEQ ID NO: 94817 - DNA, 269 bp, Homo sapiens; identical to SEQ ID NO: 30238
  misc_feature 1..269: note = chr6:1389006-1389275
  misc_feature 1..269: note = hyper
  source 1..269: mol_type = genomic DNA

SEQ ID NO: 94818 - DNA, 989 bp, Homo sapiens
  misc_feature 1..989: note = chr6:1389372-1390361
  misc_feature 1..989: note = hyper
  source 1..989: mol_type = genomic DNA
cgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcggggagcgagataagagagggaggcggccgccaggtcgggagggggaggagtgagcgcggcggcgcggagcgaggagggggcagggcggggtggggggggagggagggagggagggagcgaggagggcggccggggagggcgagggagggaggaagtccgagagacagagcgaggagcgctcctgaagggagacgtcgggctcgtccccggggtccaggccgcggtcccactcgcgggcgcagtcgcccggcgccggccgctcggccccgcggcctgggaggccgttgcgcaaggcagggcccgcggctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctc

SEQ ID NO: 94819 - DNA, 44 bp, Homo sapiens; identical to SEQ ID NO: 30240
  misc_feature 1..44: note = chr6:1390362-1390406
  misc_feature 1..44: note = hyper
  source 1..44: mol_type = genomic DNA

SEQ ID NO: 94820 - DNA, 336 bp, Homo sapiens
  misc_feature 1..336: note = chr6:1390423-1390759
  misc_feature 1..336: note = hyper
  source 1..336: mol_type = genomic DNA
cgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggc

SEQ ID NO: 94821 - DNA, 621 bp, Homo sapiens
  misc_feature 1..621: note = chr6:1390955-1391576
  misc_feature 1..621: note = hyper
  source 1..621: mol_type = genomic DNA
cgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaatt

SEQ ID NO: 94822 - DNA, 699 bp, Homo sapiens; identical to SEQ ID NO: 30322
  misc_feature 1..699: note = chr6:13924890-13925589
  misc_feature 1..699: note = hyper
  source 1..699: mol_type = genomic DNA

SEQ ID NO: 94823 - DNA, 205 bp, Homo sapiens
  misc_feature 1..205: note = chr6:1392844-1393049
  misc_feature 1..205: note = hyper
  source 1..205: mol_type = genomic DNA
cagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccag

SEQ ID NO: 94824 - DNA, 83 bp, Homo sapiens
  misc_feature 1..83: note = chr6:1393301-1393384
  misc_feature 1..83: note = hyper
  source 1..83: mol_type = genomic DNA
gccgcccactgaggcctgggggcccggcgaggcgcgggggtggccaaggcagtctccccggcacacagatcagcacatgtcta

SEQ ID NO: 94825 - DNA, 15 bp, Homo sapiens
  misc_feature 1..15: note = chr6:1393442-1393457
  misc_feature 1..15: note = hyper
  source 1..15: mol_type = genomic DNA
cgctcctgggcctgg

SEQ ID NO: 94826 - DNA, 30 bp, Homo sapiens
  misc_feature 1..30: note = chr6:139645132-139645162
  misc_feature 1..30: note = hyper
  source 1..30: mol_type = genomic DNA
ggtagataggagtcacgcccctcccccatt

SEQ ID NO: 94827 - DNA, 33 bp, Homo sapiens
  misc_feature 1..33: note = chr6:139720812-139720845
  misc_feature 1..33: note = hypo
  source 1..33: mol_type = genomic DNA
gggcacggtggtggtttacgtgtatagtctcaa

SEQ ID NO: 94828 - DNA, 30 bp, Homo sapiens
  misc_feature 1..30: note = chr6:14002445-14002475
  misc_feature 1..30: note = hypo
  source 1..30: mol_type = genomic DNA
ggtcccatcactggacgtgttccacggaga

SEQ ID NO: 94829 - DNA, 30 bp, Homo sapiens
  misc_feature 1..30: note = chr6:14140908-14140938
  misc_feature 1..30: note = hypo
  source 1..30: mol_type = genomic DNA
acttcacgtgtttcacgctagttttatcct

SEQ ID NO: 94830 - DNA, 156 bp, Homo sapiens; identical to SEQ ID NO: 40750
  misc_feature 1..156: note = chr6:14203256-14203412
  misc_feature 1..156: note = hypo
  source 1..156: mol_type = genomic DNA

SEQ ID NO: 94831 - DNA, 408 bp, Homo sapiens
  misc_feature 1..408: note = chr6:142409841-142410249
  misc_feature 1..408: note = hyper
  source 1..408: mol_type = genomic DNA
gccctgaggactgaacgcccacgatttaggtttaatcgatgtccctccctctcgcccctgcaagtttactgtccgcggggcaagcctcacagcaccacgtccctaagagttcaggacctggggaggggtctgtccacacactcgggcgctccgcttctagaggggggaaatggctccggctaactctgaatttaaattaaaaaaaaaaaaaaagcaaagcggttgcgtctttgttccgtattcagtggtttgttctcgcggttatctagcggaaaacagcctttcaggaacaaggagctgtcccttggggatcagtagaagcacctgccggactcttcgcccagagaagcagaagtcatcctggcgctgtccagcgggccgcagctgaaatcccgggaactaggcggg

SEQ ID NO: 94832 - DNA, 30 bp, Homo sapiens
  misc_feature 1..30: note = chr6:142444970-142445000
  misc_feature 1..30: note = hypo
  source 1..30: mol_type = genomic DNA
ggcacacccataagccgtagtttgccgaac

SEQ ID NO: 94833 - DNA, 249 bp, Homo sapiens
  misc_feature 1..249: note = chr6:142622714-142622963
  misc_feature 1..249: note = hyper
  source 1..249: mol_type = genomic DNA
cgtttcggcgacctccgggtccgccctgtcccctcccagctggggagctgagcccggctctgcgcccatcgccgaccccggccactctcccttcgctgctcgctccaaaagcgcctgtcccgccccgcggggcgacttctccctttcggccctggggttgaagatcctgtgtggggcagctgcgccttcgggacagccccagccgcggagcgcccagaccagggcagccggagtcgggtcatacgccgc

SEQ ID NO: 94834 - DNA, 76 bp, Homo sapiens
  misc_feature 1..76: note = chr6:14281293-14281369
  misc_feature 1..76: note = hypo
  source 1..76: mol_type = genomic DNA
ggtggtggacctcatcggtcatcacagacgtgccctggggatgctggcgccactccagccgcgtggtgggcaggca

SEQ ID NO: 94835 - DNA, 334 bp, Homo sapiens
  misc_feature 1..334: note = chr6:143247641-143247975
  misc_feature 1..334: note = hyper
  source 1..334: mol_type = genomic DNA
tgtgaaaagaaagagcgtatattctatccgggcaatgacaaacggactcaggcctcctgaggtcagcgctcctgggcaccatcaggccccacttcgggagcccccggtgctccgggcccacctgactgggcgtcctctgagtcagggaggtgccagtgctgtggtccccgcgagcccaactgtcccctgacccccgggcttttccgcaccgtggagtcccccgacacgctggggccagtgaacccgggccggggcgcgcgttctccctcccggaccagctcccggcgctgggcccgcggccgagaaactaggtctgggccggccctgcggcggc

SEQ ID NO: 94836 - DNA, 108 bp, Homo sapiens
  misc_feature 1..108: note = chr6:143248343-143248451
  misc_feature 1..108: note = hyper
  source 1..108: mol_type = genomic DNA
cgcctggatttcccacggggaggaaaaggcgtgcgtttccaggtgtttggaggacgcactggccgggcgcactttcctcagcgtaattttgaacgcagtttccctaaa

SEQ ID NO: 94837 - DNA, 312 bp, Homo sapiens
  misc_feature 1..312: note = chr6:143557301-143557613
  misc_feature 1..312: note = hypo
  source 1..312: mol_type = genomic DNA
ccttcttgggccttacgagttgtgccagttctcatgagttgagcgcatacggctggtgtccctcctggtgaccttcgcagccatctgggctggggcctgtgtctgtccggctcagcccagcggggcagggcctctgccgtgagtttgcagatgcctcattcggactccgagtctgtgactcacgccatctgttggtaatttgtcgttgttctggagtcaggagttttcaaaggattcagtctttggtgtcccttcacaggtgcactgcctgtgattttctgacaccctcttgccatccggcctatggccaga

SEQ ID NO: 94838 - DNA, 30 bp, Homo sapiens
  misc_feature 1..30: note = chr6:144277296-144277326
  misc_feature 1..30: note = hypo
  source 1..30: mol_type = genomic DNA
cctgtcagtgactcacgtgttcaaccttga

SEQ ID NO: 94839 - DNA, 144 bp, Homo sapiens
  misc_feature 1..144: note = chr6:144521927-144522071
  misc_feature 1..144: note = hypo
  source 1..144: mol_type = genomic DNA
cctagggtcattcagcggaggtattaccaccaatgagcgagtcatcaatgttaccttctatcctactgaccatcttcccctccacctccaggtacagcccgtccatgatctcccagatcttgtagatgtcggaaaacatctcat

SEQ ID NO: 94840 - DNA, 55 bp, Homo sapiens
  misc_feature 1..55: note = chr6:144607633-144607688
  misc_feature 1..55: note = hyper
  source 1..55: mol_type = genomic DNA
attggtgtgtagtcccgcgcagtcgccggctctccttttccggactctggggatc

SEQ ID NO: 94841 - DNA, 152 bp, Homo sapiens
  misc_feature 1..152: note = chr6:144622994-144623146
  misc_feature 1..152: note = hypo
  source 1..152: mol_type = genomic DNA
ccccaccctccccctcgccccaaaaaccaccatgaaggaggcagagggcaccaggtgaagactgcccatggtccttttcttacctctgtgacttcgcttgttttgtgttctgggcttgattgttctccttctccctgcgtccccagttttgc

SEQ ID NO: 94842 - DNA, 149 bp, Homo sapiens
  misc_feature 1..149: note = chr6:146349147-146349296
  misc_feature 1..149: note = hyper
  source 1..149: mol_type = genomic DNA
tgtgctctcctcgcccgctcccatagcccccttttcgtcgactctcaccttgagaaaaggagcaggggaggaacgggagagggagccaacttcagccccgcaggcggctgagatttggcgcctctgtccccaagcgggtgggtttggat

SEQ ID NO: 94843 - DNA, 282 bp, Homo sapiens
  misc_feature 1..282: note = chr6:146349511-146349793
  misc_feature 1..282: note = hyper
  source 1..282: mol_type = genomic DNA
aatgtctggctggaccgagcactgtccagggtcctgaaggcggcagggctcaggctgccgcggcgagagcaacccggaagctcccctccgttccctttctagcaactatgcaaaccccaaagcaagcgcaggaccccccctaacccgtccacccaccgcgggaaacaagttaccttatctgcaccccttcttcttgaacatacacagcaagcctgacttcttacgggggaaacataccaaactcctccatacggagactttaccaggcgttgccttagtaac

SEQ ID NO: 94844 - DNA, 454 bp, Homo sapiens
  misc_feature 1..454: note = chr6:146755460-146755914
  misc_feature 1..454: note = hyper
  source 1..454: mol_type = genomic DNA
cagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaa

SEQ ID NO: 94845 - DNA, 117 bp, Homo sapiens
  misc_feature 1..117: note = chr6:146864391-146864508
  misc_feature 1..117: note = hyper
  source 1..117: mol_type = genomic DNA
acccaagccaaggcccgcaagtgtggctctccctgcggggagagtagggcaggaggtggatttccaggccagaggcttccaggctgggcccggaccccacgccgaccccggccccgg

SEQ ID NO: 94846 - DNA, 116 bp, Homo sapiens; identical to SEQ ID NO: 30871
  misc_feature 1..116: note = chr6:146864762-146864878
  misc_feature 1..116: note = hyper
  source 1..116: mol_type = genomic DNA

SEQ ID NO: 94847 - DNA, 113 bp, Homo sapiens
  misc_feature 1..113: note = chr6:147828093-147828206
  misc_feature 1..113: note = hyper
  source 1..113: mol_type = genomic DNA
cacaagcagctccaccggctctccgcgttggtctctcccctccccctaagcagacagtcctttctgccagctgtccttaatttgagattcgtgagtcccggggtttgggaaac

SEQ ID NO: 94848 - DNA, 246 bp, Homo sapiens
  misc_feature 1..246: note = chr6:147829255-147829501
  misc_feature 1..246: note = hyper
  source 1..246: mol_type = genomic DNA
gaagggggattcaaacgcggatccggaaggaagggacactgaaccccgcagcgtccccagcgccgtggggcggcgggacgtgtccttgggctgccagcgggcgcggaagctggagtccggcagggtcgggaagaagtgagcacagacttccacgggtagaagagtcagattaaacagaaatgtgaaaagcaacccagggcagccaacggagcccagcagcgtagaagccaccggcttcccgccggg

SEQ ID NO: 94849 - DNA, 39 bp, Homo sapiens
  misc_feature 1..39: note = chr6:147829759-147829798
  misc_feature 1..39: note = hyper
  source 1..39: mol_type = genomic DNA
tccccgcggcggcagcgtcggcggcgcatccaggggcgg

SEQ ID NO: 94850 - DNA, 74 bp, Homo sapiens
  misc_feature 1..74: note = chr6:147830039-147830113
  misc_feature 1..74: note = hyper
  source 1..74: mol_type = genomic DNA
cggcggcggggttcccggtcccaccatgtgcaccaacatagtttacgagtggctcaaagcgctgcagcttccgc

SEQ ID NO: 94851 - DNA, 113 bp, Homo sapiens
  misc_feature 1..113: note = chr6:147830462-147830575
  misc_feature 1..113: note = hyper
  source 1..113: mol_type = genomic DNA
gatcagggataagctcgtccgtgacggcatccacctgagcaagcccccgtactcccgcaaggtaaggaggtgccgtccgggcggcccggggcgcgcggcgggaggggacacag

SEQ ID NO: 94852 - DNA, 30 bp, Homo sapiens
  misc_feature 1..30: note = chr6:147886875-147886905
  misc_feature 1..30: note = hypo
  source 1..30: mol_type = genomic DNA
gtgagccatcacacccggcctggatgctgg

SEQ ID NO: 94853 - DNA, 30 bp, Homo sapiens; identical to SEQ ID NO: 40903
  misc_feature 1..30: note = chr6:147981884-147981914
  misc_feature 1..30: note = hypo
  source 1..30: mol_type = genomic DNA

SEQ ID NO: 94854 - DNA, 457 bp, Homo sapiens
  misc_feature 1..457: note = chr6:148663337-148663794
  misc_feature 1..457: note = hyper
  source 1..457: mol_type = genomic DNA
atccaaacaatggctcgtgcccaagctttcacacttgttttgcagagaagtcttggctggcagaggcaggatttgtaattccttgggtcgcttgacttcacgaggggcgaggtatgcattgtagcgacacggactacttgtgaagcctttgggcgggagtcgcttaaagattaactttctcgggtttccgttaccaaaagcgtttccgtgaatagcgtgattggaaacttgtgcgggccggagaccgcggcgcggctgctctttcaacaggcgatttgttctcctgtccgaggctcatttccatgcaaagagcctgacatcagagcaccttttgttgctaaacgctttctttagcctcgagggagagagtcatgtggagctggaagagctcattttgaagagaggggtcccggggagctccctccaagatctagaggctccgcggccacccctgccg

SEQ ID NO: 94855 - DNA, 156 bp, Homo sapiens
  misc_feature 1..156: note = chr6:148664007-148664163
  misc_feature 1..156: note = hyper
  source 1..156: mol_type = genomic DNA
gtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgcc

SEQ ID NO: 94856 - DNA, 163 bp, Homo sapiens
  misc_feature 1..163: note = chr6:149068767-149068930
  misc_feature 1..163: note = hyper
  source 1..163: mol_type = genomic DNA
agcgggggaccccctcgcttcctgctcgacctgcggcagtacttgggtaaggaagctgggcaggcgctagggcggcgccgacagcgcaaagttgtgcggcggggagagggtcgcggcggggacttctcgcgctgccaccgcgcgccgccgccgccccgggtct

SEQ ID NO: 94857 - DNA, 320 bp, Homo sapiens
  misc_feature 1..320: note = chr6:149069188-149069508
  misc_feature 1..320: note = hyper
  source 1..320: mol_type = genomic DNA
agggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaacccgaggatcctcggcgctg

SEQ ID NO: 94858 - DNA, 38 bp, Homo sapiens
  misc_feature 1..38: note = chr6:149069731-149069769
  misc_feature 1..38: note = hyper
  source 1..38: mol_type = genomic DNA
agcgcaagcccaggtcgcaaggacgatgctggcactcg

SEQ ID NO: 94859 - DNA, 99 bp, Homo sapiens; identical to SEQ ID NO: 40904
  misc_feature 1..99: note = chr6:149177471-149177570
  misc_feature 1..99: note = hypo
  source 1..99: mol_type = genomic DNA

SEQ ID NO: 94860 - DNA, 71 bp, Homo sapiens
  misc_feature 1..71: note = chr6:149460105-149460176
  misc_feature 1..71: note = hypo
  source 1..71: mol_type = genomic DNA
aggttaaatgctcagcgcatctggccagagagttattatattacagcagagcatcacgagagtcagcagcg

SEQ ID NO: 94861 - DNA, 23 bp, Homo sapiens
  misc_feature 1..23: note = chr6:149498669-149498692
  misc_feature 1..23: note = hypo
  source 1..23: mol_type = genomic DNA
aattctccatccaatcgagtctt

SEQ ID NO: 94862 - DNA, 34 bp, Homo sapiens; identical to SEQ ID NO: 40907
  misc_feature 1..34: note = chr6:149772982-149773016
  misc_feature 1..34: note = hypo
  source 1..34: mol_type = genomic DNA

SEQ ID NO: 94863 - DNA, 192 bp, Homo sapiens
  misc_feature 1..192: note = chr6:149785967-149786159
  misc_feature 1..192: note = hypo
  source 1..192: mol_type = genomic DNA
agtggggctggagcacgaggaatgagcccgggcaacaggtgtaaagggaggggcaaggataagttcttagagagccaagggccactacgccactcgtgccttctcccgagaagcctggcagccaacccatatgcagacaaggatgacattttgaattcacactgctgtgctctctctcgtatgtgacctttc

SEQ ID NO: 94864 - DNA, 20 bp, Homo sapiens
  misc_feature 1..20: note = chr6:149868358-149868378
  misc_feature 1..20: note = hypo
  source 1..20: mol_type = genomic DNA
gccaccgcacctggcggaaa

SEQ ID NO: 94865 - DNA, 30 bp, Homo sapiens; identical to SEQ ID NO: 40751
  misc_feature 1..30: note = chr6:14999193-14999223
  misc_feature 1..30: note = hypo
  source 1..30: mol_type = genomic DNA

SEQ ID NO: 94866 - DNA, 23 bp, Homo sapiens
  misc_feature 1..23: note = chr6:150069440-150069463
  misc_feature 1..23: note = hypo
  source 1..23: mol_type = genomic DNA
tgagactccgtctcaatcaaaag

SEQ ID NO: 94867 - DNA, 85 bp, Homo sapiens
  misc_feature 1..85: note = chr6:150204851-150204936
  misc_feature 1..85: note = hypo
  source 1..85: mol_type = genomic DNA
caaagaattacttgcactgtgctcacataatttatacagtcagttctgctatatcaggttgtttgaaaaccgtactttattccaa

SEQ ID NO: 94868 - DNA, 425 bp, Homo sapiens
  misc_feature 1..425: note = chr6:150243820-150244245
  misc_feature 1..425: note = hyper
  source 1..425: mol_type = genomic DNA
ggcccctccactctccgggggttcctttccagcctcctctctgaccagctcctcccctcggaggataagtagcctctgggaacggacccggcgggaaggagacgcggagggaaactgagcgggggcgcagtccggggtgatcgcacgggtccttccagaagcctcccctcctctgaagcccacagtccacagccccccacggttggcctccgccccgcttaggctccatccccgaactcaccggccagcccggtcctgcaccagctggacagcaggagcagaagcgggaggcgtagaaggaacgcggggctggcggccgctgccattggggagttggatcgcaggggacagcagaagcgaagcccagcccgtggatcacctggcggctcgcaggctgtctgaatgcagcccgtctgaatgcagcc

SEQ ID NO: 94869 - DNA, 125 bp, Homo sapiens
  misc_feature 1..125: note = chr6:150246750-150246875
  misc_feature 1..125: note = hyper
  source 1..125: mol_type = genomic DNA
ggcgcccgctgtccccgagctccgggcctgagtgctggctggcggagacccacagtgggtgccccgctcccggacgatgcccctgggcttccagatccagagcctcgggacgaaactgtttcagg

SEQ ID NO: 94870 - DNA, 143 bp, Homo sapiens
  misc_feature 1..143: note = chr6:150262701-150262844
  misc_feature 1..143: note = hyper
  source 1..143: mol_type = genomic DNA
cccggactgtaatcacgtccactgggaactggcgcagtagtggaggggacgcgatcaggcccgtggctgcgcccagagcatgataagccagggacctcgcggcgcaggcggagggagggagagcgtcgcggacccaggcgggg

SEQ ID NO: 94871 - DNA, 702 bp, Homo sapiens
  misc_feature 1..702: note = chr6:150284667-150285369
  misc_feature 1..702: note = hyper
  source 1..702: mol_type = genomic DNA
gaggcaaaaaaggttcgctccggaatggggaagcggctgcgccctggacggagaggggcggggacttcgcgactgcaggcggagggagggcgggtgtcgctggcgcaggcggtgacagggagacaccgccgccactgagtattcctatgcaagtttcttcatcttcctgtgcatcagtgtttacactggggtaatgataaatgctgtgttgaaaaattatttgatggggccatggaaggaacggaaggaacggcgtcctggcccgctcggggcccgcgcacgccgccaccaagccgcgggggcgggtcggaggggagagttgcgtcagccaggccgctgtcagatgacgagcccggggcgtgacggggtggagcatccccaaaaaagtgcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccgg

SEQ ID NO: 94872 - DNA, 342 bp, Homo sapiens; identical to SEQ ID NO: 624
  misc_feature 1..342: note = chr6:150285544-150285886
  misc_feature 1..342: note = hyper
  source 1..342: mol_type = genomic DNA

SEQ ID NO: 94873 - DNA, 540 bp, Homo sapiens
  misc_feature 1..540: note = chr6:150286099-150286639
  misc_feature 1..540: note = hyper
  source 1..540: mol_type = genomic DNA
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccagggggagtgtcaaagaaggctgaaaaggaattgcaggagggtggagggaccaaaaggctacagagggcaaggtagggcggggatccctggtg

SEQ ID NO: 94874 - DNA, 109 bp, Homo sapiens
  misc_feature 1..109: note = chr6:150310096-150310205
  misc_feature 1..109: note = hyper
  source 1..109: mol_type = genomic DNA
ctcaacacagagtcccgccgtgtcctctgccccctccaatcctctcgtccctcccatcctcctgctgttatagaagatagaaagaaatcatttacgtagatagggtaaa

SEQ ID NO: 94875 - DNA, 39 bp, Homo sapiens
  misc_feature 1..39: note = chr6:150310414-150310453
  misc_feature 1..39: note = hyper
  source 1..39: mol_type = genomic DNA
tacagaagatggaaacggagcctcaatgagcacattcct

SEQ ID NO: 94876 - DNA, 373 bp, Homo sapiens
  misc_feature 1..373: note = chr6:150311072-150311445
  misc_feature 1..373: note = hyper
  source 1..373: mol_type = genomic DNA
tacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcccagggacgcgacaggggcagaaggagccctgcgtggggaattgagaagggtgcggcgcggtcagaaagatccgtcctccgcgacgccctctcctctttctccgacccattcctggaactcaccggctcgcgccgtccagggacagtc

SEQ ID NO: 94877 - DNA, 462 bp, Homo sapiens
  misc_feature 1..462: note = chr6:150311753-150312215
  misc_feature 1..462: note = hyper
  source 1..462: mol_type = genomic DNA
gtttcacaaagagcacggattgggttttgtactttttctgtgtggttggtttttgtgtgtctgtgggtgatgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagcaggcaccgggcgcctagcgggacccgcgggcggaactgcctttggaagacgcgtgagaactccaccccatcgcggcaggggacagttattatctccgagcttgaggtgaggggaaatcagaggcggctgatggtttcc

SEQ ID NO: 94878 - DNA, 98 bp, Homo sapiens
  misc_feature 1..98: note = chr6:150312685-150312783
  misc_feature 1..98: note = hyper
  source 1..98: mol_type = genomic DNA
atcaatgccttgagccggcgagtctctccccagtgctgagggctttgtgtgtgtggtgcactcctgcccctgccgcactcaggcgggcagctgatgtc

SEQ ID NO: 94879 - DNA, 461 bp, Homo sapiens
  misc_feature 1..461: note = chr6:150358524-150358985
  misc_feature 1..461: note = hyper
  source 1..461: mol_type = genomic DNA
gccaatgagagtggacgcaggcaggggcgggggagcctttcacacatgacttttcatggtttcgatcctgatacacgtgaatatatggaggtgaagtagtaaggaagggtggggccgggagccccggcgacggtcaccagttgagctcgcctgatctgttgtgggctacgagagtccggggacgggcaatctgggcagagtcgcacgaggctgctgcagtgatgaggcactggttctagaaatttacccaacggtgttgtcataggggggacattacaggtgattgctgatttcaaccacagatgactttcggggaaagttctctcctgggggtttctgtttctaccccgccgcgtcctctccgagttctgcgcgctcctcccagggcgcccgctgtccccgagctctggacccgggtcctgcccagtggagaccgcggagttggtgccccgcttgcggcc

SEQ ID NO: 94880 - DNA, 207 bp, Homo sapiens; identical to SEQ ID NO: 30885
  misc_feature 1..207: note = chr6:150358986-150359193
  misc_feature 1..207: note = hyper
  source 1..207: mol_type = genomic DNA

SEQ ID NO: 94881 - DNA, 15 bp, Homo sapiens
  misc_feature 1..15: note = chr6:150359438-150359453
  misc_feature 1..15: note = hyper
  source 1..15: mol_type = genomic DNA
cgggagaaagggaga

SEQ ID NO: 94882 - DNA, 30 bp, Homo sapiens
  misc_feature 1..30: note = chr6:150393330-150393360
  misc_feature 1..30: note = hypo
  source 1..30: mol_type = genomic DNA
taagcaaagaaagaacgagtctgaaagtgg

SEQ ID NO: 94883 - DNA, 20 bp, Homo sapiens
  misc_feature 1..20: note = chr6:150487217-150487237
  misc_feature 1..20: note = hypo
  source 1..20: mol_type = genomic DNA
tttttttttttgagacggag

SEQ ID NO: 94884 - DNA, 75 bp, Homo sapiens; identical to SEQ ID NO: 40752
  misc_feature 1..75: note = chr6:15073578-15073653
  misc_feature 1..75: note = hypo
  source 1..75: mol_type = genomic DNA

SEQ ID NO: 94885 - DNA, 30 bp, Homo sapiens; identical to SEQ ID NO: 40909
  misc_feature 1..30: note = chr6:150985942-150985972
  misc_feature 1..30: note = hypo
  source 1..30: mol_type = genomic DNA

SEQ ID NO: 94886 - DNA, 21 bp, Homo sapiens
  misc_feature 1..21: note = chr6:15129502-15129523
  misc_feature 1..21: note = hypo
  source 1..21: mol_type = genomic DNA
acagtttcggccgggcgcggt

SEQ ID NO: 94887 - DNA, 61 bp, Homo sapiens
  misc_feature 1..61: note = chr6:151346311-151346372
  misc_feature 1..61: note = hypo
  source 1..61: mol_type = genomic DNA
ttccctacatgtaggcgtcttcagagtgaacctgttgctcagggcccgcgagcccacaggg

SEQ ID NO: 94888 - DNA, 376 bp, Homo sapiens
  misc_feature 1..376: note = chr6:151560965-151561341
  misc_feature 1..376: note = hyper
  source 1..376: mol_type = genomic DNA
tccgtggcctgactgcgttaacctctcggttccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 94889 - DNA, 624 bp, Homo sapiens; identical to SEQ ID NO: 8773
  misc_feature 1..624: note = chr6:151561368-151561992
  misc_feature 1..624: note = hyper
  source 1..624: mol_type = genomic DNA

SEQ ID NO: 94890 - DNA, 540 bp, Homo sapiens
  misc_feature 1..540: note = chr6:151562056-151562596
  misc_feature 1..540: note = hyper
  source 1..540: mol_type = genomic DNA
cgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctag

SEQ ID NO: 94891 - DNA, 49 bp, Homo sapiens
  misc_feature 1..49: note = chr6:1515653-1515702
  misc_feature 1..49: note = hypo
  source 1..49: mol_type = genomic DNA
ggaggaggtggaacccgcggccggagacacacgccgtggggtcggtcaa

SEQ ID NO: 94892 - DNA, 735 bp, Homo sapiens
  misc_feature 1..735: note = chr6:151814876-151815611
  misc_feature 1..735: note = hyper
  source 1..735: mol_type = genomic DNA
ttcctatgcctcactcgcgccagcaccgttcacagtgcccactggctgtatttatcgctgacataaggatgaggcctggaattgcattcactgcagagtcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 94893 - DNA, 34 bp, Homo sapiens
  misc_feature 1..34: note = chr6:151815845-151815879
  misc_feature 1..34: note = hyper
  source 1..34: mol_type = genomic DNA
ttagatgtaccaatgcgcgcgcgcacacacacac

SEQ ID NO: 94894 - DNA, 30 bp, Homo sapiens
  misc_feature 1..30: note = chr6:15213893-15213923
  misc_feature 1..30: note = hypo
  source 1..30: mol_type = genomic DNA
gtgagccaccgtgcccggccctgtatatac

SEQ ID NO: 94895 - DNA, 87 bp, Homo sapiens
  misc_feature 1..87: note = chr6:15223030-15223117
  misc_feature 1..87: note = hypo
  source 1..87: mol_type = genomic DNA
aaaaagttaaaaaaaaaatctggaaaaactcagctgtttattgatccctcaggctctggggtaatttccagtcgtacaaatagatgc

SEQ ID NO: 94896 - DNA, 271 bp, Homo sapiens
  misc_feature 1..271: note = chr6:1524158-1524429
  misc_feature 1..271: note = hyper
  source 1..271: mol_type = genomic DNA
caagtctcgcagaagcgtgtgaaaatccccacgctcagtcgccctctccctgcacacgccccgagtccgcgtctccctcctgtgtgaatgcagggaaagcgggagcgcggcgaggggtctggtgcggaccagcccccgagccacagagtgcggggcccgagctccggaagcccagcctgggccgcgacggccccaattccagcaacgctagagggcgcccgtgccaagcgcccgctcccggcaagccgcgtgctcccgggtggccgcaacc

SEQ ID NO: 94897 - DNA, 151 bp, Homo sapiens; identical to SEQ ID NO: 40910
  misc_feature 1..151: note = chr6:152520849-152521000
  misc_feature 1..151: note = hypo
  source 1..151: mol_type = genomic DNA

SEQ ID NO: 94898 - DNA, 30 bp, Homo sapiens
  misc_feature 1..30: note = chr6:152539785-152539815
  misc_feature 1..30: note = hypo
  source 1..30: mol_type = genomic DNA
catgatcaaacaacacgtctgaaaaatctt

SEQ ID NO: 94899 - DNA, 196 bp, Homo sapiens
  misc_feature 1..196: note = chr6:152562427-152562623
  misc_feature 1..196: note = hypo
  source 1..196: mol_type = genomic DNA
gggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaa

SEQ ID NO: 94900 - DNA, 579 bp, Homo sapiens
  misc_feature 1..579: note = chr6:152622914-152623493
  misc_feature 1..579: note = hyper
  source 1..579: mol_type = genomic DNA
ccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttctaatcgcgagaggccccatat

SEQ ID NO: 94901 - DNA, 363 bp, Homo sapiens
  misc_feature 1..363: note = chr6:152957418-152957781
  misc_feature 1..363: note = hyper
  source 1..363: mol_type = genomic DNA
tagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctct

SEQ ID NO: 94902 - DNA, 184 bp, Homo sapiens; identical to SEQ ID NO: 30893
  misc_feature 1..184: note = chr6:152957815-152957999
  misc_feature 1..184: note = hyper
  source 1..184: mol_type = genomic DNA

SEQ ID NO: 94903 - DNA, 503 bp, Homo sapiens
  misc_feature 1..503: note = chr6:152958000-152958503
  misc_feature 1..503: note = hyper
  source 1..503: mol_type = genomic DNA
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagc

SEQ ID NO: 94904 - DNA, 37 bp, Homo sapiens
  misc_feature 1..37: note = chr6:15302352-15302389
  misc_feature 1..37: note = hypo
  source 1..37: mol_type = genomic DNA
gagtaatgaagaggccgggtgcagtggctcatgcctg

SEQ ID NO: 94905 - DNA, 30 bp, Homo sapiens
  misc_feature 1..30: note = chr6:153272474-153272504
  misc_feature 1..30: note = hypo
  source 1..30: mol_type = genomic DNA
gtgtaaataaaagttcggatatatctaata

SEQ ID NO: 94906 - DNA, 625 bp, Homo sapiens
  misc_feature 1..625: note = chr6:153450977-153451602
  misc_feature 1..625: note = hyper
  source 1..625: mol_type = genomic DNA
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccct

SEQ ID NO: 94907 - DNA, 468 bp, Homo sapiens
  misc_feature 1..468: note = chr6:153451662-153452130
  misc_feature 1..468: note = hyper
  source 1..468: mol_type = genomic DNA
ctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 94908 - DNA, 612 bp, Homo sapiens
  misc_feature 1..612: note = chr6:153452143-153452755
  misc_feature 1..612: note = hyper
  source 1..612: mol_type = genomic DNA
cgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 94909 - DNA, 39 bp, Homo sapiens
  misc_feature 1..39: note = chr6:153452788-153452827
  misc_feature 1..39: note = hyper
  source 1..39: mol_type = genomic DNA
cgcgggagccttgcacccaggagccggcctgccaggcac

SEQ ID NO: 94910 - DNA, 38 bp, Homo sapiens
  misc_feature 1..38: note = chr6:153472441-153472479
  misc_feature 1..38: note = hypo
  source 1..38: mol_type = genomic DNA
gtgtgtcatgattttgttaatgacgttatgttaacttc

SEQ ID NO: 94911 - DNA, 377 bp, Homo sapiens
  misc_feature 1..377: note = chr6:154360574-154360951
  misc_feature 1..377: note = hyper
  source 1..377: mol_type = genomic DNA
gagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggt

SEQ ID NO: 94912 - DNA, 40 bp, Homo sapiens; identical to SEQ ID NO: 40753
  misc_feature 1..40: note = chr6:15456031-15456071
  misc_feature 1..40: note = hypo
  source 1..40: mol_type = genomic DNA

SEQ ID NO: 94913 - DNA, 99 bp, Homo sapiens
  misc_feature 1..99: note = chr6:154771265-154771364
  misc_feature 1..99: note = hypo
  source 1..99: mol_type = genomic DNA
tcctggtgtccaatccgtgtgacccccagctcctccaggtcctgatgggaaatctgcagcagctgctcgccgttgatcttctctcgttcaaacttgtgg

SEQ ID NO: 94914 - DNA, 62 bp, Homo sapiens
  misc_feature 1..62: note = chr6:154796421-154796483
  misc_feature 1..62: note = hypo
  source 1..62: mol_type = genomic DNA
ggcccttctccacctcgtccctcctggccaccatctctccccctgggcgcccttccctcccc

SEQ ID NO: 94915 - DNA, 173 bp, Homo sapiens
  misc_feature 1..173: note = chr6:154830592-154830765
  misc_feature 1..173: note = hyper
  source 1..173: mol_type = genomic DNA
aaagtcactgcctcccggggagtcctggctcgaggtttctccctggcgcaaatgctatggtgttggcttttgcgcggccctctcgccttctccaacaaaaacagacaggctcggcggacccgccggagtctccctctacctgtccgacagccctgtcacgcctgcggacggct

SEQ ID NO: 94916 - DNA, 103 bp, Homo sapiens; identical to SEQ ID NO: 40911
  misc_feature 1..103: note = chr6:154970495-154970598
  misc_feature 1..103: note = hypo
  source 1..103: mol_type = genomic DNA

SEQ ID NO: 94917 - DNA, 40 bp, Homo sapiens
  misc_feature 1..40: note = chr6:15512658-15512698
  misc_feature 1..40: note = hypo
  source 1..40: mol_type = genomic DNA
catccctgtgagtgccgtgcgtgagcgcacacagaagcat

SEQ ID NO: 94918 - DNA, 38 bp, Homo sapiens
  misc_feature 1..38: note = chr6:155281592-155281630
  misc_feature 1..38: note = hypo
  source 1..38: mol_type = genomic DNA
caccttccctgttcacgccatcacgttgctgtctcctt

SEQ ID NO: 94919 - DNA, 195 bp, Homo sapiens
  misc_feature 1..195: note = chr6:155316026-155316221
  misc_feature 1..195: note = hyper
  source 1..195: mol_type = genomic DNA
tgggtcttggagtgccgactcgattgccatctccgctgcgaagccatctcctctcagaaggggaaggagatggaaagtctctgcggccgctgacctcagttttgcgtgcctttcctcggtgggacccgggaagagccgtctttaaattccttggggaagggacggggtcgcactggcgcatcgcatccccggtag

SEQ ID NO: 94920 - DNA, 1084 bp, Homo sapiens
  misc_feature 1..1084: note = chr6:155316256-155317340
  misc_feature 1..1084: note = hyper
  source 1..1084: mol_type = genomic DNA
cgatgtttcttgaattgttttatttgtgttgttccaaagaaagcgcgagggacatggtccgggaccagccgggagctggcgcgggggtcctgggcctgacgctgggcggggctggggcgtgtccggggcggggcggggcgggaggtgcggtcgcggctcgggcctggcaggcgctgcgcgcggggctggggcagcggtaaccgtaactgtggccgcggccgccgcaggcgcacagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgaggtaaggggcgcccgggtgagggcgcaggagggcgacgacccgcgctggttggcggcggctccaggtcccctgcgggcggggcggcgcgcggccggcggtcccctcccttcccctttgttggccgcccctctctgcccccgctttcctgggagtcccgcggaaggtcgcggctgcggggcgcggcctggcaccctctccccggagggcggcagcgtccgggcacagcctggcacgggggacgaagcactttccagaaggctctgaaactaggtcccctggtcccctcgcgctgcgcgacacgccaggacccactttcagccccggtcccatcccggatgggaggaggcggcgccccggcctcctgataccgaggttctcgcccaaagccgagccgtgggtgcccggaggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccgctggaaaggtctg

SEQ ID NO: 94921 - DNA, 30 bp, Homo sapiens
  misc_feature 1..30: note = chr6:155438513-155438543
  misc_feature 1..30: note = hypo
  source 1..30: mol_type = genomic DNA
tatttgtgggattgccggtttcaccatctc

SEQ ID NO: 94922 - DNA, 140 bp, Homo sapiens
  misc_feature 1..140: note = chr6:155568772-155568912
  misc_feature 1..140: note = hypo
  source 1..140: mol_type = genomic DNA
cttttaatgaattgtttgaaactcactttttaggccacctataacaatatttctcatgggtatgcatgaaatgtgtctttaaagtcagacattcctgcattttgagtcagtgttagtctttggggcgcagcctgcattcc

SEQ ID NO: 94923 - DNA, 74 bp, Homo sapiens
  misc_feature 1..74: note = chr6:155569275-155569349
  misc_feature 1..74: note = hypo
  source 1..74: mol_type = genomic DNA
gacggaccaggagagcgaggagcactaccacctgacgggtgaggcggcggcggcacctccgggcgagggcctgc

SEQ ID NO: 94924 - DNA, 30 bp, Homo sapiens; identical to SEQ ID NO: 14887
  misc_feature 1..30: note = chr6:155988231-155988261
  misc_feature 1..30: note = hypo
  source 1..30: mol_type = genomic DNA

SEQ ID NO: 94925 - DNA, 158 bp, Homo sapiens
  misc_feature 1..158: note = chr6:156817422-156817580
  misc_feature 1..158: note = hypo
  source 1..158: mol_type = genomic DNA
gttgcctcgttcaggcgttcagtcttggtggcccggaattagtaccttgatgcccttctcaaacaactggaagtatttcctgcagaaagcccacgatctgcctaagaagggatcgtcaccagataaagccatgatgcatatctcgtcagtgaaaacag

SEQ ID NO: 94926 - DNA, 30 bp, Homo sapiens
  misc_feature 1..30: note = chr6:157040065-157040095
  misc_feature 1..30: note = hypo
  source 1..30: mol_type = genomic DNA
aaggaaaacactcggcgcattccacatttt

SEQ ID NO: 94927 - DNA, 179 bp, Homo sapiens
  misc_feature 1..179: note = chr6:157103443-157103622
  misc_feature 1..179: note = hyper
  source 1..179: mol_type = genomic DNA
ggtggcaaatgttttcgtaattgggacaaaacgtgtatatattataggagaagggtctttttaaaaagtgaaataagccatttgacgattcagtttattactagatttttgtaagatgagtattcagatggagcagtctcaaaaggaatattgaggtctactcacgcacataggtttta

SEQ ID NO: 94928 - DNA, 30 bp, Homo sapiens
  misc_feature 1..30: note = chr6:157255695-157255725
  misc_feature 1..30: note = hypo
  source 1..30: mol_type = genomic DNA
ggagttctatatatgcgtgtttattggttt

SEQ ID NO: 94929 - DNA, 30 bp, Homo sapiens; identical to SEQ ID NO: 40915
  misc_feature 1..30: note = chr6:157283403-157283433
  misc_feature 1..30: note = hypo
  source 1..30: mol_type = genomic DNA

SEQ ID NO: 94930 - DNA, 30 bp, Homo sapiens
  misc_feature 1..30: note = chr6:157301697-157301727
  misc_feature 1..30: note = hypo
  source 1..30: mol_type = genomic DNA
acagagatgaaaccacgcagtgcttttccc

SEQ ID NO: 94931 - DNA, 30 bp, Homo sapiens
  misc_feature 1..30: note = chr6:157431645-157431675
  misc_feature 1..30: note = hypo
  source 1..30: mol_type = genomic DNA
atccagttcccatcccgccttgagccagtc

SEQ ID NO: 94932 - DNA, 30 bp, Homo sapiens; identical to SEQ ID NO: 40916
  misc_feature 1..30: note = chr6:157455406-157455436
  misc_feature 1..30: note = hypo
  source 1..30: mol_type = genomic DNA

SEQ ID NO: 94933 - DNA, 193 bp, Homo sapiens
  misc_feature 1..193: note = chr6:157478285-157478478
  misc_feature 1..193: note = hypo
  source 1..193: mol_type = genomic DNA
gtggctgtgctcactcggagatggctcaccgtgactcgcgcaccactgtctatgccacctgtcttcacttccagcttcatggctctgttaacatcccgcccccatagatacacacttacaccagatgtcctgggatcgtcacagcgagaaccagcattaaagcgcacccatcactaggcgtcattagcagccc

SEQ ID NO: 94934 - DNA, 30 bp, Homo sapiens
  misc_feature 1..30: note = chr6:157502438-157502468
  misc_feature 1..30: note = hypo
  source 1..30: mol_type = genomic DNA
ccttcttgcaacccacgtctgtgtgctgtc

SEQ ID NO: 94935 - DNA, 48 bp, Homo sapiens; identical to SEQ ID NO: 40918
  misc_feature 1..48: note = chr6:157505817-157505865
  misc_feature 1..48: note = hypo
  source 1..48: mol_type = genomic DNA

SEQ ID NO: 94936 - DNA, 30 bp, Homo sapiens
  misc_feature 1..30: note = chr6:157506082-157506112
  misc_feature 1..30: note = hypo
  source 1..30: mol_type = genomic DNA
aatttaacaagctgtcgtggtaaggatcca

SEQ ID NO: 94937 - DNA, 543 bp, Homo sapiens
  misc_feature 1..543: note = chr6:157556754-157557297
  misc_feature 1..543: note = hyper
  source 1..543: mol_type = genomic DNA
aaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 94938 - DNA, 31 bp, Homo sapiens
  misc_feature 1..31: note = chr6:157637384-157637415
  misc_feature 1..31: note = hypo
  source 1..31: mol_type = genomic DNA
cagcttcctgtagctcgtcccaaggtccatt

SEQ ID NO: 94939 - DNA, 84 bp, Homo sapiens; identical to SEQ ID NO: 40920
  misc_feature 1..84: note = chr6:157638362-157638446
  misc_feature 1..84: note = hypo
  source 1..84: mol_type = genomic DNA

SEQ ID NO: 94940 - DNA, 256 bp, Homo sapiens
  misc_feature 1..256: note = chr6:157912932-157913188
  misc_feature 1..256: note = hypo
  source 1..256: mol_type = genomic DNA
gaattacgtcttgtgcggatttgccattttcagaagcgcacagagctcacctgttgagtaaccgcgccacttcctggtccctaccacaggccggccagggaagccggggctccccgccagaacactgcctcgccttcatcacagcaccagttgccggtgttggttgcggcacctcaggtgctccatccagcagccctccaggcaggtgctgtcactgtcccctctcaccggggaggaaacccggccttttcccttg

SEQ ID NO: 94941 - DNA, 30 bp, Homo sapiens
  misc_feature 1..30: note = chr6:15802460-15802490
  misc_feature 1..30: note = hypo
  source 1..30: mol_type = genomic DNA
gtatacaccaagggacgggacaatcttggg

SEQ ID NO: 94942 - DNA, 38 bp, Homo sapiens
  misc_feature 1..38: note = chr6:158072190-158072228
  misc_feature 1..38: note = hypo
  source 1..38: mol_type = genomic DNA
ttgttctgttatagtcggaggctcgaagccttaaatca

SEQ ID NO: 94943 - DNA, 307 bp, Homo sapiens
  misc_feature 1..307: note = chr6:158093775-158094082
  misc_feature 1..307: note = hypo
  source 1..307: mol_type = genomic DNA
tcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtg

SEQ ID NO: 94944 - DNA, 30 bp, Homo sapiens; identical to SEQ ID NO: 14891
  misc_feature 1..30: note = chr6:158119028-158119058
  misc_feature 1..30: note = hypo
  source 1..30: mol_type = genomic DNA

SEQ ID NO: 94945 - DNA, 30 bp, Homo sapiens
  misc_feature 1..30: note = chr6:158245801-158245831
  misc_feature 1..30: note = hypo
  source 1..30: mol_type = genomic DNA
ttggttttattaatgcgatagaacttgcca

SEQ ID NO: 94946 - DNA, 154 bp, Homo sapiens
  misc_feature 1..154: note = chr6:158430536-158430690
  misc_feature 1..154: note = hyper
  source 1..154: mol_type = genomic DNA
tctggcaagaggagtcgaggaagggggctgaggaggtagaagggagggctttcctcaaaaggccagaaattcgtggccagccaaaggggaagcaaagacattctcgtgtaggaaaacttacaggaaatgcaactaaaagcgtgggagacaggaa

SEQ ID NO: 94947 - DNA, 185 bp, Homo sapiens
  misc_feature 1..185: note = chr6:15843746-15843931
  misc_feature 1..185: note = hypo
  source 1..185: mol_type = genomic DNA
taaaggcattgttaacgtccattgggcagaaaggacgttagagtttttctggtgacataggccacagagtcaagtgacttccctaaagccacacagctagttatgggcaaagccgggaagaccactcaggtattcttgttttcacgacaagtcaatatctacagataacgcgtgaatggctggaa

SEQ ID NO: 94948 - DNA, 184 bp, Homo sapiens; identical to SEQ ID NO: 40924
  misc_feature 1..184: note = chr6:158489608-158489792
  misc_feature 1..184: note = hypo
  source 1..184: mol_type = genomic DNA

SEQ ID NO: 94949 - DNA, 30 bp, Homo sapiens
  misc_feature 1..30: note = chr6:158937301-158937331
  misc_feature 1..30: note = hyper
  source 1..30: mol_type = genomic DNA
tcaggggagggaacacgaaaggaaactctc

SEQ ID NO: 94950 - DNA, 35 bp, Homo sapiens
  misc_feature 1..35: note = chr6:158957282-158957317
  misc_feature 1..35: note = hyper
  source 1..35: mol_type = genomic DNA
gcaggaaagggccttcggtccgcccccaagcacca

SEQ ID NO: 94951 - DNA, 241 bp, Homo sapiens
  misc_feature 1..241: note = chr6:158957747-158957988
  misc_feature 1..241: note = hyper
  source 1..241: mol_type = genomic DNA
acccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggtgggcgcggcgcgggcagcggcggggcggccggaggcttccgggccgcagtcccctccgggaccccggcgcgccccggccttggcctggt

SEQ ID NO: 94952 - DNA, 489 bp, Homo sapiens
  misc_feature 1..489: note = chr6:158958194-158958683
  misc_feature 1..489: note = hyper
  source 1..489: mol_type = genomic DNA
cccggaaaggagctgcgggttgtggctcctccctgcgccccgcgtcgttctccccccgcgcccgcctcgccgcccccgctcgggcctcacgcggcgcagtctggggaggcgaccgcgcgcgctgcggcgtcgggaggagggtcttggccgcagctctgagcgccctaggctttgcaggacgcctcggaggcgggggcgccgccaagggctgggggcggatgggcgcggcggggaagacgcggcggggcgccatgcggggacacggcgcctgggagcggctgtgtggaacttgtttgcgttcatctctgtctccctcttcagcggcctaggggagagcggtggggactgcagaccctggcgccggcccccgcccccttcctctctgcgctctgcagttcggaggggaaggaaagtctgttcaccgccaatggccgatttacccaaaggcttggcggtgtcgggacaggaccctatcgcgagtcggtagaa

SEQ ID NO: 94953 - DNA, 30 bp, Homo sapiens; identical to SEQ ID NO: 40925
  misc_feature 1..30: note = chr6:158978998-158979028
  misc_feature 1..30: note = hypo
  source 1..30: mol_type = genomic DNA

SEQ ID NO: 94954 - DNA, 79 bp, Homo sapiens
  misc_feature 1..79: note = chr6:158982731-158982810
  misc_feature 1..79: note = hypo
  source 1..79: mol_type = genomic DNA
ggaggacaagcaaaacgcagcttgaattttgtgcgagtttgaggcctccccctgcagctgtaagcgctttgtgcctcag

SEQ ID NO: 94955 - DNA, 138 bp, Homo sapiens
  misc_feature 1..138: note = chr6:159049745-159049883
  misc_feature 1..138: note = hypo
  source 1..138: mol_type = genomic DNA
ccccaggtcaggtttcgggtggcagagcccggctccaaacccagagaggctggcgctctggagcgtgcccacgccacgctgctttccacccagaggggcaggtgctgtgaggtaaatgaggtgcggttgcctctccac

SEQ ID NO: 94956 - DNA, 21 bp, Homo sapiens
  misc_feature 1..21: note = chr6:159081339-159081360
  misc_feature 1..21: note = hypo
  source 1..21: mol_type = genomic DNA
gaacagcgcctggggtgttca

SEQ ID NO: 94957 - DNA, 30 bp, Homo sapiens; identical to SEQ ID NO: 40928
  misc_feature 1..30: note = chr6:159113607-159113637
  misc_feature 1..30: note = hypo
  source 1..30: mol_type = genomic DNA

SEQ ID NO: 94958 - DNA, 22 bp, Homo sapiens
  misc_feature 1..22: note = chr6:159151570-159151592
  misc_feature 1..22: note = hypo
  source 1..22: mol_type = genomic DNA
ggcgccccactgcctcgttgcg

SEQ ID NO: 94959 - DNA, 21 bp, Homo sapiens
  misc_feature 1..21: note = chr6:159151652-159151673
  misc_feature 1..21: note = hypo
  source 1..21: mol_type = genomic DNA
gcaacgcggaaagaaagcagc

SEQ ID NO: 94960 - DNA, 35 bp, Homo sapiens
  misc_feature 1..35: note = chr6:159151892-159151927
  misc_feature 1..35: note = hypo
  source 1..35: mol_type = genomic DNA
aaagccgccagggggcgggtcggggtggggcggtg

SEQ ID NO: 94961 - DNA, 50 bp, Homo sapiens
  misc_feature 1..50: note = chr6:159194739-159194789
  misc_feature 1..50: note = hypo
  source 1..50: mol_type = genomic DNA
gaggcaaaaaggcagcggggctcctgggaaggtcacgtgggggaagcgtc

SEQ ID NO: 94962 - DNA, 30 bp, Homo sapiens
  misc_feature 1..30: note = chr6:159195237-159195267
  misc_feature 1..30: note = hypo
  source 1..30: mol_type = genomic DNA
ggtggggcagtgcctcgagcagccctgggg

SEQ ID NO: 94963 - DNA, 30 bp, Homo sapiens
  misc_feature 1..30: note = chr6:159228054-159228084
  misc_feature 1..30: note = hypo
  source 1..30: mol_type = genomic DNA
acataacaggccaggcgcagtggctcacgc

SEQ ID NO: 94964 - DNA, 265 bp, Homo sapiens
  misc_feature 1..265: note = chr6:159252784-159253049
  misc_feature 1..265: note = hypo
  source 1..265: mol_type = genomic DNA
gcaggtgctaactggcgggtgggcagggatgacgcccataggaatgttgacaaactgggttttgtgaatctcccgaagctcagaactctgatggcatcgattcttggtggctcttcctcccttctcttccctttatcccaaggtctggccatcggatcctagaacttgcaactgagaagggggagacctggcttccatgtagaggacacacgatttcctcccctctgagggggctcgtgagggtgactgtcgggcctctcctgga

SEQ ID NO: 94965 - DNA, 39 bp, Homo sapiens
  misc_feature 1..39: note = chr6:159270065-159270104
  misc_feature 1..39: note = hypo
  source 1..39: mol_type = genomic DNA
catgctggccaggcacggtggctcacacctgtaatccta

SEQ ID NO: 94966 - DNA, 36 bp, Homo sapiens
  misc_feature 1..36: note = chr6:159343088-159343124
  misc_feature 1..36: note = hypo
  source 1..36: mol_type = genomic DNA
aaaagctgaaggaagcgacatcgtcgtacctggctt

SEQ ID NO: 94967 - DNA, 46 bp, Homo sapiens
  misc_feature 1..46: note = chr6:159456944-159456990
  misc_feature 1..46: note = hypo
  source 1..46: mol_type = genomic DNA
tcctctgcacggactcggagacggtcctcagcgggaggagctcagg

SEQ ID NO: 94968 - DNA, 18 bp, Homo sapiens
  misc_feature 1..18: note = chr6:159537157-159537175
  misc_feature 1..18: note = hypo
  source 1..18: mol_type = genomic DNA
agtctggctgctgggcgg

SEQ ID NO: 94969 - DNA, 49 bp, Homo sapiens
  misc_feature 1..49: note = chr6:159551945-159551994
  misc_feature 1..49: note = hypo
  source 1..49: mol_type = genomic DNA
agtcccgaggacactcgcttccctgcagcccgtccgccctccataagcc

SEQ ID NO: 94970 - DNA, 164 bp, Homo sapiens
  misc_feature 1..164: note = chr6:159569246-159569410
  misc_feature 1..164: note = hypo
  source 1..164: mol_type = genomic DNA
gggccattttaaacagcgaaatcaccaacaatgaccacaaaaattgtgaaaaccatagcggtaaagaaatagtgaaaaggacacttgtttacactgtcagagctgggacaagaaggcagggtgtcaccttgttagacttcagccgagaacgtgccagttgggtg

SEQ ID NO: 94971 - DNA, 177 bp, Homo sapiens
  misc_feature 1..177: note = chr6:159589910-159590087
  misc_feature 1..177: note = hyper
  source 1..177: mol_type = genomic DNA
aactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcc

SEQ ID NO: 94972 - DNA, 608 bp, Homo sapiens; identical to SEQ ID NO: 2944
  misc_feature 1..608: note = chr6:159590154-159590762
  misc_feature 1..608: note = hyper
  source 1..608: mol_type = genomic DNA

SEQ ID NO: 94973 - DNA, 306 bp, Homo sapiens
  misc_feature 1..306: note = chr6:159590971-159591277
  misc_feature 1..306: note = hyper
  source 1..306: mol_type = genomic DNA
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagc

SEQ ID NO: 94974 - DNA, 30 bp, Homo sapiens
  misc_feature 1..30: note = chr6:159653218-159653248
  misc_feature 1..30: note = hypo
  source 1..30: mol_type = genomic DNA
acccaagaccagaaacggaccctgaggccg

SEQ ID NO: 94975 - DNA, 106 bp, Homo sapiens; identical to SEQ ID NO: 30908
  misc_feature 1..106: note = chr6:159654897-159655003
  misc_feature 1..106: note = hyper
  source 1..106: mol_type = genomic DNA

SEQ ID NO: 94976 - DNA, 30 bp, Homo sapiens
  misc_feature 1..30: note = chr6:159660826-159660856
  misc_feature 1..30: note = hypo
  source 1..30: mol_type = genomic DNA
ccaacaaccacagtccgaaccactacgcgg

SEQ ID NO: 94977 - DNA, 30 bp, Homo sapiens
  misc_feature 1..30: note = chr6:159925862-159925892
  misc_feature 1..30: note = hypo
  source 1..30: mol_type = genomic DNA
gttcctggtgcccaccgcggaatggacggg

SEQ ID NO: 94978 - DNA, 58 bp, Homo sapiens
  misc_feature 1..58: note = chr6:160248421-160248479
  misc_feature 1..58: note = hypo
  source 1..58: mol_type = genomic DNA
cacaggactgcagctcgtgcctcaggctcaggctcagccccggcgcctcctggcggag

SEQ ID NO: 94979 - DNA, 30 bp, Homo sapiens; identical to SEQ ID NO: 30909
  misc_feature 1..30: note = chr6:160402852-160402882
  misc_feature 1..30: note = hyper
  source 1..30: mol_type = genomic DNA

SEQ ID NO: 94980 - DNA, 61 bp, Homo sapiens
  misc_feature 1..61: note = chr6:160450704-160450765
  misc_feature 1..61: note = hypo
  source 1..61: mol_type = genomic DNA
tgatcactaatgtggcgcacagtagcctgggttgcccatgcgaacgcgtttctgggcttgg

SEQ ID NO: 94981 - DNA, 30 bp, Homo sapiens
  misc_feature 1..30: note = chr6:160476041-160476071
  misc_feature 1..30: note = hypo
  source 1..30: mol_type = genomic DNA
tagagttgaagatctcggtgatcagggaat

SEQ ID NO: 94982 - DNA, 666 bp, Homo sapiens
  misc_feature 1..666: note = chr6:1604877-1605543
  misc_feature 1..666: note = hyper
  source 1..666: mol_type = genomic DNA
cggccaaggggcctccgggcttccacatcgtccctttttctgctgacgctcgcggggaagcggcgggaagcctgtgaggggcggcctgggagcagacggaccaccaggtcaccggcgcgcgctgccaggcgccgacccactcgcgaggaccagcggttcccggaggcgtcggccctcaggtcctcgggggaggccggctgcaccgagccgggtgtcggccttgtccctgtcctgagaggtgcaaacaccggccccggcccaggcccccggggctcctgcccagaaggctcagagctgggggccgaccgcgccttacccgcaggaggcccggcggtgcgtccgcgttggtgccactccccggccggggtgagggacgtcggaaggaaggtcccagggcgcagggttccgcgaagggagcactcggaaggaaggctggctgcggccccggcgcctgggtccgctgcggcgccgggccggagacctgggaacagccagccacctgcaaggttgcagcccacctcaccccgccggcggctccggggctgtctgtgggtctgtctcacggggcaaagcctttcttcccacacccacagccaaggcgcgtccgtgcaggggcacacgccttctgctccagccccaggaaggcgctttcgccctgcagtcctc

SEQ ID NO: 94983 - DNA, 310 bp, Homo sapiens
  misc_feature 1..310: note = chr6:160511899-160512209
  misc_feature 1..310: note = hypo
  source 1..310: mol_type = genomic DNA
aaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggt

SEQ ID NO: 94984 - DNA, 494 bp, Homo sapiens
  misc_feature 1..494: note = chr6:160769301-160769795
  misc_feature 1..494: note = hyper
  source 1..494: mol_type = genomic DNA
ggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgc

SEQ ID NO: 94985 - DNA, 108 bp, Homo sapiens
  misc_feature 1..108: note = chr6:160769827-160769935
  misc_feature 1..108: note = hyper
  source 1..108: mol_type = genomic DNA
cgtgccgcggcggctggcgctacgcccaggcccactccaccatcgtcagcgaggtaagggcgccccggccctttggaagccggcgggagaggacgatgctggctccca

SEQ ID NO: 94986 - DNA, 61 bp, Homo sapiens
  misc_feature 1..61: note = chr6:160770239-160770300
  misc_feature 1..61: note = hyper
  source 1..61: mol_type = genomic DNA
aattatggttaggtgcgcgatagggaacttcagtctctggggtgagcgacgttggcagttc

SEQ ID NO: 94987 - DNA, 48 bp, Homo sapiens
  misc_feature 1..48: note = chr6:1610816-1610864
  misc_feature 1..48: note = hyper
  source 1..48: mol_type = genomic DNA
tgtactcgcaccctgcgcacgccgagcagtacccgggcggcatggccc

SEQ ID NO: 94988 - DNA, 933 bp, Homo sapiens
  misc_feature 1..933: note = chr6:1611198-1612131
  misc_feature 1..933: note = hyper
  source 1..933: mol_type = genomic DNA
cttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggcca

SEQ ID NO: 94989 - DNA, 39 bp, Homo sapiens
  misc_feature 1..39: note = chr6:161188236-161188275
  misc_feature 1..39: note = hyper
  source 1..39: mol_type = genomic DNA
gcctcgtccacccctcgtccacccctccgcctcccgccc

SEQ ID NO: 94990 - DNA, 202 bp, Homo sapiens
  misc_feature 1..202: note = chr6:161188410-161188612
  misc_feature 1..202: note = hyper
  source 1..202: mol_type = genomic DNA
cgaccctggattgctctccccattctcagcctcaccccccactccttccaccccatattttgccgcctcgaaggacatgaaccatctgctggctgaaggcgcttggacctgaaaccagcgacaggttttggcagctgcacgctcactcccagggaggcgagggcgcccggcgaagtgtggggtctgccgccccctgccggct

SEQ ID NO: 94991 - DNA, 42 bp, Homo sapiens
  misc_feature 1..42: note = chr6:161259532-161259574
  misc_feature 1..42: note = hypo
  source 1..42: mol_type = genomic DNA
ttcattttgggaggccgaggcgggcggatcaccaggtcagga

SEQ ID NO: 94992 - DNA, 287 bp, Homo sapiens
  misc_feature 1..287: note = chr6:161351859-161352146
  misc_feature 1..287: note = hyper
  source 1..287: mol_type = genomic DNA
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagtggggcgtaaggctgagagtggggagagcaatccaggggcgccagggtgggagccgcagcgggcccgcggccgcccggaggacactgatgcttctggagct

SEQ ID NO: 94993 - DNA, 110 bp, Homo sapiens
  misc_feature 1..110: note = chr6:161352198-161352308
  misc_feature 1..110: note = hyper
  source 1..110: mol_type = genomic DNA
cgcaggcacggggctggggcccggggcgggggcgcgggtgggcggacccctcccgcaagcccatgatggccaggccaaggccgctgggaaaggcaggacgctcgcccatg

SEQ ID NO: 94994 - skipped

SEQ ID NO: 94995 - DNA, 30 bp, Homo sapiens
  misc_feature 1..30: note = chr6:16140263-16140293
  misc_feature 1..30: note = hypo
  source 1..30: mol_type = genomic DNA
tgcctcctccttagtcgattcttaccttgc

SEQ ID NO: 94996 - DNA, 38 bp, Homo sapiens
  misc_feature 1..38: note = chr6:1614162-1614200
  misc_feature 1..38: note = hyper
  source 1..38: mol_type = genomic DNA
cccctcccccagggtcgtaacctaatcgccgggaagat

SEQ ID NO: 94997 - DNA, 120 bp, Homo sapiens
  misc_feature 1..120: note = chr6:1614286-1614406
  misc_feature 1..120: note = hyper
  source 1..120: mol_type = genomic DNA
cggcgctaggtcccggggctgcctccagcttcctcgggttacagcctctttcggggcgggggaaggggagggggtgacggtagagactccaccgccagtctccaggagtttggtgtgatc

SEQ ID NO: 94998 - DNA, 182 bp, Homo sapiens
  misc_feature 1..182: note = chr6:16148438-16148620
  misc_feature 1..182: note = hypo
  source 1..182: mol_type = genomic DNA
tctgtcttttatattcgggataataaagactttaaagcaaacatggatgtgtgtattgtcatttaagccagttttatttcatttcaaagaaataagcaaggggtaacatcacagttagtatctactttcctcctaccgggaatttaattttttttttttaataatttcggtgctctacaaat

SEQ ID NO: 94999 - DNA, 30 bp, Homo sapiens
  misc_feature 1..30: note = chr6:161560023-161560053
  misc_feature 1..30: note = hypo
  source 1..30: mol_type = genomic DNA
aggagaagccacaggcgcccccagaggaag

SEQ ID NO: 95000 - DNA, 121 bp, Homo sapiens
  misc_feature 1..121: note = chr6:161561655-161561776
  misc_feature 1..121: note = hypo
  source 1..121: mol_type = genomic DNA
gcaggcgtgctcaagcggctgggagctgagctgagccaggacctggggggaacaaggagctgtggcaccaggatgcccgctggcccgtctaagggcaggtcctggccgtgaggaggggcca

SEQ ID NO: 95001 - DNA, 30 bp, Homo sapiens
  misc_feature 1..30: note = chr6:161575883-161575913
  misc_feature 1..30: note = hypo
  source 1..30: mol_type = genomic DNA
tgaatccgatttttccgagacagctcaact

SEQ ID NO: 95002 - DNA, 30 bp, Homo sapiens
  misc_feature 1..30: note = chr6:161585055-161585085
  misc_feature 1..30: note = hypo
  source 1..30: mol_type = genomic DNA
aatcaaggggaggtgcggtccctatgctgc

SEQ ID NO: 95003 - DNA, 188 bp, Homo sapiens
  misc_feature 1..188: note = chr6:161602138-161602326
  misc_feature 1..188: note = hypo
  source 1..188: mol_type = genomic DNA
gtgaaactactagcacggaataaacagaaaggtgcctcccagctctagcccaagagttcttgctgcaggtgttaagtgggccccagcaacgctgtgaaggggaacagtattcagcagcccaatgcgtctcttgtgtcctggtactcaacacagtctgggattgctgagggaggcgggctgcctgctgc

SEQ ID NO: 95004 - DNA, 167 bp, Homo sapiens
  misc_feature 1..167: note = chr6:161609747-161609914
  misc_feature 1..167: note = hypo
  source 1..167: mol_type = genomic DNA
ccatggtaacaagcacggccgtgcctctgggagggcagcttggggaggaactgaacagggcacctctgggttgagcagccagcggccgtcgaatggggcttccgtaaacatcattccctagaatcccgagagccacctggtgagatcggcatcgctatctcatttca

SEQ ID NO: 95005 - DNA, 163 bp, Homo sapiens
  misc_feature 1..163: note = chr6:161619824-161619987
  misc_feature 1..163: note = hypo
  source 1..163: mol_type = genomic DNA
gaaactgacctggaacgtatatgttgtttcgagtaaagacaaaattacatagcttattaaggggtaaatatcttgtttatatgatccacgattctatattttaaactccagaaactcctcaaatatatgtcagaattactgctgatatcgattccttttttga

SEQ ID NO: 95006 - DNA, 186 bp, Homo sapiens
  misc_feature 1..186: note = chr6:161643685-161643871
  misc_feature 1..186: note = hypo
  source 1..186: mol_type = genomic DNA
aatcttgaagtaaaccgatggtcacaattattgaaatttctgagggatggatacttggagcccatctagtgagagggtcaatggctgcaagttgctgctaggcgctactgtatgcctgcctgctctcctgcaggtgtctgtggatgcttcctctggcctcattcatttgcacggtggcctcacgac

SEQ ID NO: 95007 - DNA, 30 bp, Homo sapiens
  misc_feature 1..30: note = chr6:161656491-161656521
  misc_feature 1..30: note = hypo
  source 1..30: mol_type = genomic DNA
caaatgtgtgacatacgtcttaagttcatt

SEQ ID NO: 95008 - DNA, 63 bp, Homo sapiens; identical to SEQ ID NO: 40939
  misc_feature 1..63: note = chr6:161672733-161672796
  misc_feature 1..63: note = hypo
  source 1..63: mol_type = genomic DNA

SEQ ID NO: 95009 - DNA, 175 bp, Homo sapiens
  misc_feature 1..175: note = chr6:161685567-161685742
  misc_feature 1..175: note = hypo
  source 1..175: mol_type = genomic DNA
aggtggtccccctggcgtgcccgcgcatccctgccctgcaagtcttatccactgcgtgggaacccctcgctgaggcttccgtcttgccctctgggcagcaggctcctcaaaggcacttgcagggtcggctccctctttgtattcctgcgggctgaatgcacgggctccctaagaa

SEQ ID NO: 95010 - DNA, 101 bp, Homo sapiens
  misc_feature 1..101: note = chr6:161690505-161690606
  misc_feature 1..101: note = hypo
  source 1..101: mol_type = genomic DNA
tattagaagtgataccgccagggcaggcgcggtggctcacgcctgcagtcccagctgctgggggaggggggctgaggcaggaggatgcttgagcttaggag

SEQ ID NO: 95011 - DNA, 23 bp, Homo sapiens
  misc_feature 1..23: note = chr6:161726250-161726273
  misc_feature 1..23: note = hypo
  source 1..23: mol_type = genomic DNA
aaaaccagctgaggccgggcgcg

SEQ ID NO: 95012 - DNA, 63 bp, Homo sapiens
  misc_feature 1..63: note = chr6:161766949-161767012
  misc_feature 1..63: note = hypo
  source 1..63: mol_type = genomic DNA
tcaagcaggtcttcccggacaatactccctgcttttttttttttttttcggcatgttatttaa

SEQ ID NO: 95013 - DNA, 79 bp, Homo sapiens; identical to SEQ ID NO: 40942
  misc_feature 1..79: note = chr6:161780140-161780219
  misc_feature 1..79: note = hypo
  source 1..79: mol_type = genomic DNA

SEQ ID NO: 95014 - DNA, 25 bp, Homo sapiens
  misc_feature 1..25: note = chr6:161795264-161795289
  misc_feature 1..25: note = hypo
  source 1..25: mol_type = genomic DNA
tgtgttgtgtatatgcgtatgctgt

SEQ ID NO: 95015 - DNA, 24 bp, Homo sapiens
  misc_feature 1..24: note = chr6:161795349-161795373
  misc_feature 1..24: note = hypo
  source 1..24: mol_type = genomic DNA
tgtgtgtaacgcatggtgtgcatg

SEQ ID NO: 95016 - DNA, 266 bp, Homo sapiens
  misc_feature 1..266: note = chr6:16197009-16197275
  misc_feature 1..266: note = hypo
  source 1..266: mol_type = genomic DNA
agtagaaaacaaaagcgggctgaaccaagccgaggccgctccacagagaaagcatttagaccacccctagccaaagggaaatcagaatcgcccatcccagcagttcagaattgagttctgatgtgtccggaattgatgggttgtctcactgacttcaaggaaaaagccgcagatctccgtggtgggtgctaaaattcttaaaggtggtgtgtctggagtatgttccttttcatgttcagacgtgtgcagtttacgggggtggggag

SEQ ID NO: 95017 - DNA, 25 bp, Homo sapiens
  misc_feature 1..25: note = chr6:16197335-16197360
  misc_feature 1..25: note = hypo
  source 1..25: mol_type = genomic DNA
cctaaggtggcgcagctggagttgt

SEQ ID NO: 95018 - DNA, 83 bp, Homo sapiens
  misc_feature 1..83: note = chr6:1619887-1619970
  misc_feature 1..83: note = hyper
  source 1..83: mol_type = genomic DNA
gccccggtgcagccccgcgttccccgcgcccggcgctgccggggaaaagtggcacaacaggaaagcctcgccagagggccctt

SEQ ID NO: 95019 - DNA, 36 bp, Homo sapiens; identical to SEQ ID NO: 40945
  misc_feature 1..36: note = chr6:161989335-161989371
  misc_feature 1..36: note = hypo
  source 1..36: mol_type = genomic DNA

SEQ ID NO: 95020 - DNA, 39 bp, Homo sapiens
  misc_feature 1..39: note = chr6:162084991-162085030
  misc_feature 1..39: note = hypo
  source 1..39: mol_type = genomic DNA
tcaaaacagtgctcccgggagctccgctaatgcagcttc

SEQ ID NO: 95021 - DNA, 30 bp, Homo sapiens
  misc_feature 1..30: note = chr6:162135996-162136026
  misc_feature 1..30: note = hypo
  source 1..30: mol_type = genomic DNA
gatgccatatttgaacggtattcttaccat

SEQ ID NO: 95022 - DNA, 151 bp, Homo sapiens; identical to SEQ ID NO: 40755
  misc_feature 1..151: note = chr6:16218420-16218571
  misc_feature 1..151: note = hypo
  source 1..151: mol_type = genomic DNA

SEQ ID NO: 95023 - DNA, 40 bp, Homo sapiens
  misc_feature 1..40: note = chr6:162222104-162222144
  misc_feature 1..40: note = hypo
  source 1..40: mol_type = genomic DNA
ccatagagaaggacacgggaggaaacggaggcctagggcg

SEQ ID NO: 95024 - DNA, 30 bp, Homo sapiens
  misc_feature 1..30: note = chr6:162226297-162226327
  misc_feature 1..30: note = hypo
  source 1..30: mol_type = genomic DNA
ttcttcatgtttactcgatgcttatttcca

SEQ ID NO: 95025 - DNA, 17 bp, Homo sapiens
  misc_feature 1..17: note = chr6:162253379-162253396
  misc_feature 1..17: note = hypo
  source 1..17: mol_type = genomic DNA
gtggggtggctctcacg

SEQ ID NO: 95026 - DNA, 17 bp, Homo sapiens
  misc_feature 1..17: note = chr6:162253696-162253713
  misc_feature 1..17: note = hypo
  source 1..17: mol_type = genomic DNA
cgcggaactgtaataca

SEQ ID NO: 95027 - DNA, 177 bp, Homo sapiens
  misc_feature 1..177: note = chr6:162257854-162258031
  misc_feature 1..177: note = hypo
  source 1..177: mol_type = genomic DNA
ggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcct

SEQ ID NO: 95028 - DNA, 30 bp, Homo sapiens; identical to SEQ ID NO: 40947
  misc_feature 1..30: note = chr6:162280335-162280365
  misc_feature 1..30: note = hypo
  source 1..30: mol_type = genomic DNA

SEQ ID NO: 95029 - DNA, 145 bp, Homo sapiens; identical to SEQ ID NO: 40756
  misc_feature 1..145: note = chr6:16249815-16249960
  misc_feature 1..145: note = hypo
  source 1..145: mol_type = genomic DNA

SEQ ID NO: 95030 - DNA, 33 bp, Homo sapiens
  misc_feature 1..33: note = chr6:1625026-1625059
  misc_feature 1..33: note = hyper
  source 1..33: mol_type = genomic DNA
ctcttctccccaaggcgtcccttgggctcttaa

SEQ ID NO: 95031 - DNA, 572 bp, Homo sapiens
  misc_feature 1..572: note = chr6:1625119-1625691
  misc_feature 1..572: note = hyper
  source 1..572: mol_type = genomic DNA
gagaactgtttggaattgctgcacttctctggctaggagggaagtgagtaaatcaccaggcgcccctcccagctgcccgtgtccctgcgccgctcagctcctgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcag

SEQ ID NO: 95032 - DNA, 181 bp, Homo sapiens
  misc_feature 1..181: note = chr6:162863312-162863493
  misc_feature 1..181: note = hypo
  source 1..181: mol_type = genomic DNA
ccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttg

SEQ ID NO: 95033 - DNA, 42 bp, Homo sapiens
  misc_feature 1..42: note = chr6:16288325-16288367
  misc_feature 1..42: note = hypo
  source 1..42: mol_type = genomic DNA
agccctcacagccctcgcttgctgtccacgcctcctctgcct

SEQ ID NO: 95034 - DNA, 23 bp, Homo sapiens
  misc_feature 1..23: note = chr6:162921490-162921513
  misc_feature 1..23: note = hypo
  source 1..23: mol_type = genomic DNA
actgcgcccggcccaaacagcca

SEQ ID NO: 95035 - DNA, 192 bp, Homo sapiens
  misc_feature 1..192: note = chr6:16293373-16293565
  misc_feature 1..192: note = hypo
  source 1..192: mol_type = genomic DNA
attatttcattctcacgctgtgcccgggaggcaaagtaccttcattttacggatgagcagacttaagcatcagcaaaaaaggaatttgtaaaaggcgacaccaccacttagcagagaagcaacagtgagaatctagaaatttccaagaagccccaggaaggccatggaaatatcttacgaaaatgaaatgtc

SEQ ID NO: 95036 - DNA, 40 bp, Homo sapiens
  misc_feature 1..40: note = chr6:16295428-16295468
  misc_feature 1..40: note = hypo
  source 1..40: mol_type = genomic DNA
aagcagcgtctggctcgagtggaagcgtccaaacctgctt

SEQ ID NO: 95037 - DNA, 30 bp, Homo sapiens
  misc_feature 1..30: note = chr6:163521407-163521437
  misc_feature 1..30: note = hypo
  source 1..30: mol_type = genomic DNA
ctttccattctgcaccgcagggaaggccca

SEQ ID NO: 95038 - DNA, 154 bp, Homo sapiens
  misc_feature 1..154: note = chr6:16356093-16356247
  misc_feature 1..154: note = hypo
  source 1..154: mol_type = genomic DNA
ccctcacccacccttttgatgggcaacttgagctgccctctcctgcttattcctgtaactgcaaacacgtcttgctccaaccaccacttcttaaaactgcagatgaagggctgactctgggcatgccattggttgggctcgttccttccccgcg

SEQ ID NO: 95039 - DNA, 180 bp, Homo sapiens
  misc_feature 1..180: note = chr6:16359260-16359440
  misc_feature 1..180: note = hypo
  source 1..180: mol_type = genomic DNA
cgccccaggaaggaccctccccatctctgcatgctcagatgtgtctgcgcccactgcctggcctctctccgttccaggcacccactcagatctcagagctgggttggggccaagccccggggccatgaatggcagcaggaggaagacagggtccggggcagaaaagaggggagtccccaa

SEQ ID NO: 95040 - DNA, 38 bp, Homo sapiens
  misc_feature 1..38: note = chr6:163616660-163616698
  misc_feature 1..38: note = hypo
  source 1..38: mol_type = genomic DNA
ccccagggctccctgcgcctcggcggctgaggaggtgg

SEQ ID NO: 95041 - DNA, 95 bp, Homo sapiens
  misc_feature 1..95: note = chr6:163661684-163661779
  misc_feature 1..95: note = hypo
  source 1..95: mol_type = genomic DNA
ggatttgggcacatacgcggtggggcctcttcagctgtagagtcattaaccctaaactccttgttcatggaatcaacagccgactgtgccgtcct

SEQ ID NO: 95042 - DNA, 39 bp, Homo sapiens
  misc_feature 1..39: note = chr6:163673393-163673432
  misc_feature 1..39: note = hypo
  source 1..39: mol_type = genomic DNA
tgagcagcaggggggcgacatcatcggggaaacaaatca

SEQ ID NO: 95043 - DNA, 30 bp, Homo sapiens; identical to SEQ ID NO: 40708
  misc_feature 1..30: note = chr6:1637278-1637308
  misc_feature 1..30: note = hypo
  source 1..30: mol_type = genomic DNA

SEQ ID NO: 95044 - DNA, 118 bp, Homo sapiens
  misc_feature 1..118: note = chr6:163834265-163834383
  misc_feature 1..118: note = hyper
  source 1..118: mol_type = genomic DNA
aagacctcttgcctccgtattctttcttcatctgtaaaaatgttgacttctgcttttcagactacgcgcacagcctctttatttcctactgcggcttcattccctcacggaacactga

SEQ ID NO: 95045 - DNA, 128 bp, Homo sapiens; identical to SEQ ID NO: 30916
  misc_feature 1..128: note = chr6:163834405-163834533
  misc_feature 1..128: note = hyper
  source 1..128: mol_type = genomic DNA

SEQ ID NO: 95046 - DNA, 119 bp, Homo sapiens; identical to SEQ ID NO: 30917
  misc_feature 1..119: note = chr6:163834710-163834829
  misc_feature 1..119: note = hyper
  source 1..119: mol_type = genomic DNA

SEQ ID NO: 95047 - DNA, 48 bp, Homo sapiens
  misc_feature 1..48: note = chr6:163835083-163835131
  misc_feature 1..48: note = hyper
  source 1..48: mol_type = genomic DNA
cgctctggagccccacggctacgtgtcgggccacgtgatgcccacccc

SEQ ID NO: 95048 - DNA, 109 bp, Homo sapiens
  misc_feature 1..109: note = chr6:163835797-163835906
  misc_feature 1..109: note = hyper
  source 1..109: mol_type = genomic DNA
cccagagagaccccccgagcccgcggcacaggcggcggcggcgctgagcgggctcgaccagccgagcgagcggcggccccggctcctcctcgtccggcgccagcagccc

SEQ ID NO: 95049 - DNA, 1034 bp, Homo sapiens
  misc_feature 1..1034: note = chr6:163836197-163837231
  misc_feature 1..1034: note = hyper
  source 1..1034: mol_type = genomic DNA
gggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaaggtgagcgtctccagggccccggccccggcccgacccccgccggggcggcccctttccccgcttgggatggtggggagggcgggaaggtcacggccgggcgggaccgagcgccggggggactgggaggccaggagggcgcacaaaggaggtgccgggccgggcttgcggcgggcgggcgggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 95050 - DNA, 311 bp, Homo sapiens
  misc_feature 1..311: note = chr6:163837469-163837780
  misc_feature 1..311: note = hyper
  source 1..311: mol_type = genomic DNA
gcttagaggcaccaccggaggactgtgtaaaggaaactgaaaactacaggttgaagagatgaacaatggagtttagatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacata

SEQ ID NO: 95051 - DNA, 30 bp, Homo sapiens; identical to SEQ ID NO: 40949
  misc_feature 1..30: note = chr6:163915349-163915379
  misc_feature 1..30: note = hypo
  source 1..30: mol_type = genomic DNA

SEQ ID NO: 95052 - DNA, 35 bp, Homo sapiens
  misc_feature 1..35: note = chr6:163923060-163923095
  misc_feature 1..35: note = hypo
  source 1..35: mol_type = genomic DNA
attttatattcttgccgggcatggtgcctcacacc

SEQ ID NO: 95053 - DNA, 140 bp, Homo sapiens
  misc_feature 1..140: note = chr6:163945790-163945930
  misc_feature 1..140: note = hypo
  source 1..140: mol_type = genomic DNA
gcccggccttctgtttattttctacgatcatctattctagattctagcctgtccataccatatttacattatggtaatattaatttcagagctcttaaatgacgggtactcgtccatgtgctatccgaacactaacattt

SEQ ID NO: 95054 - DNA, 158 bp, Homo sapiens
  misc_feature 1..158: note = chr6:163946670-163946828
  misc_feature 1..158: note = hypo
  source 1..158: mol_type = genomic DNA
acaggcgtgagccaccacgcccggccatcttgtttctttttattgttttcaatgaaataattgtaatcttgattatgttgacttttaagtattgtatttagcctttcttcttaataggtagttgtcaggtcgtcaaaggcagacgagtgtcatctgaa

SEQ ID NO: 95055 - DNA, 30 bp, Homo sapiens
  misc_feature 1..30: note = chr6:163979710-163979740
  misc_feature 1..30: note = hypo
  source 1..30: mol_type = genomic DNA
gtgagccaccacacccggccagtgaaccct

SEQ ID NO: 95056 - DNA, 23 bp, Homo sapiens
  misc_feature 1..23: note = chr6:164012441-164012464
  misc_feature 1..23: note = hypo
  source 1..23: mol_type = genomic DNA
tttttgagttgcagccgaagtct

SEQ ID NO: 95057 - DNA, 150 bp, Homo sapiens
  misc_feature 1..150: note = chr6:164047494-164047644
  misc_feature 1..150: note = hypo
  source 1..150: mol_type = genomic DNA
aggaataatcttgttcgtgtcttgatccatactgtcacaaaatggccttgtcggtaaatgtgtgatgtgacatcttgtgaaattgttcagcaagagaacaccaaagctcaccaggccagctcacagcggcaccagcgcctggaagacagg

SEQ ID NO: 95058 - DNA, 32 bp, Homo sapiens
  misc_feature 1..32: note = chr6:164057505-164057537
  misc_feature 1..32: note = hypo
  source 1..32: mol_type = genomic DNA
acatttagtcttgaccgcggtcagtcctgcat

SEQ ID NO: 95059 - DNA, 138 bp, Homo sapiens
  misc_feature 1..138: note = chr6:164064007-164064145
  misc_feature 1..138: note = hypo
  source 1..138: mol_type = genomic DNA
aatggtgagtgggctcgggaaaaactccgctggtctgtcaatttccaggtggagaatttgcaatgacttttctggctgactcagctgatcaaagtaggtccacgttgttttcctttttttttttttctgagacggagt

SEQ ID NO: 95060 - DNA, 22 bp, Homo sapiens
  misc_feature 1..22: note = chr6:164114295-164114317
  misc_feature 1..22: note = hypo
  source 1..22: mol_type = genomic DNA
ttatttttttgagaccgagtct

SEQ ID NO: 95061 - DNA, 50 bp, Homo sapiens
  misc_feature 1..50: note = chr6:164118784-164118834
  misc_feature 1..50: note = hypo
  source 1..50: mol_type = genomic DNA
ccctcatgaaattagcgattcagtatatacatagtcgtaagaggatgaaa

SEQ ID NO: 95062 - DNA, 30 bp, Homo sapiens; identical to SEQ ID NO: 40955
  misc_feature 1..30: note = chr6:164121841-164121871
  misc_feature 1..30: note = hypo
  source 1..30: mol_type = genomic DNA

SEQ ID NO: 95063 - DNA, 30 bp, Homo sapiens
  misc_feature 1..30: note = chr6:164136197-164136227
  misc_feature 1..30: note = hypo
  source 1..30: mol_type = genomic DNA
gtgctacaatattggcgtgagggacccttg

SEQ ID NO: 95064 - DNA, 71 bp, Homo sapiens
  misc_feature 1..71: note = chr6:164143599-164143670
  misc_feature 1..71: note = hypo
  source 1..71: mol_type = genomic DNA
gccaggaagctataacgctgctctccaggcagaagctgctagcaatggtgctgacacggcccaactaccca

SEQ ID NO: 95065 - DNA, 160 bp, Homo sapiens
  misc_feature 1..160: note = chr6:164145352-164145512
  misc_feature 1..160: note = hypo
  source 1..160: mol_type = genomic DNA
acggagtcaccccagcgtgggtgtgggcagcacgcataggaagaggagtggcaccgccccccggggcctggaaagggagtgcacatgctgagagtgcccctgcctggaggggatggggtcttcttccagagtttatgggcgcagtcggagctgcccaccc

SEQ ID NO: 95066 - DNA, 400 bp, Homo sapiens
  misc_feature 1..400: note = chr6:164149947-164150347
  misc_feature 1..400: note = hypo
  source 1..400: mol_type = genomic DNA
ctcccactggcatctcgtgtgtagaagccagggaagccgctaacatcgtgcaatgcacagcacggcccctaccacagattccagccccaagcggcagtagcgctgctgctgagaaaccccgctctagacttttctttacaagaggcaggaaaagatctgtttgtgggttaaagaattccttggactcagaaaagtccccgatgcacccagggtttgtattgagatcaggtttgaccagacagaaatgagacctggcggcacggcgtgtgcagggcacgggagaagctggactgacttccatgagtaggaggtgaaagagcccgtcactgcacgagtagctggtcaccactagggccaacaccagctctcagggacagcacctgcacgcttgtaatgtgag

SEQ ID NO: 95067 - DNA, 30 bp, Homo sapiens
  misc_feature 1..30: note = chr6:164164781-164164811
  misc_feature 1..30: note = hypo
  source 1..30: mol_type = genomic DNA
atctgaatctggctacgtcatcctcaggaa

SEQ ID NO: 95068 - DNA, 92 bp, Homo sapiens; identical to SEQ ID NO: 40959
  misc_feature 1..92: note = chr6:164165801-164165893
  misc_feature 1..92: note = hypo
  source 1..92: mol_type = genomic DNA

SEQ ID NO: 95069 - DNA, 38 bp, Homo sapiens
  misc_feature 1..38: note = chr6:164170286-164170324
  misc_feature 1..38: note = hypo
  source 1..38: mol_type = genomic DNA
tagaaccagagatctcgcaggtacgaggggaacagatg

SEQ ID NO: 95070 - DNA, 59 bp, Homo sapiens
  misc_feature 1..59: note = chr6:164173782-164173841
  misc_feature 1..59: note = hypo
  source 1..59: mol_type = genomic DNA
tcagaggtagaggaacggggctgccagtgaagagagagagagaccgaaaacttaggcag

SEQ ID NO: 95071 - DNA, 155 bp, Homo sapiens
  misc_feature 1..155: note = chr6:164179641-164179796
  misc_feature 1..155: note = hypo
  source 1..155: mol_type = genomic DNA
tcgttactgccgcgtgcatcttattgccttctagctccgctccccatatgcgtgcttttattttttatgctccacatagagcaatctctttaaaatatactctggattatcttgacccactgtttacaatcgtgtatgtacgggcttccctaggt

SEQ ID NO: 95072 - DNA, 83 bp, Homo sapiens
  misc_feature 1..83: note = chr6:164182839-164182922
  misc_feature 1..83: note = hypo
  source 1..83: mol_type = genomic DNA
agatgctggaagaatcggtttcctttgcggatgctctcctaggtctttttttttttggaatcttgctattcgcctgcctcagg

SEQ ID NO: 95073 - DNA, 85 bp, Homo sapiens
  misc_feature 1..85: note = chr6:164183688-164183773
  misc_feature 1..85: note = hypo
  source 1..85: mol_type = genomic DNA
tctcaaaaataaaataaaataaaataaaaaataaaaaagaagctcaatgtttttaatgcaacagaccctgcggaaggtcagtaac

SEQ ID NO: 95074 - DNA, 22 bp, Homo sapiens
  misc_feature 1..22: note = chr6:164196996-164197018
  misc_feature 1..22: note = hypo
  source 1..22: mol_type = genomic DNA
ctaaaagcgtcttctgacaaac

SEQ ID NO: 95075 - DNA, 207 bp, Homo sapiens
  misc_feature 1..207: note = chr6:164209872-164210079
  misc_feature 1..207: note = hypo
  source 1..207: mol_type = genomic DNA
ttctcgaggttggtgcggcctgaaaaagcaagagttcccttggagtagtcccgagtatgggtctggagttccttgtggaggtgatgcttgaattcagtttcttctgcttgctcccacaatgccccatccatacctatcccttactaaactcacacttggtggcccaggatctcaaagtgtacttccttcctgcgctcacctgccacc

SEQ ID NO: 95076 - DNA, 133 bp, Homo sapiens; identical to SEQ ID NO: 40964
  misc_feature 1..133: note = chr6:164228294-164228427
  misc_feature 1..133: note = hypo
  source 1..133: mol_type = genomic DNA

SEQ ID NO: 95077 - DNA, 195 bp, Homo sapiens
  misc_feature 1..195: note = chr6:164228682-164228877
  misc_feature 1..195: note = hypo
  source 1..195: mol_type = genomic DNA
tggcagagaagggtccgcccgaggctctggccccagggaacccctcggttcttctccaacattttgctgagggaaggctgctcttgtgttgaacctaccgagggagagttcctaggtttgcatggcaagaaatgtgaagatatttttaagacaaattcacccctgcacaccaccggctttcgagtcacagaccct

SEQ ID NO: 95078 - DNA, 176 bp, Homo sapiens
  misc_feature 1..176: note = chr6:164241293-164241469
  misc_feature 1..176: note = hypo
  source 1..176: mol_type = genomic DNA
gactgccgtgctccacgatacctcccacggatgcgtttctggcctgatgcttggcgctctggcagtctgtgtcattcaccgctctgcctctgccgcctggagacgtgccgggcacgtaccgggtccttggtaactgcggaattcgctaatgaatgggtggacgaattcccctcata

SEQ ID NO: 95079 - DNA, 30 bp, Homo sapiens; identical to SEQ ID NO: 40967
  misc_feature 1..30: note = chr6:164243378-164243408
  misc_feature 1..30: note = hypo
  source 1..30: mol_type = genomic DNA

SEQ ID NO: 95080 - DNA, 51 bp, Homo sapiens
  misc_feature 1..51: note = chr6:164245443-164245494
  misc_feature 1..51: note = hypo
  source 1..51: mol_type = genomic DNA
cagccaccgggaaagcggtggttaacgttggctccacgcccttgttcctgc

SEQ ID NO: 95081 - DNA, 21 bp, Homo sapiens
  misc_feature 1..21: note = chr6:164246122-164246143
  misc_feature 1..21: note = hypo
  source 1..21: mol_type = genomic DNA
ccgggccgatatggaatttct

SEQ ID NO: 95082 - DNA, 123 bp, Homo sapiens
  misc_feature 1..123: note = chr6:164255972-164256095
  misc_feature 1..123: note = hypo
  source 1..123: mol_type = genomic DNA
ggaacagcacagaagcgcaaccttcctcctcgtcctggtaatactcggagtctggcggataagccgtcacagggctggaccacacgtccggggaatacctggtctgatcggaggcagtgcagc

SEQ ID NO: 95083 - DNA, 68 bp, Homo sapiens; identical to SEQ ID NO: 40969
  misc_feature 1..68: note = chr6:164283216-164283284
  misc_feature 1..68: note = hypo
  source 1..68: mol_type = genomic DNA

SEQ ID NO: 95084 - DNA, 21 bp, Homo sapiens
  misc_feature 1..21: note = chr6:164284046-164284067
  misc_feature 1..21: note = hypo
  source 1..21: mol_type = genomic DNA
gaagagaaccagaaccgatgc

SEQ ID NO: 95085 - DNA, 38 bp, Homo sapiens
  misc_feature 1..38: note = chr6:164284509-164284547
  misc_feature 1..38: note = hypo
  source 1..38: mol_type = genomic DNA
ttacaggcatgagccactatgcccggctgaggatgtat

SEQ ID NO: 95086 - DNA, 171 bp, Homo sapiens
  misc_feature 1..171: note = chr6:164288079-164288250
  misc_feature 1..171: note = hypo
  source 1..171: mol_type = genomic DNA
aacttatgaacaagccggggcagctgctgtgcctgtgcagccagaggatcacccagaacatgttcaccagccatgctgcttcccacctgcttatgaagaatcccggaggacccccgtgaagggagcctcccctgtttgctgtctcacctctcaatccgccgctccgactta

SEQ ID NO: 95087 - DNA, 76 bp, Homo sapiens
  misc_feature 1..76: note = chr6:164314367-164314443
  misc_feature 1..76: note = hypo
  source 1..76: mol_type = genomic DNA
ggtcaggttgcggcccgactggcctgacagtcaacgaggtggaaaccgtgacaaattcagacgccagggctttatc

SEQ ID NO: 95088 - DNA, 461 bp, Homo sapiens
  misc_feature 1..461: note = chr6:164322314-164322775
  misc_feature 1..461: note = hypo
  source 1..461: mol_type = genomic DNA
gcccaggctgggtcacgctacggaggagaagattttggaaagaagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggagaatgttctgcctgggcggagcattcggtgcggttacgtgggtgcggttctccagggagagcgcgggggtctcttcagggtaatgccaacctcaccgccaaatgcagcta

SEQ ID NO: 95089 - DNA, 86 bp, Homo sapiens; identical to SEQ ID NO: 40973
  misc_feature 1..86: note = chr6:164323845-164323931
  misc_feature 1..86: note = hypo
  source 1..86: mol_type = genomic DNA

SEQ ID NO: 95090 - DNA, 33 bp, Homo sapiens
  misc_feature 1..33: note = chr6:164329998-164330031
  misc_feature 1..33: note = hypo
  source 1..33: mol_type = genomic DNA
ctgcgcccggccaatgctcgatatatcttataa

SEQ ID NO: 95091 - DNA, 108 bp, Homo sapiens; identical to SEQ ID NO: 40974
  misc_feature 1..108: note = chr6:164334224-164334332
  misc_feature 1..108: note = hypo
  source 1..108: mol_type = genomic DNA

SEQ ID NO: 95092 - DNA, 30 bp, Homo sapiens
  misc_feature 1..30: note = chr6:164340153-164340183
  misc_feature 1..30: note = hypo
  source 1..30: mol_type = genomic DNA
ttgcacctcactctccggggtaaagcctgg

SEQ ID NO: 95093 - DNA, 30 bp, Homo sapiens
  misc_feature 1..30: note = chr6:164344488-164344518
  misc_feature 1..30: note = hypo
  source 1..30: mol_type = genomic DNA
gcctgccatggctggcgttaataagaacgc

SEQ ID NO: 95094 - DNA, 181 bp, Homo sapiens
  misc_feature 1..181: note = chr6:164384580-164384761
  misc_feature 1..181: note = hypo
  source 1..181: mol_type = genomic DNA
tgtcagcatgtgaaccgtcttcccacccagctcgggctctgtctcttcattcaggggtggctttagtttaccgggagataagtgggggagcgatgtgagaggaattcaggagagaggacaattccagctaaaaacaaacctcaagtgacagttgtgtaaacgcgctcgcaaagtaacattc

SEQ ID NO: 95095 - DNA, 65 bp, Homo sapiens
  misc_feature 1..65: note = chr6:164410701-164410766
  misc_feature 1..65: note = hypo
  source 1..65: mol_type = genomic DNA
aaagcgaaccttgcccggggttcatgggcccagaacaaaatccatgcactcggatgtgacaagtg

SEQ ID NO: 95096 - DNA, 30 bp, Homo sapiens
  misc_feature 1..30: note = chr6:164441343-164441373
  misc_feature 1..30: note = hypo
  source 1..30: mol_type = genomic DNA
acctgaagtgtattgcgaatatgagggctc

SEQ ID NO: 95097 - DNA, 41 bp, Homo sapiens
  misc_feature 1..41: note = chr6:16444348-16444389
  misc_feature 1..41: note = hypo
  source 1..41: mol_type = genomic DNA
aaaaaaaaaaaaaaagtacacacaatcgatctatatctata

SEQ ID NO: 95098 - DNA, 184 bp, Homo sapiens
  misc_feature 1..184: note = chr6:164500295-164500479
  misc_feature 1..184: note = hypo
  source 1..184: mol_type = genomic DNA
gtcagaggagagagacggggtactgggtggaagagctcaggtggcagcaccacctaagaaagtcttagcggggcatgggcgcacccccgagccaaggtccagcagtagaggatacctgtgcttggcagaagtgacctggtcccagtgcccagctgtgctcattcagtgccggggacagcccagg

SEQ ID NO: 95099 - DNA, 60 bp, Homo sapiens
  misc_feature 1..60: note = chr6:164565819-164565879
  misc_feature 1..60: note = hypo
  source 1..60: mol_type = genomic DNA
tcgaggtcacttcaacgctctgcctgttaccctcttctcccagcccgctcaggagggcag

SEQ ID NO: 95100 - DNA, 49 bp, Homo sapiens
  misc_feature 1..49: note = chr6:164637238-164637287
  misc_feature 1..49: note = hypo
  source 1..49: mol_type = genomic DNA
gcaagtgtagtgagccgacaagggaagcaggtgccgtaagtaatagatg

SEQ ID NO: 95101 - DNA, 30 bp, Homo sapiens
  misc_feature 1..30: note = chr6:165416380-165416410
  misc_feature 1..30: note = hypo
  source 1..30: mol_type = genomic DNA
ggtacatgctatccacgtgactcatcactg

SEQ ID NO: 95102 - DNA, 61 bp, Homo sapiens
  misc_feature 1..61: note = chr6:165731354-165731415
  misc_feature 1..61: note = hypo
  source 1..61: mol_type = genomic DNA
gaaagagaacaccagcgtggacggtggacggggactcctgcctcagcgatggtgctgcgct

SEQ ID NO: 95103 - DNA, 30 bp, Homo sapiens
  misc_feature 1..30: note = chr6:165746822-165746852
  misc_feature 1..30: note = hypo
  source 1..30: mol_type = genomic DNA
gcaccttggtccatccgctctggaccgcga

SEQ ID NO: 95104 - DNA, 46 bp, Homo sapiens
  misc_feature 1..46: note = chr6:1658547-1658593
  misc_feature 1..46: note = hypo
  source 1..46: mol_type = genomic DNA
tgaagctgcaatttgcgaagtcgcattttcccgaaggctttcccac

SEQ ID NO: 95105 - DNA, 198 bp, Homo sapiens
  misc_feature 1..198: note = chr6:166050958-166051156
  misc_feature 1..198: note = hypo
  source 1..198: mol_type = genomic DNA
acacacacaagactgcggaaaatttttcacatttggcatggaaaaagagaaagactacacatgcagtcaaaattcattccatacattctggagaacgtcctgtgtgtcgggcagcataacagggtcacaaaaacaaaaccccactttgtttccaggcatcatgttaagtggcaaaaggttctgcgtcaatagtgcaag

SEQ ID NO: 95106 - DNA, 1115 bp, Homo sapiens
  misc_feature 1..1115: note = chr6:166074010-166075125
  misc_feature 1..1115: note = hyper
  source 1..1115: mol_type = genomic DNA
cggggttgcaaggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 95107 - DNA, 266 bp, Homo sapiens
  misc_feature 1..266: note = chr6:166075258-166075524
  misc_feature 1..266: note = hyper
  source 1..266: mol_type = genomic DNA
cgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaaggtccatcttccatgtcggagccgaagagcagcgcgg

SEQ ID NO: 95108 - DNA, 964 bp, Homo sapiens
  misc_feature 1..964: note = chr6:166076095-166077059
  misc_feature 1..964: note = hyper
  source 1..964: mol_type = genomic DNA
gggcgggcgcgggggcgcggcgcgctccgcccggccacggccaggccactcgggggccgggcccgggcccgccgcgctccccccgccggccgcgctgagccggggttccgggcggagtttgccggggccgcagcccggctcgtccccggccgctggcaggggaccctgggggcggggagcaagaggctcctcgaggctggccatggttcctccccgggccgcggaggggcaggccgcgggcgggaggggcgcggcgggccggggctcggtgggctccgcccccgcaggacctgcccacccctgccggccgcccgaaccgctgcctggtcctcctctccggtcttcggcttccctcccagtctagtcttcacattgtgctcggcttgggttgcgggaggacccgggcctgggggccaggccccggcgacggcgcctggctaccctcaggcgcgcacaatcggcgtcctcccgggccggggctagggacggcggagaccctccctgcaggcgtggcgtggtgtgtgcgcgctccggcggctgagcctcggcggcttctcgaaagcagcggagaaaagcgccgcagtgccgctgcccgtggaggcggtggtggcggcggcggcagaagacgcccactggcggagcaggcgctccccacgccgccgccgccgccgccgccttccgcgcccacgtagcgcgccccgcgggactcggcccctgcgccaggctcccgcacccgagtgatcctctgtgcgccgcctgcacccggggccggggcgggcggacagagcaaccgctgcgtctctgccctgccttgtcacatctgggtccggtgtttcggattctaaatcctgagtcctgcagctgctccagctgtgcgctgctgggcgagccacgtcggcctgcccgttgcccgagccagggaatcctcctggtagcgggccagcagctccgacccagctgtgct

SEQ ID NO: 95109 - DNA, 298 bp, Homo sapiens; identical to SEQ ID NO: 30925
  misc_feature 1..298: note = chr6:166077335-166077633
  misc_feature 1..298: note = hyper
  source 1..298: mol_type = genomic DNA

SEQ ID NO: 95110 - DNA, 768 bp, Homo sapiens
  misc_feature 1..768: note = chr6:166077668-166078436
  misc_feature 1..768: note = hyper
  source 1..768: mol_type = genomic DNA
cgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttggcactcactaggtcagaatccctacatttgtggaagaagaaaatgattcctgtgactcttaccttaggggcgctgcccttgtttctgaattttttcggcaaagaaaaaaactgcaatggttgagccaggctgccggcagcctcccggcttgacgcttctccagccgtgcagagtccactccggttactttgctgcgagtccggagtttgtgctttcgcgactggaccaggcagcaagggtctgagggctgcccacacatttagggaagtcgagtttctcctcaagtgtttattgtttattcctttacacgcaaaattgtttctccttgtcatttaagtttctttatttgcattttggagttactaaatctatttttcagttccaagaaaatatacatttaacttgcccataagcccccttgcgggcgcaggagaca

SEQ ID NO: 95111 - DNA, 33 bp, Homo sapiens
  misc_feature 1..33: note = chr6:166122198-166122231
  misc_feature 1..33: note = hypo
  source 1..33: mol_type = genomic DNA
tctacccccatgctgcggcgctctgcccccact

SEQ ID NO: 95112 - DNA, 47 bp, Homo sapiens
  misc_feature 1..47: note = chr6:166128567-166128614
  misc_feature 1..47: note = hypo
  source 1..47: mol_type = genomic DNA
gcagggacggccgcccgagaacccccgagggacgctgcagtgcagca

SEQ ID NO: 95113 - DNA, 185 bp, Homo sapiens
  misc_feature 1..185: note = chr6:166217994-166218179
  misc_feature 1..185: note = hyper
  source 1..185: mol_type = genomic DNA
atcaaatgtttggcgcgaaccacagaaacgaggccaggaagaagaggtcgtggtgaagtggctgcaggttagtttcctccgagcagccaaggagcgccggagtttggaaacctggggccctggaaacccgggggccttggcctgcaggcggggctggtgggatcagagcgcgtggtcgcgaaggg

SEQ ID NO: 95114 - DNA, 274 bp, Homo sapiens
  misc_feature 1..274: note = chr6:166218546-166218820
  misc_feature 1..274: note = hyper
  source 1..274: mol_type = genomic DNA
tggagggacatggggcgtacggaggggcagcggggcctggggtcgagcagaggggcgcatggaggggagcatggagggacgtggggcgcgcggaggggcggcggggcgtgggacgcgcggttcttcctcgcgaagttggagaggcctcgggtcgcagggcacccactgtgcgccctggacgaagcctaccctggaggcagcggctccgagggacgccggaaggaacggccgctttcctcagggtccccgcctgcacctgcgggctggcagatcc

SEQ ID NO: 95115 - DNA, 398 bp, Homo sapiens
  misc_feature 1..398: note = chr6:166267494-166267892
  misc_feature 1..398: note = hyper
  source 1..398: mol_type = genomic DNA
gtgggaagccaaggccgtgatgcggggcgtggtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 95116 - DNA, 61 bp, Homo sapiens
  misc_feature 1..61: note = chr6:166298461-166298522
  misc_feature 1..61: note = hyper
  source 1..61: mol_type = genomic DNA
ttaattactgaattccgcctagactgcggtgcggccttcatgtgcacgcccctgccgccgt

SEQ ID NO: 95117 - DNA, 156 bp, Homo sapiens
  misc_feature 1..156: note = chr6:166302038-166302194
  misc_feature 1..156: note = hypo
  source 1..156: mol_type = genomic DNA
tgagattacaggcgtgagccaccgcacctggcctgctttttttcagttgcctattgccttctgcgggaatgtaacttctaccaaggctgggatttttatttgtttgtttgtggatgttttccaagtgccttgaacagtgtccggctcagagcaatc

SEQ ID NO: 95118 - DNA, 30 bp, Homo sapiens
  misc_feature 1..30: note = chr6:166314916-166314946
  misc_feature 1..30: note = hypo
  source 1..30: mol_type = genomic DNA
tcctcatcagggctccgggtctcacgtggg

SEQ ID NO: 95119 - DNA, 111 bp, Homo sapiens
  misc_feature 1..111: note = chr6:166343020-166343131
  misc_feature 1..111: note = hypo
  source 1..111: mol_type = genomic DNA
tgtggggctggatgccgcgacaccctatgtgtcccatgccccagctagcagccccatgtgtgcagggccttcagtgctgctggaaaatcatgaagtcgaaagcatattttc

SEQ ID NO: 95120 - DNA, 30 bp, Homo sapiens
  misc_feature 1..30: note = chr6:166344391-166344421
  misc_feature 1..30: note = hypo
  source 1..30: mol_type = genomic DNA
aacatgggaagccaccgtggtgctgatgaa

SEQ ID NO: 95121 - DNA, 115 bp, Homo sapiens
  misc_feature 1..115: note = chr6:166399418-166399533
  misc_feature 1..115: note = hyper
  source 1..115: mol_type = genomic DNA
tatcctgaagaaacacgtaaaatcccatctgtgggggaaaagtctactcaagttgtcttgctatagggagctctgatgaagcgtggcgagggcattcctgcggagggatctcaac

SEQ ID NO: 95122 - DNA, 945 bp, Homo sapiens
  misc_feature 1..945: note = chr6:166400555-166401500
  misc_feature 1..945: note = hyper
  source 1..945: mol_type = genomic DNA
ggaggaaggaagttgcggtgcacacaccatcccttctccaggccgcctcgggaggcacctgcgggtctggcgcggcagccgctgcggtttgcagctggcgcgcagccctcgctgggaacttggagctctcaaactcctcggatcaagcgttagccccgaggctgtcagttggcgctggggcgggctgcagtctctctcccctcctctgcaaacccttgagtcttcggctttatatactcccttttcttctttctcgagtccactcatcaccctttcccccaaacagtcacctccacaagcacaacacaccacacacgcgcacacgttttcttattgccaaaaagggtggagggaaaggacaggaagtttttttaagtacacgcacacacacacaaagattgggactaagtttttctggactctcaagggttaaataataggtaaaagaactgtcaacttacccgccaaagtatgctgacgcgcatatctgctttccgcttcatttcgagttcataaatttaaaaagagacagtgagagaaagaaaaagaaaaaaaaaggcaaggcgccgggagcacagtgggtccagggttccatggagaactgcgcaaagcaagttgccaagaaagcccgctggccaagttcgggacctgtccaccacgctcgcgcgctccgctcagcaggcagattccaaaggcttggggcactctggggtgcgcgccgatcttctcgcaaaaggcgagtgtgtggggttcctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 95123 - DNA, 717 bp, Homo sapiens
  misc_feature 1..717: note = chr6:166401934-166402651
  misc_feature 1..717: note = hyper
  source 1..717: mol_type = genomic DNA
ccccaacccgacccccgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 95124 - DNA, 158 bp, Homo sapiens
  misc_feature 1..158: note = chr6:166419898-166420056
  misc_feature 1..158: note = hyper
  source 1..158: mol_type = genomic DNA
gtaatgcacagagctcggcttgctgtggctggtgcagctctacacggatgcagagctggtcctcccgttccctggaaatggttttgcaaagttgttggttttgcaaacaataaaagggtaaaaaatggggtttgcaggcaaatcggttggttagaggg

SEQ ID NO: 95125 - DNA, 73 bp, Homo sapiens
  misc_feature 1..73: note = chr6:166421919-166421992
  misc_feature 1..73: note = hyper
  source 1..73: mol_type = genomic DNA
ggagatgcgcccaagcgggggcggaggagcgggtcgcgccgctgacattcgccaaggacaggatggggtgggc

SEQ ID NO: 95126 - DNA, 288 bp, Homo sapiens
  misc_feature 1..288: note = chr6:166421993-166422281
  misc_feature 1..288: note = hyper
  source 1..288: mol_type = genomic DNA
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtgaccatccgcctcctgcgtagcgctgcccccaggagaggaaaacccatcggaggttgtgctgt

SEQ ID NO: 95127 - DNA, 42 bp, Homo sapiens
  misc_feature 1..42: note = chr6:166487228-166487270
  misc_feature 1..42: note = hypo
  source 1..42: mol_type = genomic DNA
ttacaggcttgaggcaccgcgcccggccgaagtaaggcttct

SEQ ID NO: 95128 - DNA, 135 bp, Homo sapiens
  misc_feature 1..135: note = chr6:166571802-166571937
  misc_feature 1..135: note = hypo
  source 1..135: mol_type = genomic DNA
tcacatggaaggtggcgacacaggtgtccatgaggctatgaggcggccttgggctgcggcgtcgtactggctgtccacgatgtctgtggccgcggccgccccttcgtacagtggggatcccgaggaagagggcgc

SEQ ID NO: 95129 - DNA, 2678 bp, Homo sapiens; identical to SEQ ID NO: 30937
  misc_feature 1..2678: note = chr6:166579715-166582393
  misc_feature 1..2678: note = hyper
  source 1..2678: mol_type = genomic DNA

SEQ ID NO: 95130 - DNA, 433 bp, Homo sapiens; identical to SEQ ID NO: 30938
  misc_feature 1..433: note = chr6:166582394-166582827
  misc_feature 1..433: note = hyper
  source 1..433: mol_type = genomic DNA

SEQ ID NO: 95131 - DNA, 155 bp, Homo sapiens; identical to SEQ ID NO: 30939
  misc_feature 1..155: note = chr6:166582941-166583096
  misc_feature 1..155: note = hyper
  source 1..155: mol_type = genomic DNA

SEQ ID NO: 95132 - DNA, 242 bp, Homo sapiens
  misc_feature 1..242: note = chr6:166583152-166583394
  misc_feature 1..242: note = hyper
  source 1..242: mol_type = genomic DNA
cgtggtgcgtgttactctccttactccgggtattaaaatgtctaagaggtcatcgctttggcccaaggcctcccgaggataagataaaagggaaaagtggaggggaggtgaaggaggaacgagggtgggtcccaggcaattgagggcctcggaaccctaggcacgggagcgaaacctctcctgcggcttcagggcaaaggagtcccgaaggctggatccctcccctgcgctcggacggcgtc

SEQ ID NO: 95133 - DNA, 42 bp, Homo sapiens
  misc_feature 1..42: note = chr6:166635577-166635619
  misc_feature 1..42: note = hypo
  source 1..42: mol_type = genomic DNA
ctgcagataaggtgccgtcggacaggcgtctcggtggacctg

SEQ ID NO: 95134 - DNA, 134 bp, Homo sapiens
  misc_feature 1..134: note = chr6:166666726-166666860
  misc_feature 1..134: note = hyper
  source 1..134: mol_type = genomic DNA
tcgaaaaaaaaagaagaggaaagaaaaagaaaaccagaacgagaaagtgcggccagcccgggctcaggagctgggtgggaaacaaagccgccagaaaatgacaagtaaacacgcagccgcgggaagccactggg

SEQ ID NO: 95135 - DNA, 247 bp, Homo sapiens
  misc_feature 1..247: note = chr6:166666879-166667126
  misc_feature 1..247: note = hyper
  source 1..247: mol_type = genomic DNA
cgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctcccaggcaaaggccctccggggtctccgcccggggggccccacctgccttgtgacggctgagatgtg

SEQ ID NO: 95136 - DNA, 135 bp, Homo sapiens
  misc_feature 1..135: note = chr6:166667161-166667296
  misc_feature 1..135: note = hyper
  source 1..135: mol_type = genomic DNA
cgtttctcattaaaaaacaagctttttgaataaccaaatgttcctttggcgccctccaattttattttactgtaatctattgagttgtatttgtttttctgaatccgcttcctaggaaagcgccccctcccattt

SEQ ID NO: 95137 - DNA, 66 bp, Homo sapiens
  misc_feature 1..66: note = chr6:166667524-166667590
  misc_feature 1..66: note = hyper
  source 1..66: mol_type = genomic DNA
cccccaagccagccccgcctacccagagagggccagtcctgttccgggtcccgagggccttgggaa

SEQ ID NO: 95138 - DNA, 188 bp, Homo sapiens
  misc_feature 1..188: note = chr6:166683768-166683956
  misc_feature 1..188: note = hypo
  source 1..188: mol_type = genomic DNA
gtggcgatggggacccggacttgtccaggtgggaggggctgtggcccggaccaggggcttcggggacagggatgagaagcaggaggattctggacacagttctgaggaagagctgtattcctcttattgggattccatggccttcatccttgtctagagaggttggtgccggccgtgcctctgtggga

SEQ ID NO: 95139 - DNA, 137 bp, Homo sapiens
  misc_feature 1..137: note = chr6:166711365-166711502
  misc_feature 1..137: note = hypo
  source 1..137: mol_type = genomic DNA
ggctgcaccaagggacgagatgtgacggtgacagacgatggccaaggccatcttaccgagtgccaggcacgggcctcggcacctgctgtgctctgtctggggaagcgggcacagagatgaagcggccccacggcggt

SEQ ID NO: 95140 - DNA, 278 bp, Homo sapiens
  misc_feature 1..278: note = chr6:166721166-166721444
  misc_feature 1..278: note = hyper
  source 1..278: mol_type = genomic DNA
tgcttctccagatgacgcttctggatgaccaggacggcctcgggggtgagattcaggcagaagcgcgcagcggagtctggacaaggccccgcccccgaggaggtgcccgcggcggtggtccccgtccccgccgaggtcgccgcataggtggtcctcgctgggctgtggccggagcctgccggccggggcggggcgcacgtggctggggcccgcgcgcggctgggcaaggcctggggggagacgcccggaggggccggcggctgcgtcctgtccaggcc

SEQ ID NO: 95141 - DNA, 480 bp, Homo sapiens
  misc_feature 1..480: note = chr6:166721658-166722138
  misc_feature 1..480: note = hyper
  source 1..480: mol_type = genomic DNA
ccctggaaagagaggcgggcgctcagccactgtgcgcggagcgggtccccgcagtccgggcggcccctccacacccacctgcgtccagccgcggcctctccggcttcctcacatcccagcgaccaaacccggggactcaaagagaggcgctcccaccctcccctcctcctgggggtgctcccgggactggaccctgcaggaaccgcctcccgccgtccgactgtgggcgagtcgcggcgcccccgggtccccacagctgagacgcgggccgggccggcaggaggaggagcccagcgcgctcgctaaggacgcggccctgccaggccccgggctgtgcccggctggtgtcacgaccgactgttgaatgggagcaaagtgccaggacagcggagggcggagcgcgcgccaggcatcccggggctcccccagctggcgctccggtggtccgaggttaatgtagtccgtcgaaagccaggagca

SEQ ID NO: 95142 - DNA, 30 bp, Homo sapiens
  misc_feature 1..30: note = chr6:166731737-166731767
  misc_feature 1..30: note = hypo
  source 1..30: mol_type = genomic DNA
agaaatgaagctgaacggacatttctcagg

SEQ ID NO: 95143 - DNA, 30 bp, Homo sapiens
  misc_feature 1..30: note = chr6:166825908-166825938
  misc_feature 1..30: note = hypo
  source 1..30: mol_type = genomic DNA
ggaaaacagatctctcggcagaaacagaag

SEQ ID NO: 95144 - DNA, 32 bp, Homo sapiens; identical to SEQ ID NO: 40979
  misc_feature 1..32: note = chr6:166888304-166888336
  misc_feature 1..32: note = hypo
  source 1..32: mol_type = genomic DNA

SEQ ID NO: 95145 - DNA, 193 bp, Homo sapiens
  misc_feature 1..193: note = chr6:166891666-166891859
  misc_feature 1..193: note = hypo
  source 1..193: mol_type = genomic DNA
tggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctgg

SEQ ID NO: 95146 - DNA, 238 bp, Homo sapiens
  misc_feature 1..238: note = chr6:166911041-166911279
  misc_feature 1..238: note = hypo
  source 1..238: mol_type = genomic DNA
tcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcat

SEQ ID NO: 95147 - DNA, 30 bp, Homo sapiens
  misc_feature 1..30: note = chr6:166914926-166914956
  misc_feature 1..30: note = hypo
  source 1..30: mol_type = genomic DNA
ggcatcgaggagcttcgggcttcagcaggt

SEQ ID NO: 95148 - DNA, 33 bp, Homo sapiens
  misc_feature 1..33: note = chr6:166939005-166939038
  misc_feature 1..33: note = hypo
  source 1..33: mol_type = genomic DNA
gagatcaaatggagccgtcggaagccattatcc

SEQ ID NO: 95149 - DNA, 30 bp, Homo sapiens
  misc_feature 1..30: note = chr6:166943962-166943992
  misc_feature 1..30: note = hypo
  source 1..30: mol_type = genomic DNA
acgccctgtgtggcacggggtgccctcctc

SEQ ID NO: 95150 - DNA, 166 bp, Homo sapiens
  misc_feature 1..166: note = chr6:166944346-166944512
  misc_feature 1..166: note = hypo
  source 1..166: mol_type = genomic DNA
cgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 95151 - DNA, 30 bp, Homo sapiens
  misc_feature 1..30: note = chr6:166946950-166946980
  misc_feature 1..30: note = hypo
  source 1..30: mol_type = genomic DNA
tgtttgtggcagggacgccacatttccccg

SEQ ID NO: 95152 - DNA, 30 bp, Homo sapiens; identical to SEQ ID NO: 40982
  misc_feature 1..30: note = chr6:166982961-166982991
  misc_feature 1..30: note = hypo
  source 1..30: mol_type = genomic DNA

SEQ ID NO: 95153 - DNA, 83 bp, Homo sapiens
  misc_feature 1..83: note = chr6:167038238-167038321
  misc_feature 1..83: note = hypo
  source 1..83: mol_type = genomic DNA
ttacatatgctaccccgattttcacaagtatcaaataatagaaagctggggaatgcatttgtaaaaaagagagcattgtatta

SEQ ID NO: 95154 - DNA, 30 bp, Homo sapiens
  misc_feature 1..30: note = chr6:167039728-167039758
  misc_feature 1..30: note = hyper
  source 1..30: mol_type = genomic DNA
taagatgccaagatgcgggacaggtagaaa

SEQ ID NO: 95155 - DNA, 198 bp, Homo sapiens
  misc_feature 1..198: note = chr6:167040127-167040325
  misc_feature 1..198: note = hyper
  source 1..198: mol_type = genomic DNA
gaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtcc

SEQ ID NO: 95156 - DNA, 94 bp, Homo sapiens
  misc_feature 1..94: note = chr6:167041860-167041954
  misc_feature 1..94: note = hyper
  source 1..94: mol_type = genomic DNA
tgcaaagagcagaaacgagtgcggtggtgagttgacaagtcttgcttgctcttttgcagtgcgaactgcaaaatcctcgcgttgttttgctccc

SEQ ID NO: 95157 - DNA, 30 bp, Homo sapiens
  misc_feature 1..30: note = chr6:167045191-167045221
  misc_feature 1..30: note = hypo
  source 1..30: mol_type = genomic DNA
atgactcccaaacagcgagaagggagggcc

SEQ ID NO: 95158 - DNA, 124 bp, Homo sapiens
  misc_feature 1..124: note = chr6:167128131-167128255
  misc_feature 1..124: note = hypo
  source 1..124: mol_type = genomic DNA
aagccaaggagcacccgaaccgcctgaagcaccagaagcaaagagaagggcctggaacaggctgtccctccccgcctcagcaggagcccactctgccacacctccaactcggacttccagcctc

SEQ ID NO: 95159 - DNA, 87 bp, Homo sapiens
  misc_feature 1..87: note = chr6:167129163-167129250
  misc_feature 1..87: note = hypo
  source 1..87: mol_type = genomic DNA
gagcctgcacacacacggctgcgctgaacactggaggcagctgcagcttcctggtcgtgtatccaaacatagaaaagctgggccagg

SEQ ID NO: 95160 - DNA, 30 bp, Homo sapiens
  misc_feature 1..30: note = chr6:167130073-167130103
  misc_feature 1..30: note = hypo
  source 1..30: mol_type = genomic DNA
tccctctgcactgcacggctgcatatgtaa

SEQ ID NO: 95161 - DNA, 102 bp, Homo sapiens
  misc_feature 1..102: note = chr6:167136306-167136408
  misc_feature 1..102: note = hypo
  source 1..102: mol_type = genomic DNA
tccatgagcttcaatcgctgcattttcagcccattcctctctgcatttctggagtaatttcggttactctttgcacagctccctctccgagtccacaggact

SEQ ID NO: 95162 - DNA, 308 bp, Homo sapiens
  misc_feature 1..308: note = chr6:167139142-167139450
  misc_feature 1..308: note = hypo
  source 1..308: mol_type = genomic DNA
ggtggggtgggcccacggggagaccctcactccacctgccttctcttcagatgctggggacgagagtgaagctccgagtttctgcttgcacagcttcctcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaa

SEQ ID NO: 95163 - DNA, 159 bp, Homo sapiens; identical to SEQ ID NO: 40985
  misc_feature 1..159: note = chr6:167140362-167140521
  misc_feature 1..159: note = hypo
  source 1..159: mol_type = genomic DNA

SEQ ID NO: 95164 - DNA, 42 bp, Homo sapiens
  misc_feature 1..42: note = chr6:167144433-167144475
  misc_feature 1..42: note = hypo
  source 1..42: mol_type = genomic DNA
aaaatagatgtcatccgccgggtgcagtggctcttgcctgta

SEQ ID NO: 95165 - DNA, 30 bp, Homo sapiens
  misc_feature 1..30: note = chr6:167250605-167250635
  misc_feature 1..30: note = hypo
  source 1..30: mol_type = genomic DNA
tcttgctgggaggtgcgtggtgaggccagg

SEQ ID NO: 95166 - DNA, 363 bp, Homo sapiens
  misc_feature 1..363: note = chr6:167275668-167276031
  misc_feature 1..363: note = hyper
  source 1..363: mol_type = genomic DNA
tccttttctgctggtcgagtattgatagtaggaaaggaaataaacagaggctcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgaggaaaggaggggacggcgctgcggcttcggaatctgtactgcgactttggcagagtaaacgctgcacttgcagc

SEQ ID NO: 95167 - DNA, 272 bp, Homo sapiens
  misc_feature 1..272: note = chr6:167276309-167276581
  misc_feature 1..272: note = hyper
  source 1..272: mol_type = genomic DNA
ggagggacaggaacacggacggagggaccgggacgaggggagggctccacgcagcacagctgctttcctgcggagcgttcaggagactcgggcacctctggaagcgctgcggactgagctgcccgcggctgcccccgccccgagggccgggacagcacctcaggagaagagggacgaagagggacgacagacaaatagctggggagaggcgggggggggcggcccgtggggtccgctgggccctacccagccctgcccggagctgcccgaaa

SEQ ID NO: 95168 - DNA, 30 bp, Homo sapiens
  misc_feature 1..30: note = chr6:167601185-167601215
  misc_feature 1..30: note = hypo
  source 1..30: mol_type = genomic DNA
ggatgcctctgtaaacgccgtcagacctta

SEQ ID NO: 95169 - DNA, 30 bp, Homo sapiens
  misc_feature 1..30: note = chr6:167753495-167753525
  misc_feature 1..30: note = hypo
  source 1..30: mol_type = genomic DNA
gacagctggcagcaccgggtgcacggtttc

SEQ ID NO: 95170 - DNA, 194 bp, Homo sapiens
  misc_feature 1..194: note = chr6:167764951-167765145
  misc_feature 1..194: note = hyper
  source 1..194: mol_type = genomic DNA
aaaggtgaatctgaccgcgttgaccgcgttacttcagagatgcgctgtgagctgctttgtgccgcgaaatgacctgtttacccgacagcgccctctgcagcccagcgccggaacgggctttttcatgatgttcctgcgttgtgtttacagcctccctgcgaggggttcgcacgcacaggcggacctcgttttgt

SEQ ID NO: 95171 - DNA, 30 bp, Homo sapiens
  misc_feature 1..30: note = chr6:167833924-167833954
  misc_feature 1..30: note = hypo
  source 1..30: mol_type = genomic DNA
ggacactgggtctgtcgccatgttttgtct

SEQ ID NO: 95172 - DNA, 324 bp, Homo sapiens
  misc_feature 1..324: note = chr6:167835015-167835339
  misc_feature 1..324: note = hypo
  source 1..324: mol_type = genomic DNA
agggcaggagagaggcgcaagcgggagctgctcttgctatgccagggcggtgctagagatagactttgccctgggctgggctgttttccccccacgcggatcctcacctccgcttctccactggctttccgcctttacatacgtctattttaaatttgtgttaggcacccccacactgtgactcccctcaacactgccgctcccccacgcacacagcggctcccccaacacacggctgctccccccacagcctgcggctccccacacacggcggctcatccacatatgctggctccccactacgcaaggcgtctccaaccctcc

SEQ ID NO: 95173 - DNA, 71 bp, Homo sapiens
  misc_feature 1..71: note = chr6:167836558-167836629
  misc_feature 1..71: note = hypo
  source 1..71: mol_type = genomic DNA
ctccaaccctccacacggcggctcctccacaaatacggcggctccccctcccacggcggctcccccacaca

SEQ ID NO: 95174 - DNA, 32 bp, Homo sapiens
  misc_feature 1..32: note = chr6:167837812-167837844
  misc_feature 1..32: note = hypo
  source 1..32: mol_type = genomic DNA
tgccctggtcacctacgcgtcacctaagcccc

SEQ ID NO: 95175 - DNA, 30 bp, Homo sapiens
  misc_feature 1..30: note = chr6:168122238-168122268
  misc_feature 1..30: note = hypo
  source 1..30: mol_type = genomic DNA
ggcagggcattgctgcgttggttttctcat

SEQ ID NO: 95176 - DNA, 152 bp, Homo sapiens
  misc_feature 1..152: note = chr6:168122617-168122769
  misc_feature 1..152: note = hypo
  source 1..152: mol_type = genomic DNA
gtcaaatattgattccgccgcgtattaacatgaatgccgctttgagtacctcactgccctctgccagcctcggtttcctcatctgtacaatacagtcaataacattaccattgtcattttgtgtagctctgggatgtcgtgcctggcctgtg

SEQ ID NO: 95177 - DNA, 30 bp, Homo sapiens
  misc_feature 1..30: note = chr6:168375613-168375643
  misc_feature 1..30: note = hypo
  source 1..30: mol_type = genomic DNA
cgaggccgtgctgcgcggggaggctgggta

SEQ ID NO: 95178 - DNA, 191 bp, Homo sapiens
  misc_feature 1..191: note = chr6:168376093-168376284
  misc_feature 1..191: note = hypo
  source 1..191: mol_type = genomic DNA
gaactgatcagatgtcggacgcaggcgtgggggattctcacggcgatgcagacttgaggctgagttgaaaaagggcgtggagaagcccagggtctggtcagggagggcgtccttggcactggggccatgagaagctggtgtccatgttcctaaccaacgatgccacatggtcgccgcgatcacgtcgcaca

SEQ ID NO: 95179 - DNA, 207 bp, Homo sapiens
  misc_feature 1..207: note = chr6:168377401-168377608
  misc_feature 1..207: note = hypo
  source 1..207: mol_type = genomic DNA
gctcctgggactcagcgctgcgcctctgggaagggccggtccaggagctccgcaagttgcgggagaacctggcgggtccgtggtccagcgaggcctgggattcagaagggatgaaacgttcctcgacgcttgaacaccggcctcctgcccctgggtcttcctgctatttcttcctgcccctcgctcccgcctcgagccaccccctcg

SEQ ID NO: 95180 - DNA, 33 bp, Homo sapiens; identical to SEQ ID NO: 40990
  misc_feature 1..33: note = chr6:168399961-168399994
  misc_feature 1..33: note = hypo
  source 1..33: mol_type = genomic DNA

SEQ ID NO: 95181 - DNA, 204 bp, Homo sapiens
  misc_feature 1..204: note = chr6:168453289-168453493
  misc_feature 1..204: note = hypo
  source 1..204: mol_type = genomic DNA
gtccagttcctgctgcgtgcactggtttgtgacagcagcagtggctgaatggagagaaccacacccctgccagcgggaggcctggctggtcacctgagcacagatgccagggcagagccaggaggggactcaggatgaacactgccaccctggggcggctggagaaccaggcatgggccggcggcgagccgggagggagcccca

SEQ ID NO: 95182 - DNA, 36 bp, Homo sapiens
  misc_feature 1..36: note = chr6:168462485-168462521
  misc_feature 1..36: note = hypo
  source 1..36: mol_type = genomic DNA
ccttctgcctcctcccgctgccgcagctgttgcaga

SEQ ID NO: 95183 - DNA, 30 bp, Homo sapiens
  misc_feature 1..30: note = chr6:168479771-168479801
  misc_feature 1..30: note = hypo
  source 1..30: mol_type = genomic DNA
catgctgtcgttactcggccctcccccgcc

SEQ ID NO: 95184 - skipped

SEQ ID NO: 95185 - DNA, 183 bp, Homo sapiens
  misc_feature 1..183: note = chr6:168719889-168720072
  misc_feature 1..183: note = hyper
  source 1..183: mol_type = genomic DNA
cgcgcggggcctccatgtccccctccttggagaccgaactgcattccattcaaatcccaaaggacgtcccctccatccatcagacacccccgtcccactaacacacagtcgctgccgaaggagcagcgcctgtggcccgcacacctcgcagccccgagtcccggcgcccggtccttaccagct

SEQ ID NO: 95186 - DNA, 58 bp, Homo sapiens
  misc_feature 1..58: note = chr6:168760650-168760708
  misc_feature 1..58: note = hypo
  source 1..58: mol_type = genomic DNA
gtcctcccagggtcccgtaattactttaatatgtgtgcacaatcgcagcctgagagga

SEQ ID NO: 95187 - DNA, 180 bp, Homo sapiens
  misc_feature 1..180: note = chr6:168771518-168771698
  misc_feature 1..180: note = hypo
  source 1..180: mol_type = genomic DNA
gggcgtggggtcaatcggctgacggcaggagcccggggggatctttccaaggcgtcttggcgagtccaggctgggccctggatgtcgtggccgcagggtcggggtgtggttccccgggagcggcagagcttgtgtccccgctttgtcccctcaggttggtgggcacgtggcaccccagga

SEQ ID NO: 95188 - DNA, 56 bp, Homo sapiens
  misc_feature 1..56: note = chr6:168841423-168841479
  misc_feature 1..56: note = hyper
  source 1..56: mol_type = genomic DNA
gtggatgaaaagtcccgctgggctgatcctgcgcggaccgggcctggaccctgggg

SEQ ID NO: 95189 - DNA, 1016 bp, Homo sapiens
  misc_feature 1..1016: note = chr6:168841502-168842518
  misc_feature 1..1016: note = hyper
  source 1..1016: mol_type = genomic DNA
cgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 95190 - DNA, 203 bp, Homo sapiens
  misc_feature 1..203: note = chr6:168842858-168843061
  misc_feature 1..203: note = hyper
  source 1..203: mol_type = genomic DNA
caggcggcggctccccgctctgcggggcctctgggttcttcctcgtggcagggatgctgcgctcctgagcgcgagggtcaccgcggttgaccgctgtgtgtttttctttctgagctgtaacttctatgcgacagccttggcccggccaacgcacgcggtgtcaaacgaggagctatgtagagggggctgagccaagcccccgc

SEQ ID NO: 95191 - DNA, 179 bp, Homo sapiens
  misc_feature 1..179: note = chr6:168843080-168843259
  misc_feature 1..179: note = hyper
  source 1..179: mol_type = genomic DNA
cggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaacgcctctggtggaca

SEQ ID NO: 95192 - DNA, 248 bp, Homo sapiens
  misc_feature 1..248: note = chr6:168858091-168858339
  misc_feature 1..248: note = hypo
  source 1..248: mol_type = genomic DNA
acaaacggcacccaccgaccctgcactggagctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcactgccggggtgggagcctggcctcgcactcgctgcagccccggc

SEQ ID NO: 95193 - DNA, 177 bp, Homo sapiens
  misc_feature 1..177: note = chr6:168947622-168947799
  misc_feature 1..177: note = hypo
  source 1..177: mol_type = genomic DNA
tatagtcattccagccgcagctgcaggcagcatcgcgttgggtctgtgtggggttgctgttgtggttgatctgtggggactgagtgcaagtcctcagcatccacccgtatgcacacttacttaacttactctcataattgtagtctccttgcaaatcttttccgttctgaattcaga

SEQ ID NO: 95194 - DNA, 66 bp, Homo sapiens
  misc_feature 1..66: note = chr6:168983395-168983461
  misc_feature 1..66: note = hypo
  source 1..66: mol_type = genomic DNA
gaggagtgcgtcacgcggtgtttccacctgtttggagcatgtccgacctgccgggaactcagagct

SEQ ID NO: 95195 - DNA, 128 bp, Homo sapiens
  misc_feature 1..128: note = chr6:168999540-168999668
  misc_feature 1..128: note = hypo
  source 1..128: mol_type = genomic DNA
caagcagcccaagaacgacaatgtggtgatccctgagtgtgcgcacggcggcctctacaagccagtgcagtgccacccctccacggggtactgctggtgcgtcctggtggacacggggcgccccattc

SEQ ID NO: 95196 - DNA, 32 bp, Homo sapiens
  misc_feature 1..32: note = chr6:169067893-169067925
  misc_feature 1..32: note = hypo
  source 1..32: mol_type = genomic DNA
aaatgtaaatccagtcgcggtgtgaccgagct

SEQ ID NO: 95197 - DNA, 30 bp, Homo sapiens
  misc_feature 1..30: note = chr6:169102398-169102428
  misc_feature 1..30: note = hypo
  source 1..30: mol_type = genomic DNA
tctccccagcatagccgatgtggcatggct

SEQ ID NO: 95198 - DNA, 51 bp, Homo sapiens
  misc_feature 1..51: note = chr6:169105616-169105667
  misc_feature 1..51: note = hypo
  source 1..51: mol_type = genomic DNA
cagagtcctccagtacgcagagccccagggcgggcacggagtcctccagca

SEQ ID NO: 95199 - DNA, 41 bp, Homo sapiens
  misc_feature 1..41: note = chr6:169400235-169400276
  misc_feature 1..41: note = hypo
  source 1..41: mol_type = genomic DNA
tttccagtgctgccccggtgcctctgcggtggaggagctag

SEQ ID NO: 95200 - DNA, 138 bp, Homo sapiens
  misc_feature 1..138: note = chr6:169462691-169462829
  misc_feature 1..138: note = hypo
  source 1..138: mol_type = genomic DNA
agccacagcaccaaccgtcacactggctagggcagcaccaaccgtcacactggctagggcagctccaaccgtcacactggctagggcagcaccaaccgtcacactggctagggcagctccaaccgtcacactggctag

SEQ ID NO: 95201 - DNA, 165 bp, Homo sapiens
  misc_feature 1..165: note = chr6:169539538-169539703
  misc_feature 1..165: note = hypo
  source 1..165: mol_type = genomic DNA
ccccacaagtgaggccgaggaggtcggcgccaggggaaccagggccggtgctgagcagctccggtggaggccgtcagtggacttgagttttaaaaaggctcctgcggcgtggtcctggccagcttctctgctgctccgtggaaaggcctccgggacagtggcctg

SEQ ID NO: 95202 - DNA, 169 bp, Homo sapiens
  misc_feature 1..169: note = chr6:169562391-169562560
  misc_feature 1..169: note = hypo
  source 1..169: mol_type = genomic DNA
ccaggtcctccttcacgttctcgccaccccaaatgcgggcaccgcggcgccaaacctgctcttcccactgttgtcaataaccgcagcctggccgaatccagtgattcatttctgtcttaatctctcctggcctttcggcagcgtttaacgtgtgcgacccctcccttct

SEQ ID NO: 95203 - DNA, 177 bp, Homo sapiens
  misc_feature 1..177: note = chr6:169562792-169562969
  misc_feature 1..177: note = hypo
  source 1..177: mol_type = genomic DNA
tcaattgatcaatgccgaggatggggagcaatgcgtgtaccagagggggctgggcacacgcaggcttgttgttggatggaggagaggcagcatcccctgcatgcctgggtggtccccatctccaggcctgcgacaagcacttctcatcttcccatcctctgacggagccagtcccac

SEQ ID NO: 95204 - DNA, 107 bp, Homo sapiens
  misc_feature 1..107: note = chr6:169567826-169567933
  misc_feature 1..107: note = hypo
  source 1..107: mol_type = genomic DNA
gccagcaggccctgccgcatctccgggctggaggcttgactgtcagcagatgaggccacggggtcggggtgtctctcccaccagaacggcttcgtggggtgctcact

SEQ ID NO: 95205 - DNA, 30 bp, Homo sapiens
  misc_feature 1..30: note = chr6:169571409-169571439
  misc_feature 1..30: note = hypo
  source 1..30: mol_type = genomic DNA
ggtctttacttttcacgcaggtgatggaac

SEQ ID NO: 95206 - DNA, 496 bp, Homo sapiens
  misc_feature 1..496: note = chr6:169632340-169632836
  misc_feature 1..496: note = hypo
  source 1..496: mol_type = genomic DNA
ccggaggcgtcgaggcggggcgtcgggcaccgcaggccccagcaggtccggtcccaagcggacccaagtcctgaagtgggaagggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggca

SEQ ID NO: 95207 - DNA, 39 bp, Homo sapiens
  misc_feature 1..39: note = chr6:169633129-169633168
  misc_feature 1..39: note = hypo
  source 1..39: mol_type = genomic DNA
gagcagagttcaccacgcgccctgcgcagcacagaagga

SEQ ID NO: 95208 - DNA, 30 bp, Homo sapiens
  misc_feature 1..30: note = chr6:169634777-169634807
  misc_feature 1..30: note = hypo
  source 1..30: mol_type = genomic DNA
atcagaatggaagcccgggtttcagtgccc

SEQ ID NO: 95209 - DNA, 118 bp, Homo sapiens
  misc_feature 1..118: note = chr6:169637173-169637291
  misc_feature 1..118: note = hypo
  source 1..118: mol_type = genomic DNA
tgacaccccggatcccggctccagctgtggctgctcactgtgagctgcctgcaagcccgcccacccagggccccgccttcaccgtacttacttgggcatggggcgccctggcaggctt

SEQ ID NO: 95210 - DNA, 35 bp, Homo sapiens; identical to SEQ ID NO: 40999
  misc_feature 1..35: note = chr6:169637816-169637851
  misc_feature 1..35: note = hypo
  source 1..35: mol_type = genomic DNA

SEQ ID NO: 95211 - DNA, 42 bp, Homo sapiens
  misc_feature 1..42: note = chr6:169640567-169640609
  misc_feature 1..42: note = hypo
  source 1..42: mol_type = genomic DNA
gctgtccaccacccacgtttcattttccgcaaagaaccggcc

SEQ ID NO: 95212 - DNA, 116 bp, Homo sapiens
  misc_feature 1..116: note = chr6:169641889-169642005
  misc_feature 1..116: note = hypo
  source 1..116: mol_type = genomic DNA
gaggacgtggagccccgagagctcctggaccatgtttcccagctcctcgcacgagcgttcgcacacctcgggcctcctctccgagctggggcccacgtactcggtggtgacatgcg

SEQ ID NO: 95213 - DNA, 454 bp, Homo sapiens
  misc_feature 1..454: note = chr6:169653638-169654092
  misc_feature 1..454: note = hyper
  source 1..454: mol_type = genomic DNA
gcagtagaaacaccacgtgaagaaacacttgccatttagtgttaatagatacaccacccaccttaagttaagaatcgaaattgctcctttttcttctccgcttcttagagttcgagaactctaatttcttaaaattagagcaccattaaataattgattgagtttaagaaataatcgtacctggtttgccaaaaagatgcagtgatgactggtttcagtgttccggaccgagtcagaaaggcgcaggctctgctggagcgagagaccggccctgcagtgcaggatgctccggtggacgtggccgagcggctcccgggcagcgcggctttatatgccgcttctcctgtgcagggctgtcaatcagacacacgaggaagcacgtttaattcattccttcgaaggaatgacatcatcccccttctgatctcaccatttgctccgagtacctgctgca

SEQ ID NO: 95214 - DNA, 42 bp, Homo sapiens
  misc_feature 1..42: note = chr6:169713648-169713690
  misc_feature 1..42: note = hypo
  source 1..42: mol_type = genomic DNA
tcaggttgccacctccgcgcaccatgccgagggcattgtcct

SEQ ID NO: 95215 - DNA, 48 bp, Homo sapiens
  misc_feature 1..48: note = chr6:169740765-169740813
  misc_feature 1..48: note = hypo
  source 1..48: mol_type = genomic DNA
cctctgtccatgggccgagccaacagcgagcttcgtgcagaggggaga

SEQ ID NO: 95216 - DNA, 36 bp, Homo sapiens
  misc_feature 1..36: note = chr6:169852398-169852434
  misc_feature 1..36: note = hypo
  source 1..36: mol_type = genomic DNA
cttgcttgaaagaaacgtttgcgatttttagtggaa

SEQ ID NO: 95217 - DNA, 30 bp, Homo sapiens; identical to SEQ ID NO: 41002
  misc_feature 1..30: note = chr6:170065367-170065397
  misc_feature 1..30: note = hypo
  source 1..30: mol_type = genomic DNA

SEQ ID NO: 95218 - DNA, 45 bp, Homo sapiens
  misc_feature 1..45: note = chr6:170091017-170091062
  misc_feature 1..45: note = hypo
  source 1..45: mol_type = genomic DNA
tacttcaaaagaggccgggcacggtcgctcacgcctgtaatccca

SEQ ID NO: 95219 - DNA, 30 bp, Homo sapiens; identical to SEQ ID NO: 41003
  misc_feature 1..30: note = chr6:170201723-170201753
  misc_feature 1..30: note = hypo
  source 1..30: mol_type = genomic DNA

SEQ ID NO: 95220 - DNA, 30 bp, Homo sapiens; identical to SEQ ID NO: 41004
  misc_feature 1..30: note = chr6:170240081-170240111
  misc_feature 1..30: note = hypo
  source 1..30: mol_type = genomic DNA

SEQ ID NO: 95221 - DNA, 30 bp, Homo sapiens
  misc_feature 1..30: note = chr6:170240765-170240795
  misc_feature 1..30: note = hypo
  source 1..30: mol_type = genomic DNA
tcccaggacaatggccgtctcagggcctgg

SEQ ID NO: 95222 - DNA, 30 bp, Homo sapiens
  misc_feature 1..30: note = chr6:170249406-170249436
  misc_feature 1..30: note = hypo
  source 1..30: mol_type = genomic DNA
aggcacagctgagctcgttcaaagacgttt

SEQ ID NO: 95223 - DNA, 50 bp, Homo sapiens
  misc_feature 1..50: note = chr6:170263200-170263250
  misc_feature 1..50: note = hypo
  source 1..50: mol_type = genomic DNA
ctgagctgggtggggcgctgagggtcccttccctccgtccctgccaccct

SEQ ID NO: 95224 - DNA, 42 bp, Homo sapiens
  misc_feature 1..42: note = chr6:170264728-170264770
  misc_feature 1..42: note = hypo
  source 1..42: mol_type = genomic DNA
tcaatgacaaggctccggcgagttgtgcggcaggactcagat

SEQ ID NO: 95225 - DNA, 139 bp, Homo sapiens
  misc_feature 1..139: note = chr6:170339404-170339543
  misc_feature 1..139: note = hypo
  source 1..139: mol_type = genomic DNA
gactacccgtgagcccggtgacgtcacggtggagaccacccgcgaggctggtgacgtcacagtgcaggagaccaccgcgaacctggtgacgtcacggtgggggagaccaccccgagccctgtgacgtcacggtggagga

SEQ ID NO: 95226 - DNA, 30 bp, Homo sapiens
  misc_feature 1..30: note = chr6:170343912-170343942
  misc_feature 1..30: note = hypo
  source 1..30: mol_type = genomic DNA
gcgtacacatgggcacggcatcctgggccg

SEQ ID NO: 95227 - DNA, 30 bp, Homo sapiens; identical to SEQ ID NO: 41006
  misc_feature 1..30: note = chr6:170361487-170361517
  misc_feature 1..30: note = hypo
  source 1..30: mol_type = genomic DNA

SEQ ID NO: 95228 - DNA, 30 bp, Homo sapiens
  misc_feature 1..30: note = chr6:170365462-170365492
  misc_feature 1..30: note = hypo
  source 1..30: mol_type = genomic DNA
tagccgggtcctcgacgatccagctgcaga

SEQ ID NO: 95229 - DNA, 30 bp, Homo sapiens; identical to SEQ ID NO: 41007
  misc_feature 1..30: note = chr6:170368767-170368797
  misc_feature 1..30: note = hypo
  source 1..30: mol_type = genomic DNA

SEQ ID NO: 95230 - DNA, 30 bp, Homo sapiens
  misc_feature 1..30: note = chr6:170371320-170371350
  misc_feature 1..30: note = hypo
  source 1..30: mol_type = genomic DNA
aaaatgttcagggtacgaagggcttcacta

SEQ ID NO: 95231 - DNA, 30 bp, Homo sapiens
  misc_feature 1..30: note = chr6:170374015-170374045
  misc_feature 1..30: note = hypo
  source 1..30: mol_type = genomic DNA
ctgccttctgcaggccgttctggggcaggg

SEQ ID NO: 95232 - DNA, 42 bp, Homo sapiens
  misc_feature 1..42: note = chr6:170392903-170392945
  misc_feature 1..42: note = hypo
  source 1..42: mol_type = genomic DNA
ttctcggcgtccagacggccgccttctcgctgtgtcctctgg

SEQ ID NO: 95233 - DNA, 323 bp, Homo sapiens
  misc_feature 1..323: note = chr6:170402281-170402604
  misc_feature 1..323: note = hypo
  source 1..323: mol_type = genomic DNA
gaggaaagggacctgcgtgggaaggaaggggcaggggaggcttcgagaaagagccaggaccgtgtagttggacccttggagggagctacacgtggccaagggtgcagggcggccccaggctggggaacagcaccggccaagctcggggaagggcgtggacaaggccggcccgtggaacggaagggagcatcgcactgttaaaaggtcatgaaacgtccgggagcctcagcaggggaggccgagtgtggaggtttagaggaaaggaatgaggctgaggctgccaaggaaaagcatggtgtggggggacccggaggccccgcggt

SEQ ID NO: 95234 - DNA, 38 bp, Homo sapiens
  misc_feature 1..38: note = chr6:170408290-170408328
  misc_feature 1..38: note = hypo
  source 1..38: mol_type = genomic DNA
ccgcacagctcccaacggcaccgcgcagctcccaacgg

SEQ ID NO: 95235 - DNA, 32 bp, Homo sapiens
  misc_feature 1..32: note = chr6:170409702-170409734
  misc_feature 1..32: note = hypo
  source 1..32: mol_type = genomic DNA
gcccatcagccaccacgcgctgggagccatgg

SEQ ID NO: 95236 - DNA, 114 bp, Homo sapiens
  misc_feature 1..114: note = chr6:170413679-170413793
  misc_feature 1..114: note = hypo
  source 1..114: mol_type = genomic DNA
cactcacagagccaccggtgaccccggcagagtcaggacatgctcaccgtgagggtgcacacccagcgagggcatcactcacagagccatcggtgaccccggcagagtcaggac

SEQ ID NO: 95237 - DNA, 138 bp, Homo sapiens
  misc_feature 1..138: note = chr6:170454062-170454200
  misc_feature 1..138: note = hypo
  source 1..138: mol_type = genomic DNA
gagaacggcagtgcccgtgagcacctggagaacggcggtgcccttgagcacgtggagaactgcagtgccctttagtacatggagaacggcggtgcccttgagcacctggagaacggcagtgcccgtgagcacctggag

SEQ ID NO: 95238 - DNA, 781 bp, Homo sapiens
  misc_feature 1..781: note = chr6:170474843-170475624
  misc_feature 1..781: note = hypo
  source 1..781: mol_type = genomic DNA
tccgacgttgctcagcgtccagcaaggggctgcccagatcccgtcttccacagaccccctctgaggccctcgttccctcaaaccccaggagccagctctgcccccgcacagctccacggccccaggctgcttcccgctactgtaacagacgaccacaggtcgcataggccagagcccggcacggcttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 95239 - DNA, 48 bp, Homo sapiens
  misc_feature 1..48: note = chr6:170475958-170476006
  misc_feature 1..48: note = hypo
  source 1..48: mol_type = genomic DNA
cagcccttccaagggcgcggccaggcagttgggcggctcttccaggga

SEQ ID NO: 95240 - DNA, 142 bp, Homo sapiens
  misc_feature 1..142: note = chr6:170493059-170493201
  misc_feature 1..142: note = hypo
  source 1..142: mol_type = genomic DNA
cctggggcctttgcacggcggctgctgccatctgctcctccctggcgctgtggggccagctcctttcttcgagttctctcactggacgcattgccacctcacacgggacccctgaccctgagctggccgggtggggccaagt

SEQ ID NO: 95241 - DNA, 126 bp, Homo sapiens
  misc_feature 1..126: note = chr6:170526716-170526842
  misc_feature 1..126: note = hypo
  source 1..126: mol_type = genomic DNA
ttgtgtacaagctcacgggaggaggaggttaaccctcgggagaagctgtgctggggaggctgcatgaaagtccttcttggaagccagagaccaggttggggatccagactgcgaagtcacatgact

SEQ ID NO: 95242 - DNA, 30 bp, Homo sapiens
  misc_feature 1..30: note = chr6:170538913-170538943
  misc_feature 1..30: note = hypo
  source 1..30: mol_type = genomic DNA
tgcccttggcacacccgggctgcagacggc

SEQ ID NO: 95243 - DNA, 142 bp, Homo sapiens
  misc_feature 1..142: note = chr6:170569776-170569918
  misc_feature 1..142: note = hypo
  source 1..142: mol_type = genomic DNA
catttcaaaaaaaaacaatactaggattgaagtttgcttcctaacttccagtgacacggttttttcaatctaggatttaaaacaaaaattatgctttacagcaaaggagagtttgggttttcactcccggaggtgttcggag

SEQ ID NO: 95244 - DNA, 76 bp, Homo sapiens
  misc_feature 1..76: note = chr6:170579513-170579589
  misc_feature 1..76: note = hypo
  source 1..76: mol_type = genomic DNA
cagtgcccactgaagcgtcctgctcccttcttcgcacagatggcagtgtggggccaggggacgtgtggcatcattt

SEQ ID NO: 95245 - DNA, 30 bp, Homo sapiens
  misc_feature 1..30: note = chr6:170592975-170593005
  misc_feature 1..30: note = hypo
  source 1..30: mol_type = genomic DNA
tcgttcacgccatcccggcaggtgcccccg

SEQ ID NO: 95246 - DNA, 148 bp, Homo sapiens
  misc_feature 1..148: note = chr6:170598204-170598352
  misc_feature 1..148: note = hyper
  source 1..148: mol_type = genomic DNA
gggatgggcacgctccgggtggtagcggtcgcgctgcgcgggtaatcgcgccaccaacgcgtctaggagtcgggaaaccagaaccttcccacgtgaaggggcgcctctgactggagacctggcacagaggccggatacggaaatctcc

SEQ ID NO: 95247 - DNA, 382 bp, Homo sapiens
  misc_feature 1..382: note = chr6:170598458-170598840
  misc_feature 1..382: note = hyper
  source 1..382: mol_type = genomic DNA
cgctaggcagatcgcagcgcccacctgcgcctcgcggggtccccgaggtcccgccaccgagcgcccaaggcgggatcccagcgcgtcctgcagcccgcccagcttcagggccggcccggcgcgcgcaggtgcggcactcaccggccaggtgaagccgaaggggaagcggatggggttgctgaacgcggagtcggcgcccccgccgtcgggcagactgaaggagtcgacgcccagcacgggggtgacggcgctgccgtaggtgcagggcggctcgggggacacgctggcctggtagtgcttgaggcacacgcggaagaaggtccggcaggcgcacggcggtggccccgcgcccccgcggcagcagttgcggttccccagcagc

SEQ ID NO: 95248 - DNA, 356 bp, Homo sapiens
  misc_feature 1..356: note = chr6:170605520-170605876
  misc_feature 1..356: note = hyper
  source 1..356: mol_type = genomic DNA
gggccactgcgagggcggagggcggcgccagggccctcccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgccaggaggtgctgcaggagcccgcgcggggtgggggtctccggcccaggcccctcggta

SEQ ID NO: 95249 - DNA, 31 bp, Homo sapiens
  misc_feature 1..31: note = chr6:170605909-170605940
  misc_feature 1..31: note = hyper
  source 1..31: mol_type = genomic DNA
cgcggcggctcctttccggctgcatccgggg

SEQ ID NO: 95250 - DNA, 45 bp, Homo sapiens
  misc_feature 1..45: note = chr6:170757555-170757600
  misc_feature 1..45: note = hypo
  source 1..45: mol_type = genomic DNA
gggcagatcagcagacgcggaggcctgaagcgcctccatctgaga

SEQ ID NO: 95251 - DNA, 30 bp, Homo sapiens; identical to SEQ ID NO: 40709
  misc_feature 1..30: note = chr6:1708613-1708643
  misc_feature 1..30: note = hypo
  source 1..30: mol_type = genomic DNA

SEQ ID NO: 95252 - DNA, 87 bp, Homo sapiens
  misc_feature 1..87: note = chr6:170921658-170921745
  misc_feature 1..87: note = hyper
  source 1..87: mol_type = genomic DNA
cacaggagcctcacgcgcctcttacctaacaggaagttgggtggaagcagcgcggacccacggcacaccgaacgcactccaacagaa

SEQ ID NO: 95253 - DNA, 73 bp, Homo sapiens
  misc_feature 1..73: note = chr6:17102273-17102346
  misc_feature 1..73: note = hyper
  source 1..73: mol_type = genomic DNA
ggcaaccattcctggcgactgcccagaaactcagtgcgtcctgcccggggtttaagcgcgggaagtgggagag

SEQ ID NO: 95254 - DNA, 30 bp, Homo sapiens
  misc_feature 1..30: note = chr6:17102637-17102667
  misc_feature 1..30: note = hyper
  source 1..30: mol_type = genomic DNA
tcccacgcttgggggcgacaagagttggct

SEQ ID NO: 95255 - DNA, 175 bp, Homo sapiens; identical to SEQ ID NO: 40710
  misc_feature 1..175: note = chr6:1726684-1726859
  misc_feature 1..175: note = hypo
  source 1..175: mol_type = genomic DNA

SEQ ID NO: 95256 - DNA, 144 bp, Homo sapiens
  misc_feature 1..144: note = chr6:17281118-17281262
  misc_feature 1..144: note = hyper
  source 1..144: mol_type = genomic DNA
cggcgcccggcgccccaggtgctgccgcggccaatcgcaggcgtccggcccgcccccctccccagccgggcgtcgacccccggcccgcgggggaagggagcagagaggtggagagctgtcctcggcactcgtcttccagatccc

SEQ ID NO: 95257 - DNA, 119 bp, Homo sapiens
  misc_feature 1..119: note = chr6:17282098-17282217
  misc_feature 1..119: note = hyper
  source 1..119: mol_type = genomic DNA
gctgccccttcgctccggggtgaactgaaactttgctaggggagagggtcggcgccagcctcgcggggttcggagaagacccagcgctgtgcgaggtcgggggccgggcagggcagagc

SEQ ID NO: 95258 - DNA, 19 bp, Homo sapiens
  misc_feature 1..19: note = chr6:17339508-17339527
  misc_feature 1..19: note = hypo
  source 1..19: mol_type = genomic DNA
acttcgtctcaaaaaaaca

SEQ ID NO: 95259 - DNA, 190 bp, Homo sapiens
  misc_feature 1..190: note = chr6:18035825-18036015
  misc_feature 1..190: note = hypo
  source 1..190: mol_type = genomic DNA
gccaccacccacagacgctgtccctgtcctcaccactctccgtggagaacactggtacgttctgtcgtctcttaagagcttttgtagttgactctgaatcctaaggccttagtgaatgtcgagtacataccaggtactcgataaatctcaagtaatatgtgaatgaacaaataaacgtttacttatttca

SEQ ID NO: 95260 - DNA, 405 bp, Homo sapiens
  misc_feature 1..405: note = chr6:18122677-18123082
  misc_feature 1..405: note = hyper
  source 1..405: mol_type = genomic DNA
aggccaggcagaccacgtggccgcaggacaggttgcgcgggcgccgctgctgccggtggccaaacttctcaaagcacaccttgcactcgagcaggctgatctccgcctcgcgcatgagctcatgcagcgctggcccgctctccgaggcttcggccgccatggcgcgtcctgtgcactcccgccgcgccgcctggccgtgccccagcgacgctctcggtcacggtcacagtcatggtcacggggtgggacgtgcgccctgacgtcgagcgccgcgggcctctgcactgcgatctgctgccccttggtgggcacgcgcggcactgtttcctgagggcctgatggtggacgtttgcaagacaaatccacatgcgcgttgtgtagacctgtaatcgtcacagcagtcat

SEQ ID NO: 95261 - DNA, 528 bp, Homo sapiens
  misc_feature 1..528: note = chr6:18277433-18277961
  misc_feature 1..528: note = hyper
  source 1..528: mol_type = genomic DNA
ttcctaaagagggtgcgtttgtggggaaggtgagtgcgcgcgcgcggagggagggccggccgcggagaggggccaaaactcttcggaatcagcagccagagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccg

SEQ ID NO: 95262 - DNA, 64 bp, Homo sapiens; identical to SEQ ID NO: 30327
  misc_feature 1..64: note = chr6:18277979-18278043
  misc_feature 1..64: note = hyper
  source 1..64: mol_type = genomic DNA

SEQ ID NO: 95263 - DNA, 34 bp, Homo sapiens
  misc_feature 1..34: note = chr6:18507305-18507339
  misc_feature 1..34: note = hypo
  source 1..34: mol_type = genomic DNA
aaaggacccagccagcggtaaatgtgccaggttt

SEQ ID NO: 95264 - DNA, 283 bp, Homo sapiens
  misc_feature 1..283: note = chr6:19691714-19691997
  misc_feature 1..283: note = hyper
  source 1..283: mol_type = genomic DNA
tagttgctgaaaagccggggccttggagctttcggatcctgcccgcctttcatcatgtaaacaaacgcatcagatttaaagctttcccataattgttatgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 95265 - DNA, 104 bp, Homo sapiens
  misc_feature 1..104: note = chr6:19692142-19692246
  misc_feature 1..104: note = hyper
  source 1..104: mol_type = genomic DNA
cgtcccgagggctctcccttttcccagagcgcataccaaaggcagactcctttgcaggctccacgagccccattcgcggtggaaaggggcgttccagactgcag

SEQ ID NO: 95266 - DNA, 30 bp, Homo sapiens
  misc_feature 1..30: note = chr6:20057944-20057974
  misc_feature 1..30: note = hypo
  source 1..30: mol_type = genomic DNA
aattaaagaagtgcacggaaaggagaaaag

SEQ ID NO: 95267 - DNA, 30 bp, Homo sapiens
  misc_feature 1..30: note = chr6:20317888-20317918
  misc_feature 1..30: note = hypo
  source 1..30: mol_type = genomic DNA
gctactagaccagcccgggcctgcctgtct

SEQ ID NO: 95268 - DNA, 30 bp, Homo sapiens; identical to SEQ ID NO: 40761
  misc_feature 1..30: note = chr6:20691518-20691548
  misc_feature 1..30: note = hypo
  source 1..30: mol_type = genomic DNA

SEQ ID NO: 95269 - DNA, 95 bp, Homo sapiens
  misc_feature 1..95: note = chr6:20702857-20702952
  misc_feature 1..95: note = hypo
  source 1..95: mol_type = genomic DNA
ctctggacgtcctctcgatatccagccacctgtgttttcttcgccgatgtgttcctcatgatgtccagccacttgtgtgttggcctgctagggtc

SEQ ID NO: 95270 - DNA, 173 bp, Homo sapiens
  misc_feature 1..173: note = chr6:21587469-21587642
  misc_feature 1..173: note = hyper
  source 1..173: mol_type = genomic DNA
tggaagaaaggagatcggttgcctggcgagggggcccgtgcgtcctacagtcgctacccgccacgcacgcgtccctctcctcctgacccgcgtcacttagcagccaatgcggtctccgtgccttcccacttccccgcaatcaagcgcctttcttcctccgcctcccctctttc

SEQ ID NO: 95271 - DNA, 268 bp, Homo sapiens
  misc_feature 1..268: note = chr6:21664923-21665191
  misc_feature 1..268: note = hyper
  source 1..268: mol_type = genomic DNA
gggcatctctggtcccgggatgcgattgtcccggtttctccttctggcccactcgccgcgcgcacgaactctaggggaagttggttgtaaagtttccgagagcggcgtgggctggtgcgagtgaagcgcggggcgggggaggcgaggacagaagctctcctcgcggcgtctttgttctgctctggaggagagaccttggcaaggagtcgccgggcgggtgcagggacctaccgccaccacattccggacccagcgggagccctcctct

SEQ ID NO: 95272 - DNA, 567 bp, Homo sapiens
  misc_feature 1..567: note = chr6:21665622-21666189
  misc_feature 1..567: note = hyper
  source 1..567: mol_type = genomic DNA
gacctggggaagggtcgggagctgttcctggtccgagacacctgatttgtcccggacaaggcagtgggggaggggaaggaaagaggggatgctcggctgggacgtgtcgcggcagggggtggaggatgaggaggcggcctgggaccccgagtcagatctttggggtgagcacgaggacgtggtgtagggaagaggacgagtgagcagcgcctggctgtagggtcagagggcgcctggtcatcctgagagccttgccttcgcagtttgagattaggggaagttcggggcctgagaaggtgggcgcgatgctggagctgggaattcttcctcggagcccctggaccgagttgcgctgcgcctgcagcaacaggtagccccgagggatgggcggaggccccggccgaacccggagctggcctttgtcctgccaattagagggctctccagagggacagcgtgggtgggggtaggtggggaagggcgggagaggagtttcctaacacttggagcccctttgagttgttctgtgtattgggtggaggagggtgaatccgagaggagggagga

SEQ ID NO: 95273 - DNA, 131 bp, Homo sapiens
  misc_feature 1..131: note = chr6:21666457-21666588
  misc_feature 1..131: note = hyper
  source 1..131: mol_type = genomic DNA
agggctggcatctcccggggaaagtttcgagcctggcagtgggaggagaccgtctgggcagagttgtgatgaactggggaccgagcagccccagctcgcctcggaggttcccgagccgggcgggagatgcg

SEQ ID NO: 95274 - DNA, 23 bp, Homo sapiens
  misc_feature 1..23: note = chr6:21687659-21687682
  misc_feature 1..23: note = hypo
  source 1..23: mol_type = genomic DNA
tgagactccgcctcaaaacaaaa

SEQ ID NO: 95275 - DNA, 30 bp, Homo sapiens
  misc_feature 1..30: note = chr6:21782706-21782736
  misc_feature 1..30: note = hypo
  source 1..30: mol_type = genomic DNA
aggcgtgagccacggcgcccggcccaaatg

SEQ ID NO: 95276 - DNA, 176 bp, Homo sapiens
  misc_feature 1..176: note = chr6:22149842-22150018
  misc_feature 1..176: note = hypo
  source 1..176: mol_type = genomic DNA
gacattgtctgagcccgtttaatttacatcttcgatttagtcaagaagcggaacctgccagatcagaatagtgtattctgtgcacccaacagggtggaagacattattttgtttgtgttagttcaaacagctggtcattaatgcagtccccatttctagagcgaagtgctgctgga

SEQ ID NO: 95277 - DNA, 155 bp, Homo sapiens
  misc_feature 1..155: note = chr6:2244329-2244484
  misc_feature 1..155: note = hypo
  source 1..155: mol_type = genomic DNA
ctcacctcgagcaatccttccacctctgcacaccgaagtgctgagatttcaagtatgagccgctgcctcctgcccacttagccctttctaacactagagaactttgagagtggtttcaataccaactggacacttcccagcggtttaacctcagg

SEQ ID NO: 95278 - DNA, 21 bp, Homo sapiens
  misc_feature 1..21: note = chr6:2247175-2247196
  misc_feature 1..21: note = hypo
  source 1..21: mol_type = genomic DNA
actgagcaagccgggcgcagt

SEQ ID NO: 95279 - DNA, 30 bp, Homo sapiens
  misc_feature 1..30: note = chr6:2376070-2376100
  misc_feature 1..30: note = hypo
  source 1..30: mol_type = genomic DNA
attcgaatatttggccgccaccactatagc

SEQ ID NO: 95280 - DNA, 180 bp, Homo sapiens
  misc_feature 1..180: note = chr6:24126308-24126488
  misc_feature 1..180: note = hyper
  source 1..180: mol_type = genomic DNA
gcgcgccagacagctcggccccgcccactcgccgctctcggaaagctggaaccctgcccctttggagggggaggcggcggcggcggcggcggctgcgcgggcctcgggtgcgcgggcacgcgggactcccagctgtcaatcaggcgcgggctgagctctacgaggcggagcggcggcggt

SEQ ID NO: 95281 - DNA, 30 bp, Homo sapiens
  misc_feature 1..30: note = chr6:24438527-24438557
  misc_feature 1..30: note = hypo
  source 1..30: mol_type = genomic DNA
tagttgttggaatttcgctgtaaactttat

SEQ ID NO: 95282 - DNA, 30 bp, Homo sapiens; identical to SEQ ID NO: 40764
  misc_feature 1..30: note = chr6:24465059-24465089
  misc_feature 1..30: note = hypo
  source 1..30: mol_type = genomic DNA

SEQ ID NO: 95283 - DNA, 223 bp, Homo sapiens
  misc_feature 1..223: note = chr6:24494649-24494872
  misc_feature 1..223: note = hyper
  source 1..223: mol_type = genomic DNA
agccaggcagcagaacgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcag

SEQ ID NO: 95284 - DNA, 30 bp, Homo sapiens
  misc_feature 1..30: note = chr6:2450689-2450719
  misc_feature 1..30: note = hypo
  source 1..30: mol_type = genomic DNA
ttttctgaaaggtgccgcatagacttcttc

SEQ ID NO: 95285 - DNA, 30 bp, Homo sapiens
  misc_feature 1..30: note = chr6:24546740-24546770
  misc_feature 1..30: note = hypo
  source 1..30: mol_type = genomic DNA
tcagtccttagaatacgattcttccttagc

SEQ ID NO: 95286 - DNA, 30 bp, Homo sapiens
  misc_feature 1..30: note = chr6:24602615-24602645
  misc_feature 1..30: note = hypo
  source 1..30: mol_type = genomic DNA
ggccacatgccaggccggaagtggatggca

SEQ ID NO: 95287 - DNA, 29 bp, Homo sapiens
  misc_feature 1..29: note = chr6:24647342-24647371
  misc_feature 1..29: note = hypo
  source 1..29: mol_type = genomic DNA
aaaaccagctgggtgcggtggctcacgcc

SEQ ID NO: 95288 - DNA, 110 bp, Homo sapiens
  misc_feature 1..110: note = chr6:24761445-24761555
  misc_feature 1..110: note = hypo
  source 1..110: mol_type = genomic DNA
agctctccaaaaccccgctaggagatcagagctggcaccaggagcagaaaggccgggcagcgagagcagacacccccgagcctgcagggatggggcggggccaagggggg

SEQ ID NO: 95289 - DNA, 30 bp, Homo sapiens
  misc_feature 1..30: note = chr6:2510157-2510187
  misc_feature 1..30: note = hypo
  source 1..30: mol_type = genomic DNA
ccacctgcgctctgtcgttcgccgcctgag

SEQ ID NO: 95290 - DNA, 150 bp, Homo sapiens
  misc_feature 1..150: note = chr6:25218431-25218581
  misc_feature 1..150: note = hypo
  source 1..150: mol_type = genomic DNA
ggaacatgcagggggcggcctgagaatccagaacatgtcctgctccccaccacccccaccccactccctcccagggaggtagcggacgctggagcttcttaggccagaagtccaggggcaggggcatggtgggggcgcctttctcacccc

SEQ ID NO: 95291 - DNA, 19 bp, Homo sapiens
  misc_feature 1..19: note = chr6:25311446-25311465
  misc_feature 1..19: note = hypo
  source 1..19: mol_type = genomic DNA
tgaacgcataagtaccttt

SEQ ID NO: 95292 - DNA, 126 bp, Homo sapiens
  misc_feature 1..126: note = chr6:25652379-25652505
  misc_feature 1..126: note = hyper
  source 1..126: mol_type = genomic DNA
gcgcgcagggcggggcggggacaggcgcgccaggagcggggcgggcttccagccgctggttttgctgagggctgagggacggctcagcgacgccacggccagcagcgctcgcgtcctccccagcaa

SEQ ID NO: 95293 - DNA, 103 bp, Homo sapiens
  misc_feature 1..103: note = chr6:25668982-25669085
  misc_feature 1..103: note = hypo
  source 1..103: mol_type = genomic DNA
gctttcccatcatgtcgggtctcttagaagtcctttcactttcttgcgatctatgctatgtaattaaaagttattggccgggcgcagtggctcacgcctgtaa

SEQ ID NO: 95294 - DNA, 30 bp, Homo sapiens; identical to SEQ ID NO: 40768
  misc_feature 1..30: note = chr6:25710967-25710997
  misc_feature 1..30: note = hypo
  source 1..30: mol_type = genomic DNA

SEQ ID NO: 95295 - DNA, 116 bp, Homo sapiens
  misc_feature 1..116: note = chr6:25727275-25727391
  misc_feature 1..116: note = hypo
  source 1..116: mol_type = genomic DNA
taaagcaggtccatccggacactggcatctcttcgaaagctatgagcattatgaattccttcgtcactgatatctttgagcgtatagcgagcgaggcatcacgtttggctcactac

SEQ ID NO: 95296 - DNA, 146 bp, Homo sapiens
  misc_feature 1..146: note = chr6:25727916-25728062
  misc_feature 1..146: note = hypo
  source 1..146: mol_type = genomic DNA
aaatcagctgtgggccgagggtagacgaactagttgcagcaagacaatccttgctaggcaccgtgactcgcctgtaatcccagcacttgcagaggtcgaggctggcggttcatgaggttaagagacggagaccatcttggccaaca

SEQ ID NO: 95297 - DNA, 30 bp, Homo sapiens
  misc_feature 1..30: note = chr6:26018763-26018793
  misc_feature 1..30: note = hypo
  source 1..30: mol_type = genomic DNA
agcacacgcaatcagcgcaccatgacatgg

SEQ ID NO: 95298 - DNA, 384 bp, Homo sapiens
  misc_feature 1..384: note = chr6:26020891-26021275
  misc_feature 1..384: note = hyper
  source 1..384: mol_type = genomic DNA
actgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaac

SEQ ID NO: 95299 - DNA, 472 bp, Homo sapiens
  misc_feature 1..472: note = chr6:26021706-26022178
  misc_feature 1..472: note = hyper
  source 1..472: mol_type = genomic DNA
ccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgct

SEQ ID NO: 95300 - DNA, 30 bp, Homo sapiens
  misc_feature 1..30: note = chr6:26028765-26028795
  misc_feature 1..30: note = hypo
  source 1..30: mol_type = genomic DNA
tcaactctccatacacgcttctcactgttg

SEQ ID NO: 95301 - DNA, 464 bp, Homo sapiens
  misc_feature 1..464: note = chr6:26033744-26034208
  misc_feature 1..464: note = hyper
  source 1..464: mol_type = genomic DNA
gagtcttagccttggcgcgagctttaccgccttgtttgccgcgaccagacataactacttctgataagggaaaatcgccacaagaaaatgtaatgaaactacattagaacgcaaggcagagaagtatttatactgactggaggtaggctgtgaggaattctcccattggctaatgtcaaatacccaatgggaaatcagaatctgcatccttcatttgcatgtaatccttccgtctggtgtaaggtttatgtttgacccaatccccagtctggcttgacgagccttcgacttgaatactaataataattggccgaattaggattttgtcaaaataccttttttaagcatgagtggaggttttgttctggttattttgactttcagccgctcgtgcttttcccggattgtgactcatgtttttggaaaggagtggactccgaccaatttctaaatagatatttaag

SEQ ID NO: 95302 - DNA, 30 bp, Homo sapiens
  misc_feature 1..30: note = chr6:26034546-26034576
  misc_feature 1..30: note = hyper
  source 1..30: mol_type = genomic DNA
gggagggaagaaaagcgaataccccaaatc

SEQ ID NO: 95303 - DNA, 41 bp, Homo sapiens
  misc_feature 1..41: note = chr6:26047700-26047741
  misc_feature 1..41: note = hypo
  source 1..41: mol_type = genomic DNA
gcccggcctccttgaagccattcttacgtcagattggctgg

SEQ ID NO: 95304 - DNA, 27 bp, Homo sapiens
  misc_feature 1..27: note = chr6:26053446-26053473
  misc_feature 1..27: note = hypo
  source 1..27: mol_type = genomic DNA
cgtgagccaccgcgcccagcctttttt

SEQ ID NO: 95305 - DNA, 43 bp, Homo sapiens
  misc_feature 1..43: note = chr6:26067205-26067248
  misc_feature 1..43: note = hypo
  source 1..43: mol_type = genomic DNA
tggcctctgaagagtcgctgaaaaccaccgacaagaggaagat

SEQ ID NO: 95306 - DNA, 161 bp, Homo sapiens
  misc_feature 1..161: note = chr6:26087615-26087776
  misc_feature 1..161: note = hyper
  source 1..161: mol_type = genomic DNA
gccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggc

SEQ ID NO: 95307 - DNA, 208 bp, Homo sapiens
  misc_feature 1..208: note = chr6:26087777-26087985
  misc_feature 1..208: note = hyper
  source 1..208: mol_type = genomic DNA
cggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtg

SEQ ID NO: 95308 - DNA, 88 bp, Homo sapiens; identical to SEQ ID NO: 30339
  misc_feature 1..88: note = chr6:26088186-26088274
  misc_feature 1..88: note = hyper
  source 1..88: mol_type = genomic DNA

SEQ ID NO: 95309 - DNA, 152 bp, Homo sapiens; identical to SEQ ID NO: 30340
  misc_feature 1..152: note = chr6:26172018-26172170
  misc_feature 1..152: note = hyper
  source 1..152: mol_type = genomic DNA

SEQ ID NO: 95310 - DNA, 103 bp, Homo sapiens
  misc_feature 1..103: note = chr6:26172268-26172371
  misc_feature 1..103: note = hyper
  source 1..103: mol_type = genomic DNA
cgtcggcccggcgcgcgcgtccgggaggttgcccgtaggccgctaactggtggttcccagtccccgccgactcggcctctttcttctgcggccaccagatcgc

SEQ ID NO: 95311 - DNA, 95 bp, Homo sapiens
  misc_feature 1..95: note = chr6:26184021-26184116
  misc_feature 1..95: note = hyper
  source 1..95: mol_type = genomic DNA
gcatgcctgagccagcgaaatccgctcccgccccgaagaagggctccaagaaggccgtgaccaaggcgcagaagaaggacggcaagaagcgcaag

SEQ ID NO: 95312 - DNA, 35 bp, Homo sapiens
  misc_feature 1..35: note = chr6:26184356-26184391
  misc_feature 1..35: note = hyper
  source 1..35: mol_type = genomic DNA
gtgtcagagggcaccaaggccgttaccaagtacac

SEQ ID NO: 95313 - DNA, 481 bp, Homo sapiens
  misc_feature 1..481: note = chr6:26188753-26189234
  misc_feature 1..481: note = hyper
  source 1..481: mol_type = genomic DNA
cgccattgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcac

SEQ ID NO: 95314 - DNA, 209 bp, Homo sapiens
  misc_feature 1..209: note = chr6:26189235-26189444
  misc_feature 1..209: note = hyper
  source 1..209: mol_type = genomic DNA
caataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaaacctcatgagaaggggcgggaaccacagtcagttcccgcccttctgtgcaa

SEQ ID NO: 95315 - DNA, 248 bp, Homo sapiens
  misc_feature 1..248: note = chr6:26197272-26197520
  misc_feature 1..248: note = hyper
  source 1..248: mol_type = genomic DNA
tggaatggcagtttgcgaatcagcagctcggtcgacttctggtagcggcggatctcgcgcagagccaccgtgccgggccggtaacggtggggcttcttcacgccgccggtggctggagcgctctttcgagcagccttggtggccagctgcttgcgtggcgctttcccacccgtggacttgcgagcagtctgcttggtacgagccattgcgaacttctaaaccctgctaaatgacgaaaaaacgaaagt

SEQ ID NO: 95316 - DNA, 25 bp, Homo sapiens
  misc_feature 1..25: note = chr6:26198574-26198599
  misc_feature 1..25: note = hyper
  source 1..25: mol_type = genomic DNA
gttttgagacagtctcgctctgtcg

SEQ ID NO: 95317 - DNA, 85 bp, Homo sapiens; identical to SEQ ID NO: 30346
  misc_feature 1..85: note = chr6:26198839-26198924
  misc_feature 1..85: note = hyper
  source 1..85: mol_type = genomic DNA

SEQ ID NO: 95318 - DNA, 696 bp, Homo sapiens
  misc_feature 1..696: note = chr6:26199182-26199878
  misc_feature 1..696: note = hyper
  source 1..696: mol_type = genomic DNA
acttgtttagctcctcgtcgttgcggatggccagctgcaggtgtcgggggatgatgcgggtcttcttgttgtcgcgggcggcgttgcccgccagctccaggatctcggcggtcaggtactccaacaccgccgccagatacactggcgcgccggccccgactcgctcggagtagttgcccttgcggagcaagcggtgtacgcggcccacagggaactggagtccggcccgcgaagagcgggtcttagccttagctcgggcctttccgccttgcttgccgcgtccggacattttgaattcttaaaaacgatgttaagcaatgaagacaaaaatgtaaaagtgaattttgttagcaagtgagaaactattatacttggaggtcgaattgtaaataacgctatttgattggctagaacaaccaaccaattgcaaagaaacgctagaatcacctaatttgcataccacagggcacacagagacaattcatccaatcaatgtgtaagcttttaaatgccagtttacgataggagctctacaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaa

SEQ ID NO: 95319 - DNA, 36 bp, Homo sapiens
  misc_feature 1..36: note = chr6:26200118-26200154
  misc_feature 1..36: note = hyper
  source 1..36: mol_type = genomic DNA
cgtgtcagagggcaccaaggccgtcaccaagtacac

SEQ ID NO: 95320 - DNA, 613 bp, Homo sapiens; identical to SEQ ID NO: 30350
  misc_feature 1..613: note = chr6:26204685-26205298
  misc_feature 1..613: note = hyper
  source 1..613: mol_type = genomic DNA

SEQ ID NO: 95321 - DNA, 210 bp, Homo sapiens; identical to SEQ ID NO: 30351
  misc_feature 1..210: note = chr6:26205502-26205712
  misc_feature 1..210: note = hyper
  source 1..210: mol_type = genomic DNA

SEQ ID NO: 95322 - DNA, 36 bp, Homo sapiens; identical to SEQ ID NO: 40772
  misc_feature 1..36: note = chr6:26214612-26214648
  misc_feature 1..36: note = hypo
  source 1..36: mol_type = genomic DNA

SEQ ID NO: 95323 - DNA, 223 bp, Homo sapiens
  misc_feature 1..223: note = chr6:26216047-26216270
  misc_feature 1..223: note = hyper
  source 1..223: mol_type = genomic DNA
gaaagcctcatgcatcgacctcccaaagtgctaggattacaggatcttgccaacacagaacaggagtatctcctgatcaattttttttgagacgaagcctcgcctttgtcgcccaggctagaatgcaaaagcgccatgtcttttcactgcaacctttgcttgctgggtttaagtgattctcctgcggcagcctcccgagtctctgggatgacacgcgactgcc

SEQ ID NO: 95324 - DNA, 300 bp, Homo sapiens
  misc_feature 1..300: note = chr6:26216390-26216690
  misc_feature 1..300: note = hyper
  source 1..300: mol_type = genomic DNA
attccctagaaaacggtgaaattcaatattaaagctctttatgtgagacttgagtggctctgaaaagagcctttgagttttaaagcacctaagcacacatttacttggagcttgtatacttggtgacagccttggtaccttcggacactgcgtgcttggccagctctccgggaagcagcagacgcacggcggtctggatctccctggaggtaatggtcgagcgcttgttgtagtgggccagacgggaagcctcgcctgcgatgcgttcgaagatgtcgttaacgaaggaattcatgatgc

SEQ ID NO: 95325 - DNA, 43 bp, Homo sapiens
  misc_feature 1..43: note = chr6:26216810-26216853
  misc_feature 1..43: note = hyper
  source 1..43: mol_type = genomic DNA
tggtcacagccttcttggaacccttcttcggagcaggagctga

SEQ ID NO: 95326 - DNA, 80 bp, Homo sapiens
  misc_feature 1..80: note = chr6:26217076-26217156
  misc_feature 1..80: note = hyper
  source 1..80: mol_type = genomic DNA
taaccaatcaaattgcgcctttcacaattctaccgatgactataactagcttcttattcctccatcgagcccattctttt

SEQ ID NO: 95327 - DNA, 213 bp, Homo sapiens
  misc_feature 1..213: note = chr6:26217365-26217578
  misc_feature 1..213: note = hyper
  source 1..213: mol_type = genomic DNA
tgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccata

SEQ ID NO: 95328 - DNA, 39 bp, Homo sapiens
  misc_feature 1..39: note = chr6:26226763-26226802
  misc_feature 1..39: note = hypo
  source 1..39: mol_type = genomic DNA
catgagccacctcgcccggccttccggctgatatcttaa

SEQ ID NO: 95329 - DNA, 1358 bp, Homo sapiens
  misc_feature 1..1358: note = chr6:26233978-26235336
  misc_feature 1..1358: note = hyper
  source 1..1358: mol_type = genomic DNA
gttggccattctcaacgaccagctgcacaagatcgtgggccggaagcaccttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttcaaaggggaacgtcccgccagtttcactttttcttcggagctgccttctttgcctttgtaaccttcggcttccccgacttaggcttggccgccttgggcttaggggctttggccttagctggactcttggcagctttttttggctgaggtgttttcacctttttcgcactcttggccactttcttggtcccagcagcggttgctggcttctttaccttcttaggagtctttttgatgcttttcttcggggtagcggcgccagccaccttcttgggcttcttggctgccccagcaggcttcctaggcttggctgcgccagcctttttggccttgggtttgccttccccggaagccgctttcttgttgagtttgaaggagccagaagcaccggtacctttggtctgcaccagagtacctttgctcaccaagctcttgaggccaagcttgatacggctgttgtttttttctacatcgtagccagcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatggtaggagcaagtggagcagtctccgacatgtttttgtcttcccagaaaagacaataagtaatctcaaactgtcagaacagcatgtcctctacgagggaggctgagggtttatatagagagacgctgagtgatgattggttccttgctccatgcgcggcgctgctggaaaaggactcctcgtatctaccgcgctgctgtgtttgt

SEQ ID NO: 95330 - DNA, 636 bp, Homo sapiens
  misc_feature 1..636: note = chr6:26240633-26241269
  misc_feature 1..636: note = hyper
  source 1..636: mol_type = genomic DNA
gttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 95331 - DNA, 41 bp, Homo sapiens; identical to SEQ ID NO: 30359
  misc_feature 1..41: note = chr6:26249960-26250001
  misc_feature 1..41: note = hyper
  source 1..41: mol_type = genomic DNA

SEQ ID NO: 95332 - DNA, 504 bp, Homo sapiens; identical to SEQ ID NO: 30360
  misc_feature 1..504: note = chr6:26250181-26250685
  misc_feature 1..504: note = hyper
  source 1..504: mol_type = genomic DNA

SEQ ID NO: 95333 - DNA, 496 bp, Homo sapiens; identical to SEQ ID NO: 30361
  misc_feature 1..496: note = chr6:26250686-26251182
  misc_feature 1..496: note = hyper
  source 1..496: mol_type = genomic DNA

SEQ ID NO: 95334 - DNA, 400 bp, Homo sapiens; identical to SEQ ID NO: 30362
  misc_feature 1..400: note = chr6:26251540-26251940
  misc_feature 1..400: note = hyper
  source 1..400: mol_type = genomic DNA

SEQ ID NO: 95335 - DNA, 39 bp, Homo sapiens; identical to SEQ ID NO: 30363
  misc_feature 1..39: note = chr6:26252060-26252099
  misc_feature 1..39: note = hyper
  source 1..39: mol_type = genomic DNA

SEQ ID NO: 95336 - DNA, 40 bp, Homo sapiens; identical to SEQ ID NO: 30364
  misc_feature 1..40: note = chr6:26252140-26252180
  misc_feature 1..40: note = hyper
  source 1..40: mol_type = genomic DNA

SEQ ID NO: 95337 - DNA, 39 bp, Homo sapiens; identical to SEQ ID NO: 30365
  misc_feature 1..39: note = chr6:26252240-26252279
  misc_feature 1..39: note = hyper
  source 1..39: mol_type = genomic DNA

SEQ ID NO: 95338 - DNA, 470 bp, Homo sapiens
  misc_feature 1..470: note = chr6:26271346-26271816
  misc_feature 1..470: note = hyper
  source 1..470: mol_type = genomic DNA
gcggaactctgaaagcgcagatctgtcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctc

SEQ ID NO: 95339 - DNA, 288 bp, Homo sapiens
  misc_feature 1..288: note = chr6:26271817-26272105
  misc_feature 1..288: note = hyper
  source 1..288: mol_type = genomic DNA
gttagtctgcgatccaagaacgttaacttcttaaagttctaattctgcgcttctcaagctgtagtccgtaaacgactactttaagacttggaagacgctaattctcattcagtagatgtgttgtggggccagattcggaggaccacgttttgagaagtttatcttgtgccgttttcttgagtcacctggactgctgctagctggaaacctttgaccattataaggcaggattcctgggtgatgtacctgggaaatcacgagccaagaagtcaccgacatacaacagtg

SEQ ID NO: 95340 - DNA, 422 bp, Homo sapiens; identical to SEQ ID NO: 30369
  misc_feature 1..422: note = chr6:26272431-26272853
  misc_feature 1..422: note = hyper
  source 1..422: mol_type = genomic DNA

SEQ ID NO: 95341 - DNA, 205 bp, Homo sapiens
  misc_feature 1..205: note = chr6:26273080-26273285
  misc_feature 1..205: note = hyper
  source 1..205: mol_type = genomic DNA
gaaccaatgagaaaccgaaactcagccagcctcatttgcatatacacgaggtaaataatgagggcgtttgggctcaccagcattttcctgtggtcatttgacggtatcacttcggctgcgaacatgcctgaaccagctaagtcagctcccgccccgaagaagggctccaagaaggcggtgaccaaggcacagaagaaggatggca

SEQ ID NO: 95342 - DNA, 74 bp, Homo sapiens
  misc_feature 1..74: note = chr6:26273345-26273419
  misc_feature 1..74: note = hyper
  source 1..74: mol_type = genomic DNA
aggtccaccccgacaccggcatctcgtccaaggctatggggattatgaactccttcgtcaacgacattttcgag

SEQ ID NO: 95343 - DNA, 251 bp, Homo sapiens
  misc_feature 1..251: note = chr6:26273514-26273765
  misc_feature 1..251: note = hyper
  source 1..251: mol_type = genomic DNA
cggggagctggccaaacacgcggtgtcggagggcaccaaggcggtcaccaagtacaccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccgggcgcagtggctcacgc

SEQ ID NO: 95344 - DNA, 89 bp, Homo sapiens
  misc_feature 1..89: note = chr6:26283423-26283512
  misc_feature 1..89: note = hypo
  source 1..89: mol_type = genomic DNA
cctcctccctccacacgtctttagcctgtttcagtgatagcacttagcaccatctgatagtttcacttactttgcgtgtgaaagcacac

SEQ ID NO: 95345 - DNA, 49 bp, Homo sapiens
  misc_feature 1..49: note = chr6:26284880-26284929
  misc_feature 1..49: note = hyper
  source 1..49: mol_type = genomic DNA
ctgcgatcctactcacgcagatgtgttgcgctcacggattcgccttggt

SEQ ID NO: 95346 - DNA, 30 bp, Homo sapiens
  misc_feature 1..30: note = chr6:26313515-26313545
  misc_feature 1..30: note = hyper
  source 1..30: mol_type = genomic DNA
taaatgatttgttgtcgtttgccaaattat

SEQ ID NO: 95347 - DNA, 120 bp, Homo sapiens; identical to SEQ ID NO: 30372
  misc_feature 1..120: note = chr6:26322568-26322688
  misc_feature 1..120: note = hyper
  source 1..120: mol_type = genomic DNA

SEQ ID NO: 95348 - DNA, 157 bp, Homo sapiens; identical to SEQ ID NO: 537
  misc_feature 1..157: note = chr6:26327825-26327982
  misc_feature 1..157: note = hyper
  source 1..157: mol_type = genomic DNA

SEQ ID NO: 95349 - DNA, 122 bp, Homo sapiens
  misc_feature 1..122: note = chr6:26328294-26328416
  misc_feature 1..122: note = hyper
  source 1..122: mol_type = genomic DNA
tcatgtataggaggacgcggtaatcccaaaacgtttttttctataggtataacgcctgtcttcgttcgtcagagggccagtggcgcaatggataacgcgtctgactacggatcagaagattc

SEQ ID NO: 95350 - DNA, 108 bp, Homo sapiens; identical to SEQ ID NO: 30375
  misc_feature 1..108: note = chr6:26331703-26331811
  misc_feature 1..108: note = hyper
  source 1..108: mol_type = genomic DNA

SEQ ID NO: 95351 - DNA, 149 bp, Homo sapiens
  misc_feature 1..149: note = chr6:26332134-26332283
  misc_feature 1..149: note = hyper
  source 1..149: mol_type = genomic DNA
ggtgagttttaaattcgtttccaaagttcactgcaggtcacaaccagtgtttccgttaacgaattcacgcgggggctggcaggttgtttgtgctgcatcttttctgagagataacggcgcctccctgtagcctccgttctcagctgatg

SEQ ID NO: 95352 - DNA, 119 bp, Homo sapiens
  misc_feature 1..119: note = chr6:26501722-26501841
  misc_feature 1..119: note = hyper
  source 1..119: mol_type = genomic DNA
gagcgcggggcactgcgctttggcgggaatctggtcggtgtctgtccgtagttcccatctccacatcccgtctgatcccgctcgtttttcggcagctccctttgacgtgattggacccc

SEQ ID NO: 95353 - DNA, 260 bp, Homo sapiens
  misc_feature 1..260: note = chr6:26501949-26502209
  misc_feature 1..260: note = hyper
  source 1..260: mol_type = genomic DNA
cgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgt

SEQ ID NO: 95354 - DNA, 77 bp, Homo sapiens
  misc_feature 1..77: note = chr6:26534344-26534421
  misc_feature 1..77: note = hypo
  source 1..77: mol_type = genomic DNA
ctttgcctatgtatgcgatggggggaacagtaaaaggtcacgccgactagagttttcatttttataaaaagatgcaa

SEQ ID NO: 95355 - DNA, 292 bp, Homo sapiens; identical to SEQ ID NO: 30378
  misc_feature 1..292: note = chr6:26550767-26551059
  misc_feature 1..292: note = hyper
  source 1..292: mol_type = genomic DNA

SEQ ID NO: 95356 - DNA, 46 bp, Homo sapiens; identical to SEQ ID NO: 30379
  misc_feature 1..46: note = chr6:26551083-26551129
  misc_feature 1..46: note = hyper
  source 1..46: mol_type = genomic DNA

SEQ ID NO: 95357 - DNA, 91 bp, Homo sapiens
  misc_feature 1..91: note = chr6:26555188-26555279
  misc_feature 1..91: note = hyper
  source 1..91: mol_type = genomic DNA
aaacttactgggcctcgcctccagagacttttactcagatttgagaaggaacccagatttctgcgttttaaacaaacgccacagctgtttc

SEQ ID NO: 95358 - DNA, 344 bp, Homo sapiens
  misc_feature 1..344: note = chr6:26577131-26577475
  misc_feature 1..344: note = hyper
  source 1..344: mol_type = genomic DNA
tacacagaatacttccggtgtatgagaatactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacctaccaagctaataattccagacaatacggtctttacaaaaa

SEQ ID NO: 95359 - DNA, 168 bp, Homo sapiens
  misc_feature 1..168: note = chr6:26577722-26577890
  misc_feature 1..168: note = hyper
  source 1..168: mol_type = genomic DNA
tggctcttggtttctcgatgccattcttatttccggctactgatcgtcaaatgcagtttttattcccacttcccctctccatccccgacccgagctgacgttcgaccagcaaaccacagccaacgcccgcaacacagttcagttaagaaggcgcgtgggaggtgtggg

SEQ ID NO: 95360 - DNA, 81 bp, Homo sapiens
  misc_feature 1..81: note = chr6:2684354-2684435
  misc_feature 1..81: note = hypo
  source 1..81: mol_type = genomic DNA
ctgcactactcttgtgtcttggggccattatgaagtcaaatgatagttccgtgaacacaagcatggcgatgcctccacagt

SEQ ID NO: 95361 - DNA, 41 bp, Homo sapiens
  misc_feature 1..41: note = chr6:26988028-26988069
  misc_feature 1..41: note = hyper
  source 1..41: mol_type = genomic DNA
gcgcgcccgaggaaccggtgctgtgacgaccagagcaaaca

SEQ ID NO: 95362 - DNA, 213 bp, Homo sapiens; identical to SEQ ID NO: 30382
  misc_feature 1..213: note = chr6:27059686-27059899
  misc_feature 1..213: note = hyper
  source 1..213: mol_type = genomic DNA

SEQ ID NO: 95363 - DNA, 141 bp, Homo sapiens; identical to SEQ ID NO: 30383
  misc_feature 1..141: note = chr6:27064628-27064769
  misc_feature 1..141: note = hyper
  source 1..141: mol_type = genomic DNA

SEQ ID NO: 95364 - DNA, 233 bp, Homo sapiens; identical to SEQ ID NO: 2787
  misc_feature 1..233: note = chr6:27064770-27065003
  misc_feature 1..233: note = hyper
  source 1..233: mol_type = genomic DNA

SEQ ID NO: 95365 - DNA, 312 bp, Homo sapiens
  misc_feature 1..312: note = chr6:27065004-27065316
  misc_feature 1..312: note = hyper
  source 1..312: mol_type = genomic DNA
tttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaaaggagctcttgtaattttgtatcatcagtataacgatggtgttgctgg

SEQ ID NO: 95366 - DNA, 138 bp, Homo sapiens
  misc_feature 1..138: note = chr6:27094912-27095050
  misc_feature 1..138: note = hyper
  source 1..138: mol_type = genomic DNA
ctacattagcctatccgttattgccataagatggcgacagcccttctcaactcataaaactaaacaaagttttagctacattatcccatccattatcgccacaagatggcgatagcgcttctcaactcgcctgcggga

SEQ ID NO: 95367 - DNA, 104 bp, Homo sapiens
  misc_feature 1..104: note = chr6:27095107-27095211
  misc_feature 1..104: note = hyper
  source 1..104: mol_type = genomic DNA
cgcagcgcttcctgacgttccgttagttcagtctcctgaacttctctgcatgtagattcctctcagggtagccctttgttgaccaaaaacgaaatatgttcact

SEQ ID NO: 95368 - DNA, 68 bp, Homo sapiens
  misc_feature 1..68: note = chr6:2709559-2709627
  misc_feature 1..68: note = hypo
  source 1..68: mol_type = genomic DNA
attagcttgccttcccgttgtttcagtttctgtcagtggtgccatgagacttgcgtcttacttgtgga

SEQ ID NO: 95369 - DNA, 110 bp, Homo sapiens
  misc_feature 1..110: note = chr6:27099764-27099874
  misc_feature 1..110: note = hyper
  source 1..110: mol_type = genomic DNA
gatgcagaggaagggcgggcgttgcccgggcaaattcaaactgacaaccgctgcaacttggcactgttccaaatcactaaccgacgggggaccgacgagtattttaattg

SEQ ID NO: 95370 - DNA, 98 bp, Homo sapiens
  misc_feature 1..98: note = chr6:27100291-27100389
  misc_feature 1..98: note = hyper
  source 1..98: mol_type = genomic DNA
gggaagcctcacctgcgatgcgctcgaaaatgtcgttcacaaacgaattcatgatgcccatggccttggacgaaatgccggtgtcagggtggacctgc

SEQ ID NO: 95371 - DNA, 600 bp, Homo sapiens
  misc_feature 1..600: note = chr6:27100449-27101049
  misc_feature 1..600: note = hyper
  source 1..600: mol_type = genomic DNA
ccgtctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactgg

SEQ ID NO: 95372 - DNA, 97 bp, Homo sapiens
  misc_feature 1..97: note = chr6:27101109-27101206
  misc_feature 1..97: note = hyper
  source 1..97: mol_type = genomic DNA
ccatccgcaacgacgaggagctcaacaagctgctgggcaaagtcaccatcgcacagggcggtgtcctgcccaacattcaggccgtgctactgcccaa

SEQ ID NO: 95373 - DNA, 24 bp, Homo sapiens
  misc_feature 1..24: note = chr6:27102706-27102730
  misc_feature 1..24: note = hypo
  source 1..24: mol_type = genomic DNA
ttaagaagacgttaactcattttt

SEQ ID NO: 95374 - DNA, 181 bp, Homo sapiens
  misc_feature 1..181: note = chr6:27173366-27173547
  misc_feature 1..181: note = hyper
  source 1..181: mol_type = genomic DNA
ttcttgttacctgcccgaggtccttgtcagttcttaaggacaggtgctttgcattatcctccagcactctcccacccactgcaacattcccctctcaccatgcaggtggtaagtaaattttggttgaaaatatttatccagcaagagatgaattgcccggctaatgtcactgccggacgcc

SEQ ID NO: 95375 - DNA, 232 bp, Homo sapiens
  misc_feature 1..232: note = chr6:27173632-27173864
  misc_feature 1..232: note = hyper
  source 1..232: mol_type = genomic DNA
cgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaag

SEQ ID NO: 95376 - DNA, 257 bp, Homo sapiens
  misc_feature 1..257: note = chr6:27173924-27174181
  misc_feature 1..257: note = hyper
  source 1..257: mol_type = genomic DNA
ctccactacggaaacaactgtgggaaagggttacccacatcccccccgcccccatccccaccccgccgcttaactaagagggctttgcctgaagggcctggactgccttatacgtctgtttagaaaatgatcgttgtggtgcagttctctccttttactgttttcgaaaagaaaagcaattcataaccaagcttccccagggctccaattcccgcacaaatttcaaacatggaaagctagaacggaatgctacagaa

SEQ ID NO: 95377 - DNA, 145 bp, Homo sapiens
  misc_feature 1..145: note = chr6:27182855-27183000
  misc_feature 1..145: note = hyper
  source 1..145: mol_type = genomic DNA
cattaaaaaacaaaaacaaaaacaaaaagcgggtacatcaatgatagataatcgacagacgcagactgagtggccagtagtcaaaagcgcaaccgagggccagtggcgcaatggataacgcgtctgactacggatcagaagattc

SEQ ID NO: 95378 - DNA, 86 bp, Homo sapiens
  misc_feature 1..86: note = chr6:27203207-27203293
  misc_feature 1..86: note = hyper
  source 1..86: mol_type = genomic DNA
aaagatataccctgacggaacggataaatttaaagttcattttaactaattcaaaactgaaaaacactctcactaagcgagtttcc

SEQ ID NO: 95379 - DNA, 27 bp, Homo sapiens
  misc_feature 1..27: note = chr6:27205332-27205359
  misc_feature 1..27: note = hyper
  source 1..27: mol_type = genomic DNA
gaaggtgagaaccctcgtggcccgtac

SEQ ID NO: 95380 - DNA, 418 bp, Homo sapiens
  misc_feature 1..418: note = chr6:27205419-27205837
  misc_feature 1..418: note = hyper
  source 1..418: mol_type = genomic DNA
ggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggt

SEQ ID NO: 95381 - DNA, 373 bp, Homo sapiens
  misc_feature 1..373: note = chr6:27205913-27206286
  misc_feature 1..373: note = hyper
  source 1..373: mol_type = genomic DNA
cggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtcatcaggagtctcaacgtcttccccccaaa

SEQ ID NO: 95382 - DNA, 10 bp, Homo sapiens
  misc_feature 1..10: note = chr6:27206493-27206503
  misc_feature 1..10: note = hyper
  source 1..10: mol_type = genomic DNA
gtccgggcgc

SEQ ID NO: 95383 - DNA, 47 bp, Homo sapiens
  misc_feature 1..47: note = chr6:27206504-27206551
  misc_feature 1..47: note = hyper
  source 1..47: mol_type = genomic DNA
gctacggttcctggtacacattcgctgcgcctcgggcagcctaaggg

SEQ ID NO: 95384 - DNA, 61 bp, Homo sapiens
  misc_feature 1..61: note = chr6:27219595-27219656
  misc_feature 1..61: note = hyper
  source 1..61: mol_type = genomic DNA
aagcagcattgcggacggagctgagcgcttgcgggcccctgggccgcgctgaaaaccaggc

SEQ ID NO: 95385 - DNA, 15 bp, Homo sapiens
  misc_feature 1..15: note = chr6:27228172-27228187
  misc_feature 1..15: note = hyper
  source 1..15: mol_type = genomic DNA
gaagagcccacctgc

SEQ ID NO: 95386 - DNA, 170 bp, Homo sapiens; identical to SEQ ID NO: 540
  misc_feature 1..170: note = chr6:27228289-27228459
  misc_feature 1..170: note = hyper
  source 1..170: mol_type = genomic DNA

SEQ ID NO: 95387 - DNA, 280 bp, Homo sapiens
  misc_feature 1..280: note = chr6:27228667-27228947
  misc_feature 1..280: note = hyper
  source 1..280: mol_type = genomic DNA
atcctttgcatatagcgaaggggccacaattctcgtcccgccggccggttagctcggttgcttagagtgttgtgttaattacgctaaaggtcgtgggtttgatcctcttaccggccacatgaggagaattagttctttaccacttttgttgatcacatctcctgtgaattctgcttccagtttctccgaaagtaagctctatatcgccactactgaactggaaacacagtctttcaaaagaagaaatgtgggcgagggcggtggctcacgcccgtaatcc

SEQ ID NO: 95388 - DNA, 245 bp, Homo sapiens
  misc_feature 1..245: note = chr6:27242878-27243123
  misc_feature 1..245: note = hyper
  source 1..245: mol_type = genomic DNA
tcactggctgaaaaccgacgatttgcatcgttaattatccgtagcccttcgctggctgaaaaccgacgagtttctgcagaactgccataaaaaactactggggaaaatacgtggccagtacggggatcgaacccgcgaccttggcgttattagcaccacgctctaaccaactgagctaaccagccgacgctgggtgcagctcttccccccccaccccccgcccttaatctcgacactcatccttt

SEQ ID NO: 95389 - DNA, 522 bp, Homo sapiens
  misc_feature 1..522: note = chr6:27247546-27248068
  misc_feature 1..522: note = hyper
  source 1..522: mol_type = genomic DNA
gatgatcccatggagcgaggcttacgagcagcgagtgagcgactggagcccagcctgcacctggaggggcggttctggcccagtgctcccggaaagggtggctttcggcaaagtctcggcctcgccttgaccctccaggaaaaatgttcctgagcggaaagatcgttcaagttgcctgcgaaccaagtccttgaggtctttgtggggatcaggcgatgagagcatcaattataataataataatttgttcggcaaaaaattgctcgggtctgttcatgtccacccgagtagccacggacacttggctttgaagagggctttttccttgtcgaaaacaggaagggctctggtgggagaaaggcggcaggtgtacttcggtttatatgcacaccacaggtgacaaggagaaccttctctcctaaacggctaaagatggtgcgggggtgcaattctaaaaacgtgcactgagaaattcagctaaggattcctcaaaaatacaggttgcttctgcccggtttcgaa

SEQ ID NO: 95390 - DNA, 24 bp, Homo sapiens
  misc_feature 1..24: note = chr6:27249182-27249206
  misc_feature 1..24: note = hyper
  source 1..24: mol_type = genomic DNA
gattgcaggcgtgagcaacggcgc

SEQ ID NO: 95391 - DNA, 510 bp, Homo sapiens
  misc_feature 1..510: note = chr6:27255937-27256447
  misc_feature 1..510: note = hyper
  source 1..510: mol_type = genomic DNA
cactctgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcaggatattgccaaggactcggcatccggctcagctcaaggtggggacgaagacgtcctggttgcaag

SEQ ID NO: 95392 - DNA, 329 bp, Homo sapiens
  misc_feature 1..329: note = chr6:27258095-27258424
  misc_feature 1..329: note = hyper
  source 1..329: mol_type = genomic DNA
tttatccataaacatcgacaacaacgaaatcacactcttctgaattcctgcctctgccccgtgaaaacaaaaaaaaaagaaaaaaaaatcaacgtccacagtaacaagcctcgcatctgaggggaaattttcttaaattctccagtcacgtctgaaaaaaaaaagttttaatggaggactttgtagtaaagaaaagcatggtaaccttgataatttactgaaaggaaaggccaatcaactcgatgttaccaaagctgaaacagaaaaatttaattctcccttaacgaaggaagccaacgcagcacacaggtttccgtggtgtagtggtt

SEQ ID NO: 95393 - DNA, 30 bp, Homo sapiens
  misc_feature 1..30: note = chr6:27264021-27264051
  misc_feature 1..30: note = hyper
  source 1..30: mol_type = genomic DNA
ctttcttggcatttccgtctgggcatggac

SEQ ID NO: 95394 - DNA, 30 bp, Homo sapiens
  misc_feature 1..30: note = chr6:27264418-27264448
  misc_feature 1..30: note = hyper
  source 1..30: mol_type = genomic DNA
tagataatatcttaccgtgacagaacaact

SEQ ID NO: 95395 - DNA, 1007 bp, Homo sapiens
  misc_feature 1..1007: note = chr6:27279779-27280786
  misc_feature 1..1007: note = hyper
  source 1..1007: mol_type = genomic DNA
ctcacaggtctataccgtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 95396 - DNA, 166 bp, Homo sapiens
  misc_feature 1..166: note = chr6:27301031-27301197
  misc_feature 1..166: note = hyper
  source 1..166: mol_type = genomic DNA
caacctgccaaagatcgtctgagcctcttagcaagcactcgtttatcatagcgagcctaggaggagggcgccaagcaaaacactaggtgtagtcttctcgagtagaatccaggcagtcgtggagcgaacgcagctgccaccggagaggaatcgtgttaacagtctt

SEQ ID NO: 95397 - DNA, 578 bp, Homo sapiens
  misc_feature 1..578: note = chr6:27342451-27343029
  misc_feature 1..578: note = hyper
  source 1..578: mol_type = genomic DNA
ccagtttgtggctctcggagagttcgcctcgtccctccctctcagataaccacctatttctgacctctggaggccgggctgagcccggaattttatgaccagcgcccgctggccgtcgtcaccctctaatttctcgcaaaactcccggggacccttcttaatgtcagtagccacagtcgccgccgctcctgcgcctagaagccttccacgaccctcaaccccacagagccccgagcaggctcgggttcccgcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggtaagacgtgcaactgacactcagcgcgcggaggagcccgctgagaaagggtttacctgtccgaagagaactgcgcttgcatggctctggctgtgggccggctggctcttgtc

SEQ ID NO: 95398 - DNA, 30 bp, Homo sapiens
  misc_feature 1..30: note = chr6:27356433-27356463
  misc_feature 1..30: note = hyper
  source 1..30: mol_type = genomic DNA
ttgcaaaaccttccacgaaagtgaatccca

SEQ ID NO: 95399 - DNA, 395 bp, Homo sapiens
  misc_feature 1..395: note = chr6:27356685-27357080
  misc_feature 1..395: note = hyper
  source 1..395: mol_type = genomic DNA
tgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggtgggtgctcttagaggttctggaaagcggaaacacgggttcttcgaaggaaacgggcgaaagggtcgcgtgtggtttggctgcaggtcgggtcaggaggcacctccacggttgggacgccgcgtggcgtggggtcatgaagcccccagcgctcgtctcactggcgggccagcctagtccctctgcggcagtgacagccagtggttttccccgggtgtatccctgg

SEQ ID NO: 95400 - DNA, 72 bp, Homo sapiens; identical to SEQ ID NO: 40713
  misc_feature 1..72: note = chr6:2737187-2737259
  misc_feature 1..72: note = hypo
  source 1..72: mol_type = genomic DNA

SEQ ID NO: 95401 - DNA, 21 bp, Homo sapiens
  misc_feature 1..21: note = chr6:27441925-27441946
  misc_feature 1..21: note = hypo
  source 1..21: mol_type = genomic DNA
ccactgcgcccggccccaaca

SEQ ID NO: 95402 - DNA, 658 bp, Homo sapiens
  misc_feature 1..658: note = chr6:27463029-27463687
  misc_feature 1..658: note = hyper
  source 1..658: mol_type = genomic DNA
ctaaatttagagcaacgcgggaagcccttgtgtcggccaaaactcaaaccagattctgagcctaaaagacttaatgtcacaacgaagggacacagaggagacttttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaatccattggggtctccccgcgcaggttcgaatcctgccgactacggggtggtttttgc

SEQ ID NO: 95403 - DNA, 240 bp, Homo sapiens
  misc_feature 1..240: note = chr6:27471362-27471602
  misc_feature 1..240: note = hyper
  source 1..240: mol_type = genomic DNA
tgtcctgacagaccccgtcgttttggcttaggcggcagattaaagtgtaaattcgccaagtataatcaatttagtagaatacaaacttacagacttaaaaaagtgggcaagaatacttaagtttattagaggtagtcaaaactcgctgacgcagagttcttcctcgttagtatagtggtgagtatccccgcctgtcacgcgggagaccggggttcgattccccgacggggagaaaagttg

SEQ ID NO: 95404 - DNA, 30 bp, Homo sapiens
  misc_feature 1..30: note = chr6:27494670-27494700
  misc_feature 1..30: note = hypo
  source 1..30: mol_type = genomic DNA
gtgagccaccctgcccggcctgccttttct

SEQ ID NO: 95405 - DNA, 492 bp, Homo sapiens
  misc_feature 1..492: note = chr6:27512392-27512884
  misc_feature 1..492: note = hyper
  source 1..492: mol_type = genomic DNA
tcaaaggttacaaaccgtttctaacctaaattgaagatatagcaaatgccccagtaataagaccaaataatatttgcaagagtccaacgaagggaacacatttcttactattttagagggaaaaacaaatgtgggcgcgctttcactatcagagacattgccggcctcggtcatggaggtcactttccctttgtatctgcggggccgactcacttccattcccagaattccgagactttccccctaacttttgtctaaaaaggaatctgattcaagtctaccccttatttttccactctgacaatactgtagtatctgaagcaagaatcaaccttattaatttagctagatttatcctgacatttacttgtttccatctttttgcgtttttctgtgctggactctccctaagatatttggaaacctgtgttctgagttcttccttttccccgggctcgggtggctgaaggccttggctcttgggaatggtct

SEQ ID NO: 95406 - DNA, 712 bp, Homo sapiens
  misc_feature 1..712: note = chr6:27512994-27513706
  misc_feature 1..712: note = hyper
  source 1..712: mol_type = genomic DNA
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcgatggacttgaaatccattggggtttccccgcgcaggttcgaatcctgccgactacggttttaccaggtgcagttcccgcctttcctcaaaacttacccaaattcttgtactccatttgctgctctcctacacaatcctcccactgcatattcagataatatcctctttactcagtgaatggagactaccttatgttgccgttacttcaaaact

SEQ ID NO: 95407 - DNA, 34 bp, Homo sapiens
  misc_feature 1..34: note = chr6:27526047-27526081
  misc_feature 1..34: note = hyper
  source 1..34: mol_type = genomic DNA
ccaaccctccagtgacggtcgtatttgtttctgt

SEQ ID NO: 95408 - DNA, 30 bp, Homo sapiens
  misc_feature 1..30: note = chr6:27526284-27526314
  misc_feature 1..30: note = hyper
  source 1..30: mol_type = genomic DNA
taacggagcaagtaccgctgggccacaccg

SEQ ID NO: 95409 - DNA, 604 bp, Homo sapiens
  misc_feature 1..604: note = chr6:27533773-27534377
  misc_feature 1..604: note = hyper
  source 1..604: mol_type = genomic DNA
catcacattgattggcgtcaagaggggacatcagtcatatgggcctgttggcgctgtgaggcaacggtctcaagagtcctcgagagaaagagaggtgttgcccctccctggggacaacctgacactaggtgtggagccagtcgcggggatgggcgaccgccatggggccaggggcggaagtggggatagagcacagggtataaaagactcctgctacagctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 95410 - DNA, 58 bp, Homo sapiens
  misc_feature 1..58: note = chr6:27551225-27551283
  misc_feature 1..58: note = hyper
  source 1..58: mol_type = genomic DNA
actgcttcgtctccccgtcggggaatcgaaccccggtctcccgcgtgacagacgggga

SEQ ID NO: 95411 - DNA, 138 bp, Homo sapiens
  misc_feature 1..138: note = chr6:27559855-27559993
  misc_feature 1..138: note = hyper
  source 1..138: mol_type = genomic DNA
ttacaggggaaatgacgaagaaaatcgggctcagaatagagtgggaccccttcggtagtgaataatcccgcagctcattattgcgaacagcagcccttagagatcgtagctggctggtaaaggcggctttagagcgga

SEQ ID NO: 95412 - DNA, 34 bp, Homo sapiens
  misc_feature 1..34: note = chr6:27560276-27560310
  misc_feature 1..34: note = hyper
  source 1..34: mol_type = genomic DNA
ataatatctttttcccggtcgcccaacctagtct

SEQ ID NO: 95413 - DNA, 175 bp, Homo sapiens
  misc_feature 1..175: note = chr6:27560710-27560885
  misc_feature 1..175: note = hyper
  source 1..175: mol_type = genomic DNA
aacatctcctaacaccgctgtccagctgcgtcaatatttttttcttccttatccatttatcttctctagtctctgtctttcatcctcgagttgtctcacgtttccttctcaacatagtcacctacaacttgttgtttgctcctttgcaacttaagaaaaccgattgaaatccttt

SEQ ID NO: 95414 - DNA, 789 bp, Homo sapiens
  misc_feature 1..789: note = chr6:27572826-27573615
  misc_feature 1..789: note = hyper
  source 1..789: mol_type = genomic DNA
taacagattattttacgtgtgcagaaaagcagtgaagattttagtcactgatcagttgactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatgatctccaacagtgctgcgggactgcgtccaaatggcactgaaaatatcccaggattctgtaaatgtggggttttcctttgtcgattggtttgatgtaagagagatgcctctctctttgcgagaccctgtttggcgaacatcggttggggagggaaatcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 95415 - DNA, 379 bp, Homo sapiens
  misc_feature 1..379: note = chr6:27585093-27585472
  misc_feature 1..379: note = hyper
  source 1..379: mol_type = genomic DNA
ttttcctattgtttgcgtttataccacttccggtcacacgggcattgttttgccggtatgactttgggggatgaaggtggggatgcggaatatgtgattgttttaccctttaagacctttgggacagctggctggattgctcttaaacagcagatttcacagcctgtcttctggaagggagagctgcgtcctcgggataagacaggcgcatagagcctggattccccgcttcccaaccagtggctcgcatttttttctgagttgttttaatgttacttgtatttgtcagtagtcgaggactttttaagtttttatttattttatttttttaagggatattgtttctttatgagcacagggcccccgacttgggacagga

SEQ ID NO: 95416 - DNA, 669 bp, Homo sapiens
  misc_feature 1..669: note = chr6:27598672-27599341
  misc_feature 1..669: note = hyper
  source 1..669: mol_type = genomic DNA
agagatgctggactgcgaatgcaggcgcgctgcaggcgaggctgggagggccgccaggagcgctgcgggtatcgggagacacgcagagggaggggcaggcggcgggctccgcttcttcgcgtcctggctctgaaagcaaccacaggccagcggggcggtgctaggtgaagctacgaagaagccaaatagctcgcgtcttctacaaaaaccgtgttcttgctagaacgttggcaaggagaagccggagtctctcctttttctcctcggcttttctcgggctttctgaaaagagcacctgcatattcccaggaaattttggctcctgatggcatgggggaggatcacattcatcttccaggagagatggagatatcttgatcaaattgtgttttatgcaagaggcgaggggctgcgaagggaggatctcgggcagctcagcgcgctgccgctccggcgcgaggccggggtcgagcgcttcagtagctcatggctctgtagagtgcgcatggccaagcaaaggaaagcatgctccagtggcgcaatcggttagcgcgcggtacttatacaacagtatatgtgcgggtgatgccgaggttgtgagttcgagcctcacctggagcatgttttcttccaattgcgatttcagacatttcacgataatgcattttt

SEQ ID NO: 95417 - DNA, 25 bp, Homo sapiens
  misc_feature 1..25: note = chr6:27631920-27631945
  misc_feature 1..25: note = hypo
  source 1..25: mol_type = genomic DNA
aaaactcaatacttccggccaggcg

SEQ ID NO: 95418 - DNA, 30 bp, Homo sapiens
  misc_feature 1..30: note = chr6:27633696-27633726
  misc_feature 1..30: note = hypo
  source 1..30: mol_type = genomic DNA
tttactgtgcagagacgcaagagaggacat

SEQ ID NO: 95419 - DNA, 258 bp, Homo sapiens
  misc_feature 1..258: note = chr6:27635245-27635503
  misc_feature 1..258: note = hyper
  source 1..258: mol_type = genomic DNA
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttgaaagttccaaaaacacgaaggaaaccccaggcacatgtagagagatagttcctgacgctgcaggaggttt

SEQ ID NO: 95420 - DNA, 211 bp, Homo sapiens; identical to SEQ ID NO: 30418
  misc_feature 1..211: note = chr6:27635858-27636069
  misc_feature 1..211: note = hyper
  source 1..211: mol_type = genomic DNA

SEQ ID NO: 95421 - DNA, 196 bp, Homo sapiens
  misc_feature 1..196: note = chr6:27636335-27636531
  misc_feature 1..196: note = hyper
  source 1..196: mol_type = genomic DNA
cctttaaaacagcagcgcattcgtgtggccggttagctcagtcggctagagcgtggtgctaataacgccaaggtcgcgggttcgatccccgtacgggccactggatgccatagtggggcccttcacttacctgaagggaggccttttaatttaagcctgtcgaatcacaggtgctccgaatcgaatcccaggtgct

SEQ ID NO: 95422 - DNA, 262 bp, Homo sapiens
  misc_feature 1..262: note = chr6:27640050-27640312
  misc_feature 1..262: note = hyper
  source 1..262: mol_type = genomic DNA
gcagaagtgagccaccgcgcccggccttcaaatgtacatatttcttgatgtacatttccacaagtgtgcgcgcgctgtaaaagccacagcgatagcactcacaactttctatcctagtgaactaatgaaagctaactgatgaaagtagcaaattggaaatctaaccagaaaatggcgacgctgtgagcaggatttgaacctgcgcggggaacccccattggatttcgagtccaacaccttaaccactcggccatcacagctc

SEQ ID NO: 95423 - DNA, 223 bp, Homo sapiens
  misc_feature 1..223: note = chr6:27647513-27647736
  misc_feature 1..223: note = hyper
  source 1..223: mol_type = genomic DNA
gggggtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggcca

SEQ ID NO: 95424 - DNA, 357 bp, Homo sapiens; identical to SEQ ID NO: 30421
  misc_feature 1..357: note = chr6:27647890-27648247
  misc_feature 1..357: note = hyper
  source 1..357: mol_type = genomic DNA

SEQ ID NO: 95425 - DNA, 258 bp, Homo sapiens
  misc_feature 1..258: note = chr6:27648814-27649072
  misc_feature 1..258: note = hyper
  source 1..258: mol_type = genomic DNA
aaccgcaaactggttcgtgcgtaagaaggaatagaaactaagcagcaaccaagaatatcataagcctacctgtttccgcccggtttcgaaccgcggacctttcgcgtgttaggcgaacgtgataaccactacactacggaaacaccctctttctgctcccttaccttgaaacatggaagtatatattccctgatccccaagtttagaaattttggaattgttctttccttgtagaaaattttccgattgtagtattgt

SEQ ID NO: 95426 - DNA, 441 bp, Homo sapiens
  misc_feature 1..441: note = chr6:27661684-27662125
  misc_feature 1..441: note = hyper
  source 1..441: mol_type = genomic DNA
tgaacctttcttccccgtgtgtttagaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtg

SEQ ID NO: 95427 - DNA, 34 bp, Homo sapiens
  misc_feature 1..34: note = chr6:27719759-27719793
  misc_feature 1..34: note = hypo
  source 1..34: mol_type = genomic DNA
gaaatgtgtcaccttcgcgcggtggctcatgcct

SEQ ID NO: 95428 - DNA, 153 bp, Homo sapiens
  misc_feature 1..153: note = chr6:27719853-27720006
  misc_feature 1..153: note = hypo
  source 1..153: mol_type = genomic DNA
ccaggctggcccatataagaagcagctaacacccctagggctgagggctgagatggagcacgcaagtattctcttccccaccagggctgagatccagacctgcatccaggttgggagggtagaaaaaaagtgctccagcggaaggtgcaggtc

SEQ ID NO: 95429 - DNA, 32 bp, Homo sapiens
  misc_feature 1..32: note = chr6:27755529-27755561
  misc_feature 1..32: note = hypo
  source 1..32: mol_type = genomic DNA
tactttgattgagctcggtgataatttttttt

SEQ ID NO: 95430 - DNA, 51 bp, Homo sapiens
  misc_feature 1..51: note = chr6:27759373-27759424
  misc_feature 1..51: note = hyper
  source 1..51: mol_type = genomic DNA
aaaaagtgaagtcgtcgaacaaaaccgagcccttatcgtgtgccaggtttt

SEQ ID NO: 95431 - DNA, 620 bp, Homo sapiens
  misc_feature 1..620: note = chr6:27774739-27775359
  misc_feature 1..620: note = hyper
  source 1..620: mol_type = genomic DNA
cggaaagattaaaaacgccagccttgttttcctagtgctgtttttggtttttacctcgggtcttttgtcgtgccttaaaatcatgtctggttgcgcaagtgagggaaaggattgggtaaagggggcgccaccgcaagttgctgtgcaacatccagacatcaccagacccaccacctggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtacatttcaccttaaatggctttcaaagagctagattaatttagtggatagatcaaaatgatttatgacccctcgccccccagtgataggaagagcgaaccagctcttctttagataatagtgagtggctctgaaaagagcctttgggttggacaagagcttgagaatttacttggagctggtgtacttggtgacggccttggtgccctccgacaccgcgtgct

SEQ ID NO: 95432 - DNA, 307 bp, Homo sapiens
  misc_feature 1..307: note = chr6:27775704-27776011
  misc_feature 1..307: note = hyper
  source 1..307: mol_type = genomic DNA
accaaaacaagaagtcggtctcctctttttatataatagtttatgcggccgaggtagtgggaaggtctctgctgattggtaattatccgtggatgacgacagatgccagttttgcccaatcaaaataggtatcctgcataatcgagtcctattggtctaaataaaaataaaacgtaagccaatcgcacagcttccttttcgcgcccagtagaggctataaaatgtacgtttttctagtttcacttcagtctttcttgaccgtatagataataggccttttgccatgtctgggcgtggcaagcaggga

SEQ ID NO: 95433 - DNA, 441 bp, Homo sapiens; identical to SEQ ID NO: 30426
  misc_feature 1..441: note = chr6:27777715-27778156
  misc_feature 1..441: note = hyper
  source 1..441: mol_type = genomic DNA

SEQ ID NO: 95434 - DNA, 221 bp, Homo sapiens
  misc_feature 1..221: note = chr6:27782421-27782642
  misc_feature 1..221: note = hyper
  source 1..221: mol_type = genomic DNA
gatgcactcggcctacgggaaactgaagcccggcccgagaagagcgggtcttggccttggcgcgagctttgcctccctgcttaccacgcccagacatggcaaaaggtctattacctttacggtcaagaaagactgaaatgaaattggaaaaacgtacattttatagcctctactgggcgcgaaaaggaagctgtgcgattggcttacgttttatttttatt

SEQ ID NO: 95435 - DNA, 428 bp, Homo sapiens
  misc_feature 1..428: note = chr6:27832864-27833292
  misc_feature 1..428: note = hyper
  source 1..428: mol_type = genomic DNA
gtaacgtcctgttcacgaattcttatgcaaatgaggtgattaataaaatagtgtgtaggactggtggcgattctagatgacgtcatatacacgtttgtccaatccaaagaagcatgtttcataacagcgattccattggttgaaataaaactgtaatttgagccaatggcacagctttattttcgcgcccagtattgactataagtagtggagctctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcgg

SEQ ID NO: 95436 - DNA, 19 bp, Homo sapiens
  misc_feature 1..19: note = chr6:27833815-27833834
  misc_feature 1..19: note = hyper
  source 1..19: mol_type = genomic DNA
aggctcagtggctcacgcc

SEQ ID NO: 95437 - DNA, 789 bp, Homo sapiens
  misc_feature 1..789: note = chr6:27834074-27834863
  misc_feature 1..789: note = hyper
  source 1..789: mol_type = genomic DNA
aggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaatataagaagcttctttgtagctaggcgtctgacaaaaagcttgacaccaacttaacaaaaaccaacggctggaattcatactctaataacagactgcatgggtaaactacgtggggagtccaaccaacaccctggactcttgcttgccttgcgttactcgattagggttgagggagaactgcccgagatttttcgaatgcaaggaatcttgctgcctgatctaacatgttgtgcacagccattttttagaggtctctgggtggctctgaaaagagcctttggggctttgttgcggttttcacacgccagcttcctacttctttttggcagccgccttcttggcctttgcagctttaggttttgctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgccttttt

SEQ ID NO: 95438 - DNA, 193 bp, Homo sapiens; identical to SEQ ID NO: 30431
  misc_feature 1..193: note = chr6:27834904-27835097
  misc_feature 1..193: note = hyper
  source 1..193: mol_type = genomic DNA

SEQ ID NO: 95439 - DNA, 95 bp, Homo sapiens
  misc_feature 1..95: note = chr6:27835377-27835472
  misc_feature 1..95: note = hyper
  source 1..95: mol_type = genomic DNA
cgggccccgggcttatataagccggcgctgccctgtgattggtggagcgtccaatccaccgccctctggccgccgccgctcgcggttggactccc

SEQ ID NO: 95440 - DNA, 890 bp, Homo sapiens; identical to SEQ ID NO: 30433
  misc_feature 1..890: note = chr6:27839683-27840573
  misc_feature 1..890: note = hyper
  source 1..890: mol_type = genomic DNA

SEQ ID NO: 95441 - DNA, 153 bp, Homo sapiens
  misc_feature 1..153: note = chr6:27841104-27841257
  misc_feature 1..153: note = hyper
  source 1..153: mol_type = genomic DNA
acactttaagaactccgcgtgtctcctcgtatataaggcctgagatgcgcttaacgcctccacgccgtgccaggcgtcggatggcgggcttggtgatgccctgaatgttgtcgcgcagaactttgcggtggcgcttagcgcctcctttgccca

SEQ ID NO: 95442 - DNA, 461 bp, Homo sapiens
  misc_feature 1..461: note = chr6:27858279-27858740
  misc_feature 1..461: note = hyper
  source 1..461: mol_type = genomic DNA
gcacgcctcttgcagcgccatcaccgccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgcttccgcggtgccttgccgccggtagacttgcgagctgtctgcttcgtccgggccatagttgagaaagctatgctctgaaagcaagcagctgaatgagcagtggcttctaccagaatttataacgatgatctgatcctgattggtcagaactgttgtaggaaaaacctggttggttgttaatactatcttcatttggttcctgccactttttttttttttttttttt

SEQ ID NO: 95443 - DNA, 127 bp, Homo sapiens
  misc_feature 1..127: note = chr6:27934883-27935010
  misc_feature 1..127: note = hypo
  source 1..127: mol_type = genomic DNA
ggcaccgggcctggacgaggggaatgcggtggcgcctgaaaacttgacgatgccacaatgtcagagccccaaggggtgttgggcggagcacgtgctacatctctctctttcccgccacctgcagctt

SEQ ID NO: 95444 - DNA, 254 bp, Homo sapiens
  misc_feature 1..254: note = chr6:28129376-28129630
  misc_feature 1..254: note = hyper
  source 1..254: mol_type = genomic DNA
aagtctgagcattgccgacgggccggagcaaatcgctcccgggctagaccctgcctacaccgcggcggggacaggtggaggtttcaacccctgtttggcaacctcgggcgcagccaggccccgcccagaaatttccgggacacgccccggaagtactgagagggacttccgccccgaggcgaggcctcggagctggttgctgctcacaggcagagaaacgctggtatgcatttgggtgtcgcttgggtggatgt

SEQ ID NO: 95445 - DNA, 40 bp, Homo sapiens
  misc_feature 1..40: note = chr6:28149166-28149206
  misc_feature 1..40: note = hypo
  source 1..40: mol_type = genomic DNA
gtttaacaaaatgctggtgggggaacgggggaacgtggtt

SEQ ID NO: 95446 - DNA, 1150 bp, Homo sapiens
  misc_feature 1..1150: note = chr6:28175189-28176339
  misc_feature 1..1150: note = hyper
  source 1..1150: mol_type = genomic DNA
acccacagaatgaatcgaagggtactcaacaaatgggaggactcgggcagctttcctgggatatcacaccatatagactgagaatttcagaaacgcaaagtgcgcgtcccagcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagccaccggagatatcgagagagctccttaactgctcactgagcaaacttcgttttacagctttggggttgatatttgggaaactgggtcctaaaagtggcttctggtcttcagaaggctttgttctccgcttttgattttttgacaccacgggtttcacaccccaccccaccccccagtctcacacaaaccactcaaactcgattgcgtctccattgcgctttggggaaaaataatttaagattctcgcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaatcccatgaacagtgatttttcttcaattctctagtctcgtctacgttttttgtttttt

SEQ ID NO: 95447 - DNA, 170 bp, Homo sapiens; identical to SEQ ID NO: 30438
  misc_feature 1..170: note = chr6:28249409-28249579
  misc_feature 1..170: note = hyper
  source 1..170: mol_type = genomic DNA

SEQ ID NO: 95448 - DNA, 38 bp, Homo sapiens; identical to SEQ ID NO: 30439
  misc_feature 1..38: note = chr6:28303451-28303489
  misc_feature 1..38: note = hyper
  source 1..38: mol_type = genomic DNA

SEQ ID NO: 95449 - DNA, 370 bp, Homo sapiens
  misc_feature 1..370: note = chr6:28303931-28304301
  misc_feature 1..370: note = hyper
  source 1..370: mol_type = genomic DNA
cggaaatgcgtcagccgttctgagcccactggctgaagccaggcaactctttcctttctaggaattccagaggtggctgctgcttggtgactcccttattgcaaaccccggggccaaaaatcccagtcccactgggtgcgaggcggagaaatccggcgaggcatttctatggggagcggcccccagcatttaggagttagatggtcatcgagacccaaaacattagagccggaaggtgttaggaagatataaacgtagagagcgagtaacaggaggcaattccacggccaaacaggtttatttacaggaaaagcctgcgaagagttccagttaggaatctggctgagatcctgatcgcttacaagctgag

SEQ ID NO: 95450 - DNA, 225 bp, Homo sapiens; identical to SEQ ID NO: 544
  misc_feature 1..225: note = chr6:28367054-28367279
  misc_feature 1..225: note = hyper
  source 1..225: mol_type = genomic DNA

SEQ ID NO: 95451 - DNA, 67 bp, Homo sapiens; identical to SEQ ID NO: 545
  misc_feature 1..67: note = chr6:28367280-28367347
  misc_feature 1..67: note = hyper
  source 1..67: mol_type = genomic DNA

SEQ ID NO: 95452 - DNA, 81 bp, Homo sapiens; identical to SEQ ID NO: 546
  misc_feature 1..81: note = chr6:28367490-28367571
  misc_feature 1..81: note = hyper
  source 1..81: mol_type = genomic DNA

SEQ ID NO: 95453 - DNA, 306 bp, Homo sapiens; identical to SEQ ID NO: 30445
  misc_feature 1..306: note = chr6:28367572-28367878
  misc_feature 1..306: note = hyper
  source 1..306: mol_type = genomic DNA

SEQ ID NO: 95454 - DNA, 30 bp, Homo sapiens; identical to SEQ ID NO: 40776
  misc_feature 1..30: note = chr6:28395568-28395598
  misc_feature 1..30: note = hypo
  source 1..30: mol_type = genomic DNA

SEQ ID NO: 95455 - DNA, 141 bp, Homo sapiens; identical to SEQ ID NO: 30446
  misc_feature 1..141: note = chr6:28410889-28411030
  misc_feature 1..141: note = hyper
  source 1..141: mol_type = genomic DNA

SEQ ID NO: 95456 - DNA, 57 bp, Homo sapiens; identical to SEQ ID NO: 549
  misc_feature 1..57: note = chr6:28411031-28411088
  misc_feature 1..57: note = hyper
  source 1..57: mol_type = genomic DNA

SEQ ID NO: 95457 - DNA, 342 bp, Homo sapiens; identical to SEQ ID NO: 30448
  misc_feature 1..342: note = chr6:28411151-28411493
  misc_feature 1..342: note = hyper
  source 1..342: mol_type = genomic DNA

SEQ ID NO: 95458 - DNA, 126 bp, Homo sapiens
  misc_feature 1..126: note = chr6:28414613-28414739
  misc_feature 1..126: note = hyper
  source 1..126: mol_type = genomic DNA
tacagctacaaaccacgttgataaatttcacaaacataatagtaaaaggagccagaatagtgagtaaaagaagacaaaaaacacgacatttgacctctcgtccctgagaggcgggtggttgttagt

SEQ ID NO: 95459 - DNA, 50 bp, Homo sapiens; identical to SEQ ID NO: 30449
  misc_feature 1..50: note = chr6:28414942-28414992
  misc_feature 1..50: note = hyper
  source 1..50: mol_type = genomic DNA

SEQ ID NO: 95460 - DNA, 118 bp, Homo sapiens; identical to SEQ ID NO: 30450
  misc_feature 1..118: note = chr6:28415091-28415209
  misc_feature 1..118: note = hyper
  source 1..118: mol_type = genomic DNA

SEQ ID NO: 95461 - DNA, 53 bp, Homo sapiens
  misc_feature 1..53: note = chr6:28457292-28457345
  misc_feature 1..53: note = hyper
  source 1..53: mol_type = genomic DNA
taaagttctgtgtcacgtggggcctctcaggaggggtgcggaggtgggggagg

SEQ ID NO: 95462 - DNA, 639 bp, Homo sapiens
  misc_feature 1..639: note = chr6:28457553-28458192
  misc_feature 1..639: note = hyper
  source 1..639: mol_type = genomic DNA
tcccagaggagataacgcgttctcctctgtaacccgtccttccacgtcccggtggtgggggggggggtcccggttctcattctttcggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagagggcaggacacagcctctctgggcccggtagtatgcgaagacacgcataacgcaaaaggattcccgtcctggactttgggaattaaggccctgaacacattgagcaaaaagtagatctgtctgtacagacgtttctttccacgtctttcatagtaaggactttattaaaaagcaggcactcgaatcctaggtgggtagatgggaggctggggctggggatggggacgtcctctgttttctggttgtgcacattaaaaataactctctgctgcctactcctaaacgcagccggcaaaaatgagacgtcaactaagcgccgtttcagtcccaga

SEQ ID NO: 95463 - DNA, 510 bp, Homo sapiens
  misc_feature 1..510: note = chr6:2903047-2903557
  misc_feature 1..510: note = hyper
  source 1..510: mol_type = genomic DNA
ggccgagactggtgactgtaaaggacagtgaagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccctgctgctgcgctcgccgcggactcccgctagggcctctgc

SEQ ID NO: 95464 - DNA, 180 bp, Homo sapiens
  misc_feature 1..180: note = chr6:2920758-2920938
  misc_feature 1..180: note = hypo
  source 1..180: mol_type = genomic DNA
taatgaggcacgtcccgctcccccaaaccatcctggcgcaaactagtctttcaggtaaactttggaatgtccttggcaagaggggacgtccattcagatggttgggaagcttagaattttacttttggtttacaaacgtgagacggttgctgtagatgcgggcggcgagcatgtcaggac

SEQ ID NO: 95465 - DNA, 30 bp, Homo sapiens; identical to SEQ ID NO: 40715
  misc_feature 1..30: note = chr6:2939086-2939116
  misc_feature 1..30: note = hypo
  source 1..30: mol_type = genomic DNA

SEQ ID NO: 95466 - DNA, 30 bp, Homo sapiens
  misc_feature 1..30: note = chr6:2964245-2964275
  misc_feature 1..30: note = hypo
  source 1..30: mol_type = genomic DNA
ctcctgcccctgtgccgctgccctcctgct

SEQ ID NO: 95467 - DNA, 68 bp, Homo sapiens
  misc_feature 1..68: note = chr6:2985307-2985375
  misc_feature 1..68: note = hypo
  source 1..68: mol_type = genomic DNA
aaaactgaaaaagcacgaaaacaaaaatggttgtgaacagggctcagcgatgacgaggctacattcag

SEQ ID NO: 95468 - DNA, 47 bp, Homo sapiens
  misc_feature 1..47: note = chr6:304250-304297
  misc_feature 1..47: note = hypo
  source 1..47: mol_type = genomic DNA
gcctgcagtgggcaccgtgtgtgcagtggcctcgtgcagcagagtgc

SEQ ID NO: 95469 - DNA, 30 bp, Homo sapiens
  misc_feature 1..30: note = chr6:3053039-3053069
  misc_feature 1..30: note = hypo
  source 1..30: mol_type = genomic DNA
acttgcttctccccacggcttggccccctt

SEQ ID NO: 95470 - DNA, 104 bp, Homo sapiens
  misc_feature 1..104: note = chr6:3053334-3053438
  misc_feature 1..104: note = hypo
  source 1..104: mol_type = genomic DNA
gctccaggctcttcacgagttctttgaaagccgctggcgttgactccattactagcaatgagtgggacacatttcctaacccatacacacgtttgttcagctgg

SEQ ID NO: 95471 - DNA, 84 bp, Homo sapiens
  misc_feature 1..84: note = chr6:3065550-3065634
  misc_feature 1..84: note = hypo
  source 1..84: mol_type = genomic DNA
ggctgtggcgggggtggctgggggtgcgggttgtgttcattgtccaaggctctccagtgctttgcgtggcgttttggggagcac

SEQ ID NO: 95472 - DNA, 94 bp, Homo sapiens; identical to SEQ ID NO: 40718
  misc_feature 1..94: note = chr6:3104457-3104551
  misc_feature 1..94: note = hypo
  source 1..94: mol_type = genomic DNA

SEQ ID NO: 95473 - DNA, 35 bp, Homo sapiens; identical to SEQ ID NO: 40719
  misc_feature 1..35: note = chr6:3225962-3225997
  misc_feature 1..35: note = hypo
  source 1..35: mol_type = genomic DNA

SEQ ID NO: 95474 - DNA, 50 bp, Homo sapiens
  misc_feature 1..50: note = chr6:3227693-3227743
  misc_feature 1..50: note = hyper
  source 1..50: mol_type = genomic DNA
ggaccccctccgctgcggcgcgcccaccttggcgccgatctggttgccgc

SEQ ID NO: 95475 - DNA, 494 bp, Homo sapiens
  misc_feature 1..494: note = chr6:3228186-3228680
  misc_feature 1..494: note = hyper
  source 1..494: mol_type = genomic DNA
aggagggtgagagggcggcgaggcgagggccaccagcgcgtcctgaccggggtgggggcagagctggcaccggatgggaacgatggaggactggagcatgtggagaagccgtcaggtgctccagtgccggcaggtgggagggctgaggtggcacaggctgctccgccacctcggactgcggctcctactcggccactggccagagtccctccagccaactgcccctggtgagaccaccgtctttttcctcaaccctggaggccagcgactgcccaggcggcgctccgtctcacagaggcctgggggaggacaggtggccccagaaggaagtcgtgcttgatggcaaccgggacacctgcggcccatgaacaccagcgcggcctccgcccccgccccagcgtgggcctgctttctcctttgtctgtcttgggctggtagctcctctcactgcgccgcagcatctaggggtgaagcgacctcggagcccctcagcc

SEQ ID NO: 95476 - DNA, 326 bp, Homo sapiens
  misc_feature 1..326: note = chr6:3228921-3229247
  misc_feature 1..326: note = hyper
  source 1..326: mol_type = genomic DNA
cccacccccccaccccgccctcggattcagttcatctattgtcaagtaagagggtgggttccaagggtggcccaagcccgagtaacaaactttcttatcttccatcgcggcgacctggaggtccgaggcttcgtgctgcggttgaagggtggggaatacgactaaaaactgcagcccagcgcgcgcgagacgacccaagacccacgcgcactcgcacgagcgcgtgcacagacttggagcacagaccctcccttcagatccgcagtctctaggtactgaggcaggaactggtctctttgttacttttcgcgcgcgcgtgtgtgtgt

SEQ ID NO: 95477 - DNA, 325 bp, Homo sapiens
  misc_feature 1..325: note = chr6:3229307-3229632
  misc_feature 1..325: note = hyper
  source 1..325: mol_type = genomic DNA
gggcgggaggggaaagggtgtcagaaacgttcactgcacaacctgttccctgcaattcgatgactgaagcgcgccgccccacacttcggaagggccgttggcgaggtgacgtgacctctttcatcccctggcgagaaaggccgaatgacccgggcgcacgcggcggagctcagcctgcagctgttgagcgagaccctcccagaactatcagcaagctgtcatcgcctccctttcccgctgtggggtggagggtggggggttcaagtcgattccaatgtacaaagagaagtagcgagaacaaaagcccaggcgcccccaaacatcc

SEQ ID NO: 95478 - DNA, 358 bp, Homo sapiens; identical to SEQ ID NO: 30253
  misc_feature 1..358: note = chr6:3231580-3231938
  misc_feature 1..358: note = hyper
  source 1..358: mol_type = genomic DNA

SEQ ID NO: 95479 - DNA, 186 bp, Homo sapiens
  misc_feature 1..186: note = chr6:32632511-32632697
  misc_feature 1..186: note = hyper
  source 1..186: mol_type = genomic DNA
cccggcacagaaactcggggtctcggccaagggtgggcctcacggaggggcgacgacgctcacctctcctctgcaagatcccgcggaacgccacctcgtagttgtgtctgcacaccgtgtccaactccgcccgggtcccctccaggacttccttctggctgttccagtactcggcatcaggccgcc

SEQ ID NO: 95480 - DNA, 396 bp, Homo sapiens
  misc_feature 1..396: note = chr6:3285139-3285535
  misc_feature 1..396: note = hypo
  source 1..396: mol_type = genomic DNA
gaatacaaatgtatccgtatagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggcgctggccgccggggcagtggaattcatactgcgctaaacaaagatc

SEQ ID NO: 95481 - DNA, 48 bp, Homo sapiens
  misc_feature 1..48: note = chr6:3286048-3286096
  misc_feature 1..48: note = hypo
  source 1..48: mol_type = genomic DNA
ggtggacagccctggcgtctagttctgagagcccgggttcattttcct

SEQ ID NO: 95482 - DNA, 30 bp, Homo sapiens; identical to SEQ ID NO: 40721
  misc_feature 1..30: note = chr6:3298330-3298360
  misc_feature 1..30: note = hypo
  source 1..30: mol_type = genomic DNA

SEQ ID NO: 95483 - DNA, 297 bp, Homo sapiens
  misc_feature 1..297: note = chr6:3307198-3307495
  misc_feature 1..297: note = hypo
  source 1..297: mol_type = genomic DNA
ccaagcaggcgtcagcgtctgcagcgcggtatggatacagcaatggaggggcacaaggattcctcctctagggtaagtaggatgcttgccaacttggaggattttagagcagatgtttgctgatgggccatgaacatgctgagcagacggcatacggcagcgctacgacatgcacaggtggcacttggttactgacaagctgagggtaggcacaaaacctgcactctcagtggcatgtccaggcaggtgtcctcactggctccgggtctcagttcatctcgacgctctgacccccca

SEQ ID NO: 95484 - DNA, 149 bp, Homo sapiens
  misc_feature 1..149: note = chr6:3328274-3328423
  misc_feature 1..149: note = hypo
  source 1..149: mol_type = genomic DNA
ctcattggtctcattcgacatggtgagatcctgtctctaaaaaacaaccaaccaaacaaacaaccgttacttttcccctaacaccttaatgaagaatgcttacaagctactcttggcaactagatatactttgtcgataagcagagaga

SEQ ID NO: 95485 - DNA, 52 bp, Homo sapiens
  misc_feature 1..52: note = chr6:3333103-3333155
  misc_feature 1..52: note = hypo
  source 1..52: mol_type = genomic DNA
ggaacttgaagaaaccgctggttttatgtgactgtcccgtgatgtcgttcac

SEQ ID NO: 95486 - DNA, 30 bp, Homo sapiens
  misc_feature 1..30: note = chr6:33579234-33579264
  misc_feature 1..30: note = hypo
  source 1..30: mol_type = genomic DNA
actcacagagacctgcgccgcttccctcct

SEQ ID NO: 95487 - DNA, 30 bp, Homo sapiens
  misc_feature 1..30: note = chr6:33609197-33609227
  misc_feature 1..30: note = hypo
  source 1..30: mol_type = genomic DNA
ggatttaagacaatccggcggcatccttgg

SEQ ID NO: 95488 - DNA, 128 bp, Homo sapiens
  misc_feature 1..128: note = chr6:3361088-3361216
  misc_feature 1..128: note = hypo
  source 1..128: mol_type = genomic DNA
gacgaagccttccctcgggcaaagatgctggggtggggaacaggtgcagcaggaacagaaggtcagagcgtggtactggggtgacgagaggcgctagcgaacatcagcagctgcggggagctcgaggc

SEQ ID NO: 95489 - DNA, 197 bp, Homo sapiens; identical to SEQ ID NO: 40724
  misc_feature 1..197: note = chr6:3363773-3363970
  misc_feature 1..197: note = hypo
  source 1..197: mol_type = genomic DNA

SEQ ID NO: 95490 - DNA, 30 bp, Homo sapiens
  misc_feature 1..30: note = chr6:33678306-33678336
  misc_feature 1..30: note = hypo
  source 1..30: mol_type = genomic DNA
ctggaatgtccttcccgccaagtgtacatg

SEQ ID NO: 95491 - DNA, 30 bp, Homo sapiens
  misc_feature 1..30: note = chr6:33678538-33678568
  misc_feature 1..30: note = hypo
  source 1..30: mol_type = genomic DNA
ctgtttccctagcaccgttccaggcatatg

SEQ ID NO: 95492 - DNA, 30 bp, Homo sapiens
  misc_feature 1..30: note = chr6:33684793-33684823
  misc_feature 1..30: note = hypo
  source 1..30: mol_type = genomic DNA
ttcaactggaggaaacgattggctgcaata

SEQ ID NO: 95493 - DNA, 30 bp, Homo sapiens
  misc_feature 1..30: note = chr6:33748632-33748662
  misc_feature 1..30: note = hypo
  source 1..30: mol_type = genomic DNA
ccccactgcacatggcggcctggctctggg

SEQ ID NO: 95494 - DNA, 30 bp, Homo sapiens
  misc_feature 1..30: note = chr6:33761619-33761649
  misc_feature 1..30: note = hypo
  source 1..30: mol_type = genomic DNA
cgtgtgaatgttcagcgtggcgggggtggg

SEQ ID NO: 95495 - DNA, 468 bp, Homo sapiens
  misc_feature 1..468: note = chr6:33955284-33955752
  misc_feature 1..468: note = hypo
  source 1..468: mol_type = genomic DNA
caaatagcatcttagcgttattaagaaacagttctgacctcaaggcctccccctgagagggtcttaggaaccgccagaggtcctctgattacaccttgagaactgagcccctgaaggcagggaccatataaacttgtcctgtgtcctggggcagaggcgatgcccgatacacatgcatagaatatgagtcaacactgctgtgcgcatgtcaccctcacggccactctggaggcaggcgcttttgtcatcaaacccatttcacatgtgagggcgctgaagcccaaagaaagcagcgcctcactctgctgcctcatactctgttaaaaggagaatcatgccaacctccagaaatgaggcgggaaaatgactgcgctccgtgacctgtcaattaccccctggagacagccagcagctgtcctcatccctaggctgcggtcagagaaacatggaccccgagaggttaagggc

SEQ ID NO: 95496 - DNA, 195 bp, Homo sapiens
  misc_feature 1..195: note = chr6:33995948-33996143
  misc_feature 1..195: note = hypo
  source 1..195: mol_type = genomic DNA
gaagttgcccttctgcgtgaacttgttggacatggtggccgccgtaacgacggctttgaggctgcgcttgcgcttgggcacgttctgctccgggtggaagaggatgatgtagactttgggcatgtagagcattcccagggacaccgaggcgctcagactcaccgagaccgtcagcgtcgtcgtctggatgtacag

SEQ ID NO: 95497 - DNA, 30 bp, Homo sapiens
  misc_feature 1..30: note = chr6:34021237-34021267
  misc_feature 1..30: note = hypo
  source 1..30: mol_type = genomic DNA
cagagaggctcacagcgcctggcctggggc

SEQ ID NO: 95498 - DNA, 41 bp, Homo sapiens
  misc_feature 1..41: note = chr6:34034613-34034654
  misc_feature 1..41: note = hypo
  source 1..41: mol_type = genomic DNA
tgacagcaagggtgccgcggtcctcacgtggtgccgcctga

SEQ ID NO: 95499 - DNA, 44 bp, Homo sapiens
  misc_feature 1..44: note = chr6:34037899-34037943
  misc_feature 1..44: note = hypo
  source 1..44: mol_type = genomic DNA
tcgcacctgctcacacgctcccatcccctcggtgacctcccctc

SEQ ID NO: 95500 - DNA, 30 bp, Homo sapiens
  misc_feature 1..30: note = chr6:34038143-34038173
  misc_feature 1..30: note = hypo
  source 1..30: mol_type = genomic DNA
gagtgctcaggaaatcggcctgcaaaggat

SEQ ID NO: 95501 - DNA, 30 bp, Homo sapiens
  misc_feature 1..30: note = chr6:3405673-3405703
  misc_feature 1..30: note = hypo
  source 1..30: mol_type = genomic DNA
agagacgaccgagcacgtattcatgcgaaa

SEQ ID NO: 95502 - DNA, 30 bp, Homo sapiens
  misc_feature 1..30: note = chr6:34100465-34100495
  misc_feature 1..30: note = hyper
  source 1..30: mol_type = genomic DNA
tcaccgagcctccagcggcaggtgctgttt

SEQ ID NO: 95503 - DNA, 136 bp, Homo sapiens
  misc_feature 1..136: note = chr6:34110456-34110592
  misc_feature 1..136: note = hyper
  source 1..136: mol_type = genomic DNA
agttccagtttcactcgatcgctcacccgctcgctctctcacctacctcgggctgcctgccgctgtgcaaggcgctccctctcagagaagtcacgcctccaacggaatgaagccgcccagacgcaggttgggggag

SEQ ID NO: 95504 - DNA, 1919 bp, Homo sapiens
  misc_feature 1..1919: note = chr6:34111638-34113557
  misc_feature 1..1919: note = hyper
  source 1..1919: mol_type = genomic DNA
ccagaacggacaaggcgagggactatgatgggaacatacatgcccctccctccctgtcacttcgggctttctgccagattgacacaggggcagccaccgctctgagagacacgtggcttcgggcacccagctaggcaagcccagctcagtcggtgtccggaaaggccgcgttctcccgcgccaggggccggcaatggtgcggagaggggagaaagaagcaaggcgcctcctccgacagggactgaaagtctgagggcgggatgtcactcaaggcctaggggcagggggcgctcgtacgttcgggcctcaggactccctgccgccgccgatgctgctgccccatctcagcacaaacagcctcagaccgccctggtgcgggggcgcctctcgcagtcgaggcctccacctcccggccccgcccccgcgcggggaggagacgcctcccacctgcgagcgccggggaagaccgaccccggagcggggacccccagcacacacgcgcgtacacacatgcacacacagagaccactgccggtccgctcgcccggcggccgcgtagacgcgcaggttcatcacggtcccggggagggacggtcccgagtgtccggagagagcctgaccctgaagtcctggggctgcagggagaccccagaccctagagacccccacaacctgccgaggccacgggcaagcggttgccgggctccggccgctggcgaaggcggcgctggggcgggcacgggagctggacgcggtgcctgggaaaggagccgaggcgcgcgaggctgggtgccctcccgccgggagactgccgggaagaggtgcaaataatgccccgcgcccccgcctgtcccgcctctccgcagaccgggatgcgctaatgccgccgcccccacctgaaagctggcacgaccctccatccggtggaagcccctgtatacagagacagtactttccaccgggcccgcaaaaaagcctctgccccattccctccctcaggggcacccggaaagcctgccttagccccgaggggagaccctctagttcagatcccgcgccctccggcccctagggctccgggggcgccagctctcctcggagcactccaagcgcgggagctcgccggaggccacctccccgagccccgatgtccccgccgcagccctcgccccaggaggccggagggcacggtcccctctgtcggtccccctcgggccacaactcaccgcgcgccagcaaggtttaagccgcggcgaggggtcggctgcgtgccggcctgccccgggggcgcaggcagtcgacggccggaggcacggttctcgcggtgcccagagcccgggccgcggcgggcagcgctgacgctgcggacccagcgcgccgcggagccgcccggagtccgggacgcagcagggatgagctggcggccgcccggccggagccgccgccaagcgcgcggcgttcggctgctgctccggcaagcgagcaagcgagagggagatcggcggcaacccctgctcctgctgcggcggagcccggcgtccgagccggaaggagcgggagaggcggcaagaggagctgggtctggccgagagctccgggctgggaagggagcggagcgggagcgaccagcgagcgcagccggccgaggtacgggcgcctggcggcgccgcaacagcggcaacagcagcaggaaaaaaaatgagagcgagctagagagcgcgctggagagcgagcgagagagggagcgagagacgagagagcgaggaaggcgctgagaggggaggctgcgggagagggcgggagagccgggaagcgcaagggggcgagggggccgcagccgcttgccccggcgcccacagccgctgctgcacccgaggaggcacgagaccaatccggcaagtttgcgctgaaagtgcggg

SEQ ID NO: 95505 - DNA, 174 bp, Homo sapiens
  misc_feature 1..174: note = chr6:34119143-34119317
  misc_feature 1..174: note = hyper
  source 1..174: mol_type = genomic DNA
ccagcctctttgcctcgctgcaatttaaaacaacttatcatctctctctccacatgtccgggggctgtcagccgtgagccaaatgtcattagcatggatgtcacaagccgggatgtcaaaatacaattaacatttaaaagccccttccgcccaagacctcgtggccgcctgctc

SEQ ID NO: 95506 - DNA, 120 bp, Homo sapiens; identical to SEQ ID NO: 5043
  misc_feature 1..120: note = chr6:34170868-34170988
  misc_feature 1..120: note = hypo
  source 1..120: mol_type = genomic DNA

SEQ ID NO: 95507 - DNA, 31 bp, Homo sapiens; identical to SEQ ID NO: 5044
  misc_feature 1..31: note = chr6:34171048-34171079
  misc_feature 1..31: note = hypo
  source 1..31: mol_type = genomic DNA

SEQ ID NO: 95508 - DNA, 30 bp, Homo sapiens
  misc_feature 1..30: note = chr6:3438520-3438550
  misc_feature 1..30: note = hypo
  source 1..30: mol_type = genomic DNA
tacccaagggggccccggccagcagtccag

SEQ ID NO: 95509 - DNA, 46 bp, Homo sapiens
  misc_feature 1..46: note = chr6:34392006-34392052
  misc_feature 1..46: note = hypo
  source 1..46: mol_type = genomic DNA
catatcctttcacatcgtggtatacaccatccgttctccactccag

SEQ ID NO: 95510 - DNA, 31 bp, Homo sapiens
  misc_feature 1..31: note = chr6:34396511-34396542
  misc_feature 1..31: note = hypo
  source 1..31: mol_type = genomic DNA
cgacagagcgagactccgtctcaaaaacaaa

SEQ ID NO: 95511 - DNA, 611 bp, Homo sapiens
  misc_feature 1..611: note = chr6:34433479-34434090
  misc_feature 1..611: note = hyper
  source 1..611: mol_type = genomic DNA
gaggaaaggccaaggcgatggggagatggggagagaggcagggagcaacatcccgggctccgagcgcgccagctgggagggctggggaggagggcgcaccggagggctcccggcacgcgcggggccgcgggcagcccccagaagagggagccaggcaagactgctggggcaggggtcggctgaagcagcggggagccggaccccacccgccacccgccacccgccacccccggcgcctgccaaactggttgctgcctccccggcagccgcggcgcgtccacctgcgcagccaccgcgccgccctgcccgcgctaccattggctcgctaaaaatgcctctctaatctgctctgctcggtgcacgcctcctcctcatccttcccccctctccgcctcagctctgaccttcctccttcccgcagccccggcgagatcccagagcgacgcggtggcggcggcagcgccagccccctcctcccccgggaagtcggccgggcttgaggccgggccccagacgtcccgcttcgccccgagtcgccgccgatggtccccggagctcctgcccccaggtaggaggtctggcccttgaatagagggcgggggggttgtgtg

SEQ ID NO: 95512 - DNA, 30 bp, Homo sapiens
  misc_feature 1..30: note = chr6:34490562-34490592
  misc_feature 1..30: note = hypo
  source 1..30: mol_type = genomic DNA
ctcatgcaaagtccccgagtccaaaggcca

SEQ ID NO: 95513 - DNA, 30 bp, Homo sapiens
  misc_feature 1..30: note = chr6:34498821-34498851
  misc_feature 1..30: note = hypo
  source 1..30: mol_type = genomic DNA
cagggttggggaccccggtccagatcacag

SEQ ID NO: 95514 - DNA, 30 bp, Homo sapiens; identical to SEQ ID NO: 14846
  misc_feature 1..30: note = chr6:34514348-34514378
  misc_feature 1..30: note = hypo
  source 1..30: mol_type = genomic DNA

SEQ ID NO: 95515 - DNA, 30 bp, Homo sapiens
  misc_feature 1..30: note = chr6:34518840-34518870
  misc_feature 1..30: note = hypo
  source 1..30: mol_type = genomic DNA
cgctgtgacctgctacggggcacctgtcca

SEQ ID NO: 95516 - DNA, 29 bp, Homo sapiens
  misc_feature 1..29: note = chr6:34535577-34535606
  misc_feature 1..29: note = hypo
  source 1..29: mol_type = genomic DNA
gccctgccatcatagcgctgacagcggct

SEQ ID NO: 95517 - DNA, 29 bp, Homo sapiens
  misc_feature 1..29: note = chr6:34535906-34535935
  misc_feature 1..29: note = hypo
  source 1..29: mol_type = genomic DNA
ggcgtgagtcactgcgcccagccatatcc

SEQ ID NO: 95518 - DNA, 70 bp, Homo sapiens
  misc_feature 1..70: note = chr6:34618507-34618577
  misc_feature 1..70: note = hypo
  source 1..70: mol_type = genomic DNA
ttgagctatctaccacgcctggccaggaatttaattttaaacagtgcgcaacgttcgccttcttcgggaa

SEQ ID NO: 95519 - DNA, 70 bp, Homo sapiens; identical to SEQ ID NO: 40786
  misc_feature 1..70: note = chr6:34671603-34671673
  misc_feature 1..70: note = hypo
  source 1..70: mol_type = genomic DNA

SEQ ID NO: 95520 - DNA, 30 bp, Homo sapiens
  misc_feature 1..30: note = chr6:3471840-3471870
  misc_feature 1..30: note = hypo
  source 1..30: mol_type = genomic DNA
cccctctccttcctccgatgaccgaacccc

SEQ ID NO: 95521 - DNA, 19 bp, Homo sapiens
  misc_feature 1..19: note = chr6:34723890-34723909
  misc_feature 1..19: note = hypo
  source 1..19: mol_type = genomic DNA
gggcgcggtgggtcacgcc

SEQ ID NO: 95522 - DNA, 19 bp, Homo sapiens
  misc_feature 1..19: note = chr6:34724209-34724228
  misc_feature 1..19: note = hypo
  source 1..19: mol_type = genomic DNA
aagacgagataacctttct

SEQ ID NO: 95523 - DNA, 45 bp, Homo sapiens
  misc_feature 1..45: note = chr6:34854786-34854831
  misc_feature 1..45: note = hypo
  source 1..45: mol_type = genomic DNA
tgggtccctgatcaccgggtgcggtggctcacgcctgtaatccta

SEQ ID NO: 95524 - DNA, 336 bp, Homo sapiens
  misc_feature 1..336: note = chr6:348707-349043
  misc_feature 1..336: note = hypo
  source 1..336: mol_type = genomic DNA
ccacgtggatgcagacgtgcacatgtgtgtgacgtttcgggtttgtttccatcctctccagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaa

SEQ ID NO: 95525 - DNA, 50 bp, Homo sapiens
  misc_feature 1..50: note = chr6:35026986-35027036
  misc_feature 1..50: note = hypo
  source 1..50: mol_type = genomic DNA
aggcaacacttcagacggcgtgctggcccaggagacgccctgcttgccag

SEQ ID NO: 95526 - DNA, 56 bp, Homo sapiens
  misc_feature 1..56: note = chr6:35109367-35109423
  misc_feature 1..56: note = hypo
  source 1..56: mol_type = genomic DNA
agggttgtttcacagcgtgtgccgcaggggcgcaggggccgcgctctttcctcaca

SEQ ID NO: 95527 - DNA, 297 bp, Homo sapiens; identical to SEQ ID NO: 40791
  misc_feature 1..297: note = chr6:35149810-35150107
  misc_feature 1..297: note = hypo
  source 1..297: mol_type = genomic DNA

SEQ ID NO: 95528 - DNA, 191 bp, Homo sapiens
  misc_feature 1..191: note = chr6:35181252-35181443
  misc_feature 1..191: note = hyper
  source 1..191: mol_type = genomic DNA
aaacctggcgccgcacggccgtcctcgcgagcgagcgcggggacgcaccctcgctccccgactctttcctaggggagcgaggacgagtcggagcccggtgctgtttggtctggagccgagcggagcttgcattgatccattgattgcgcgcggtctgcgcctgacctccctgctcccggggaagccgtctc

SEQ ID NO: 95529 - DNA, 122 bp, Homo sapiens
  misc_feature 1..122: note = chr6:35181861-35181983
  misc_feature 1..122: note = hyper
  source 1..122: mol_type = genomic DNA
ttgggtgggattacacggagcagccccgccgccgccgctggcagaggccggcttggagagggcgggggttcccctccgtcagtcgcccctggcgcccctcgcctcgtcgcactctccgcctc

SEQ ID NO: 95530 - DNA, 64 bp, Homo sapiens
  misc_feature 1..64: note = chr6:35182200-35182264
  misc_feature 1..64: note = hyper
  source 1..64: mol_type = genomic DNA
ctcggggcgcgtacccgggctctgcctgcttgtcctgctggtccacgcccgcgccgcccagtac

SEQ ID NO: 95531 - DNA, 266 bp, Homo sapiens
  misc_feature 1..266: note = chr6:35309463-35309729
  misc_feature 1..266: note = hypo
  source 1..266: mol_type = genomic DNA
tgaaactgtgtctcaaaaaaaaaaaaaaaaaaaaaaatcactcatccagatagctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagccaacttcttccaccagattgcctcccagctgctaggtagtttcctgtggtacatcttaagcggtaggttgggata

SEQ ID NO: 95532 - DNA, 234 bp, Homo sapiens
  misc_feature 1..234: note = chr6:35359757-35359991
  misc_feature 1..234: note = hypo
  source 1..234: mol_type = genomic DNA
ctcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccgcaccagcagctct

SEQ ID NO: 95533 - DNA, 47 bp, Homo sapiens
  misc_feature 1..47: note = chr6:35454542-35454589
  misc_feature 1..47: note = hypo
  source 1..47: mol_type = genomic DNA
ctcctatcccacagccgctggctctggagctccgcccccagccccaa

SEQ ID NO: 95534 - DNA, 65 bp, Homo sapiens
  misc_feature 1..65: note = chr6:35466126-35466191
  misc_feature 1..65: note = hyper
  source 1..65: mol_type = genomic DNA
cgaaactggagagggcgatggcgaaggcctgcagggcgcacagcgggtaccggtagtctagggtg

SEQ ID NO: 95535 - DNA, 30 bp, Homo sapiens
  misc_feature 1..30: note = chr6:3569703-3569733
  misc_feature 1..30: note = hypo
  source 1..30: mol_type = genomic DNA
ccttaaggcctcaagcgtcaaaggagaaag

SEQ ID NO: 95536 - DNA, 30 bp, Homo sapiens
  misc_feature 1..30: note = chr6:35744172-35744202
  misc_feature 1..30: note = hyper
  source 1..30: mol_type = genomic DNA
tacttggaagtaacacgtatggaggctccc

SEQ ID NO: 95537 - DNA, 103 bp, Homo sapiens
  misc_feature 1..103: note = chr6:35773143-35773246
  misc_feature 1..103: note = hyper
  source 1..103: mol_type = genomic DNA
ccgggaagagggagacgggcagggcggcgccagcaggccctggtgggcttgggaggaggcaggagactggagacagcctcggctagagcggacacaggcacct

SEQ ID NO: 95538 - DNA, 25 bp, Homo sapiens
  misc_feature 1..25: note = chr6:35895210-35895235
  misc_feature 1..25: note = hypo
  source 1..25: mol_type = genomic DNA
ccacggtgcccggcccccaggtatt

SEQ ID NO: 95539 - DNA, 79 bp, Homo sapiens
  misc_feature 1..79: note = chr6:3593615-3593694
  misc_feature 1..79: note = hypo
  source 1..79: mol_type = genomic DNA
gtaggtaaatacatccgtagatttatttaaagcatgtgtaaaagctaaggcatattacctgtagcggttggtattcttg

SEQ ID NO: 95540 - DNA, 125 bp, Homo sapiens
  misc_feature 1..125: note = chr6:35992409-35992534
  misc_feature 1..125: note = hyper
  source 1..125: mol_type = genomic DNA
gggcgggctgaggagatgagagtgggggaggggacgaggaagaggagcatgagcagctgggctagggagccaggaaagtggtacctgggtcgccctcctcatacctgagtcgtgggatccccttg

SEQ ID NO: 95541 - DNA, 57 bp, Homo sapiens; identical to SEQ ID NO: 30462
  misc_feature 1..57: note = chr6:36088966-36089023
  misc_feature 1..57: note = hyper
  source 1..57: mol_type = genomic DNA

SEQ ID NO: 95542 - DNA, 104 bp, Homo sapiens
  misc_feature 1..104: note = chr6:36165588-36165692
  misc_feature 1..104: note = hypo
  source 1..104: mol_type = genomic DNA
tctagagtttctccccggtgtctggaggcgtgggtgggacaaaacacgtctgtgtagagtcttgcatggtcgagagatgcttgagcagccgaggaggtggcagg

SEQ ID NO: 95543 - DNA, 171 bp, Homo sapiens
  misc_feature 1..171: note = chr6:36214623-36214794
  misc_feature 1..171: note = hypo
  source 1..171: mol_type = genomic DNA
aaggttcttcccacacgtaaaattacatagtactcttaaatatgtcttcttgaacgccatcgccccatcccagactcaggaccagcctccccgcgctcactgctgtcactgctttccgcactccctgcggattttaggattttagctcccatctcgcgtcctctctccagc

SEQ ID NO: 95544 - DNA, 200 bp, Homo sapiens
  misc_feature 1..200: note = chr6:36238319-36238519
  misc_feature 1..200: note = hypo
  source 1..200: mol_type = genomic DNA
ggcgggggctgtggacgccctgcgggacctggccccccggatgctggaaacagcccaccgctttgcggggacatcggcaggtgctgtgatcgccgccctggccatctgcgggattgaaatgggtgaggcctgtgttctgggtcccctgggaagtctcttgggggattccacagagacagaaggagcgtgagggaggctgg

SEQ ID NO: 95545 - DNA, 29 bp, Homo sapiens
  misc_feature 1..29: note = chr6:36240231-36240260
  misc_feature 1..29: note = hypo
  source 1..29: mol_type = genomic DNA
acaggccacagacccggggccatggcctg

SEQ ID NO: 95546 - DNA, 369 bp, Homo sapiens
  misc_feature 1..369: note = chr6:36252866-36253235
  misc_feature 1..369: note = hyper
  source 1..369: mol_type = genomic DNA
taacaattattattacgttggggtagggtattcaagatatacccacaggaaaatgcagattacaattcagtctgcaattagggaccagatagcagccaactctcaggtgatccatgcagggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctctgtggcagatccatccctcactgcagacctaattccggtaccctgtgaacggcatcctcagcag

SEQ ID NO: 95547 - DNA, 164 bp, Homo sapiens
  misc_feature 1..164: note = chr6:36287117-36287281
  misc_feature 1..164: note = hypo
  source 1..164: mol_type = genomic DNA
cccgccctctctcaccggctggtcctccctgtatgggaactgggtgcaattgtagtggtctcttaggcccatgaggatgcacatggcatggctgttgctgccagcaaatttgttagctaagctaacgtcaaactggtagagtctcctggcgcggttcctgtcca

SEQ ID NO: 95548 - DNA, 30 bp, Homo sapiens
  misc_feature 1..30: note = chr6:36313961-36313991
  misc_feature 1..30: note = hypo
  source 1..30: mol_type = genomic DNA
gctttccataagacacgctaagacacgccc

SEQ ID NO: 95549 - DNA, 56 bp, Homo sapiens
  misc_feature 1..56: note = chr6:36344624-36344680
  misc_feature 1..56: note = hypo
  source 1..56: mol_type = genomic DNA
agtgactagcccacacgcatacaggcagcatggggcacagccgggctgtctggcta

SEQ ID NO: 95550 - DNA, 30 bp, Homo sapiens
  misc_feature 1..30: note = chr6:36355327-36355357
  misc_feature 1..30: note = hyper
  source 1..30: mol_type = genomic DNA
aggtgaggaagccaccggctttctgtcttg

SEQ ID NO: 95551 - DNA, 18 bp, Homo sapiens
  misc_feature 1..18: note = chr6:36392123-36392141
  misc_feature 1..18: note = hypo
  source 1..18: mol_type = genomic DNA
aaatgaagattcaggcgg

SEQ ID NO: 95552 - DNA, 91 bp, Homo sapiens
  misc_feature 1..91: note = chr6:36535507-36535598
  misc_feature 1..91: note = hypo
  source 1..91: mol_type = genomic DNA
gtatttttgattgtgagtcaccatcaaaaagtttgaacacctctgaatgaatacagttaaagcaattagaagtgtgcgggacaccttgtaa

SEQ ID NO: 95553 - DNA, 367 bp, Homo sapiens
  misc_feature 1..367: note = chr6:36806909-36807276
  misc_feature 1..367: note = hyper
  source 1..367: mol_type = genomic DNA
gggctcttggcagatcggcaggggcgcagtcctggagaccaggacactctgggaagggggcgcgcggaggtttaggatcgaagcggcaggggccgcggggctctgcgtccagggccggggcaaggggacccggccagcgggaggctcacctgcaggacacggtgatctccaccttggtggccgggatgctgcccgccaaggagtcgaactcgctcagcgacgccatgtcctcaggctgctccatcgcccaccgcaccccccaccccaaattagtcaatccctgcgcgattcacgcctcctccggagcgactggagccctgggctctcccccaactccagagcctgggctgggcggcaaggggaggag

SEQ ID NO: 95554 - DNA, 495 bp, Homo sapiens
  misc_feature 1..495: note = chr6:36808059-36808554
  misc_feature 1..495: note = hyper
  source 1..495: mol_type = genomic DNA
ggttatgggaaccaacgggcgcctttttgagaaaggtctatgcagggttgagagggggcataagtgggagggaggtgtgcaaaaaagatcccctcccaggggcttgggtgtggagggtctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatgggcgcctcccccatccgtggttcccgccagccgcggcctcgccaagtcggctgccgaaaccacgcgccagcgcccttccactcccccgcccgtcgtgaccacacgactgagccagcctccaggtctagaagctcctgccacccagtctggtggcaaccagactgggagatcggcccgagctccctgggcttctatgcagccagcaccgagtaggcgcgtgctgtgtgcctg

SEQ ID NO: 95555 - DNA, 30 bp, Homo sapiens; identical to SEQ ID NO: 14852
  misc_feature 1..30: note = chr6:36831576-36831606
  misc_feature 1..30: note = hypo
  source 1..30: mol_type = genomic DNA

SEQ ID NO: 95556 - DNA, 30 bp, Homo sapiens; identical to SEQ ID NO: 40799
  misc_feature 1..30: note = chr6:36881595-36881625
  misc_feature 1..30: note = hypo
  source 1..30: mol_type = genomic DNA

SEQ ID NO: 95557 - DNA, 30 bp, Homo sapiens
  misc_feature 1..30: note = chr6:36932229-36932259
  misc_feature 1..30: note = hypo
  source 1..30: mol_type = genomic DNA
ttggttaaggccctccggaagggaaaggct

SEQ ID NO: 95558 - DNA, 56 bp, Homo sapiens
  misc_feature 1..56: note = chr6:36949243-36949299
  misc_feature 1..56: note = hypo
  source 1..56: mol_type = genomic DNA
atgccagctcgactgcgtgccatgctgcgcagtgagttccccggggccagctggtc

SEQ ID NO: 95559 - DNA, 46 bp, Homo sapiens; identical to SEQ ID NO: 40801
  misc_feature 1..46: note = chr6:37004177-37004223
  misc_feature 1..46: note = hypo
  source 1..46: mol_type = genomic DNA

SEQ ID NO: 95560 - DNA, 510 bp, Homo sapiens
  misc_feature 1..510: note = chr6:37024139-37024649
  misc_feature 1..510: note = hypo
  source 1..510: mol_type = genomic DNA
tatgggctgctggggcgggggaggtcccagggttttccagattcagctgtcctccctctgcagtctcagggacccagacagggctggctgacaaacaggtcctgcccgggatgggcgtggggctgagcgagcgaaactccttttaggaaggaaatctcggccaggttgagaaaccagcatcttgccaaggcctagggggtgggggagcccaggtgagccgactcagtcctcaggaatgggtggggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctccccgtcctccatggtgt

SEQ ID NO: 95561 - DNA, 68 bp, Homo sapiens
  misc_feature 1..68: note = chr6:37027628-37027696
  misc_feature 1..68: note = hypo
  source 1..68: mol_type = genomic DNA
cttggcccaggaaggcgcccccaggcccagctactgggggaagcaacacttcccggctcctgtgctcc

SEQ ID NO: 95562 - DNA, 79 bp, Homo sapiens
  misc_feature 1..79: note = chr6:37053276-37053355
  misc_feature 1..79: note = hypo
  source 1..79: mol_type = genomic DNA
tgataaaacccctaccgatggctgatgactaaaccaatccgcattaatttaaccagctaccttgggctgggcgcggtgg

SEQ ID NO: 95563 - DNA, 30 bp, Homo sapiens
  misc_feature 1..30: note = chr6:37139199-37139229
  misc_feature 1..30: note = hyper
  source 1..30: mol_type = genomic DNA
cgagctcaagctcatcgacttcgggtcggg

SEQ ID NO: 95564 - DNA, 45 bp, Homo sapiens
  misc_feature 1..45: note = chr6:37275438-37275483
  misc_feature 1..45: note = hypo
  source 1..45: mol_type = genomic DNA
aaaatattacgcaaggtattcttatgagtccggttcaacaacaac

SEQ ID NO: 95565 - DNA, 30 bp, Homo sapiens; identical to SEQ ID NO: 40805
  misc_feature 1..30: note = chr6:37358523-37358553
  misc_feature 1..30: note = hypo
  source 1..30: mol_type = genomic DNA

SEQ ID NO: 95566 - DNA, 180 bp, Homo sapiens; identical to SEQ ID NO: 40806
  misc_feature 1..180: note = chr6:37391410-37391590
  misc_feature 1..180: note = hypo
  source 1..180: mol_type = genomic DNA

SEQ ID NO: 95567 - DNA, 42 bp, Homo sapiens
  misc_feature 1..42: note = chr6:37392290-37392332
  misc_feature 1..42: note = hypo
  source 1..42: mol_type = genomic DNA
gggattacaggtgtgagccaccgcgcccggcctagtaccttt

SEQ ID NO: 95568 - DNA, 132 bp, Homo sapiens
  misc_feature 1..132: note = chr6:3751602-3751734
  misc_feature 1..132: note = hyper
  source 1..132: mol_type = genomic DNA
ggtgcaggtagagcacgctgcggtccgaccactccgtgcggatctcgaagaactcctcttcgtcgccgcgccggctgacgatgagcctgcggatgccgttcacccagcagccgcgcacgaacatgttcacga

SEQ ID NO: 95569 - DNA, 137 bp, Homo sapiens
  misc_feature 1..137: note = chr6:37526552-37526689
  misc_feature 1..137: note = hypo
  source 1..137: mol_type = genomic DNA
ctcgggccggcacaccgtaggtgcccagcatgagtgcgtggacaccactcgtgtctctcaccattgtccctaaaatcaagcccacagtccatggaggcttgccctgccagctcctgaacagccggctgacccactcc

SEQ ID NO: 95570 - DNA, 32 bp, Homo sapiens
  misc_feature 1..32: note = chr6:3752663-3752695
  misc_feature 1..32: note = hyper
  source 1..32: mol_type = genomic DNA
ccctgggaagctggacgcggtgggtgctcttg

SEQ ID NO: 95571 - DNA, 30 bp, Homo sapiens; identical to SEQ ID NO: 40807
  misc_feature 1..30: note = chr6:37557743-37557773
  misc_feature 1..30: note = hypo
  source 1..30: mol_type = genomic DNA

SEQ ID NO: 95572 - DNA, 474 bp, Homo sapiens; identical to SEQ ID NO: 30466
  misc_feature 1..474: note = chr6:37663985-37664459
  misc_feature 1..474: note = hyper
  source 1..474: mol_type = genomic DNA

SEQ ID NO: 95573 - DNA, 760 bp, Homo sapiens
  misc_feature 1..760: note = chr6:37664481-37665241
  misc_feature 1..760: note = hyper
  source 1..760: mol_type = genomic DNA
cgaggttaagccaaggtggagcgggacgcgggctcttaccgtagactccttgtccccggcagtggaaggggatcagcgccagaagtagaaggcaggtcacctccatcttcacggccggtgcttcatccccgcgaggcggcgcagcccgagaggcggcggggggcgcattcgccggggccccgcgacgcccctatgtccccccctttccctgagaggtgagagagagagcggcgacgaagaccaggagactgaagaggcggaggtggcggcgacccgtgtttctcctccggcggggccgctgcccgcgtggggacgcagggggcgctggcccagccccgggtgcctcggcgcgcccggcacagcagccagcgccccgacccgaggagcccggccgccgagccgccccgggtacccagggccgtccgcgcgggatgctaggcgccggggacctctcggcggcggaggcggcgcttcgatccaacaggccacggacgactgacaaacttgtcgtttccccgcactggggccgcccctcagcggagcggagtcggggaggccggggctccgctcgagttaatcaatctgctgtttccagtcctgcggccgctgccgtgggctcagcggcccgactccagggggccgggctgaaagcactcgcggcggcgaagcagccccgggcccggccctcctgatccggggagcagcgcgggctgggttcggccgagggacgagcgccgcgggtccccgggtccgtgaagtt

SEQ ID NO: 95574 - DNA, 470 bp, Homo sapiens
  misc_feature 1..470: note = chr6:37673008-37673478
  misc_feature 1..470: note = hyper
  source 1..470: mol_type = genomic DNA
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctggcgtggacttggaggcgttcagcacacccgcgaccgctgcgtggcataaactacagggggcgccattcacataggatacgacagacatggcgcccgccccctccgcccccccagtacaacgtgggggccctgctgccacgccctcgggtctgacctgac

SEQ ID NO: 95575 - DNA, 30 bp, Homo sapiens
  misc_feature 1..30: note = chr6:37751633-37751663
  misc_feature 1..30: note = hyper
  source 1..30: mol_type = genomic DNA
aggaggaaagctggtcgaaataattattct

SEQ ID NO: 95576 - DNA, 30 bp, Homo sapiens; identical to SEQ ID NO: 40808
  misc_feature 1..30: note = chr6:37776410-37776440
  misc_feature 1..30: note = hypo
  source 1..30: mol_type = genomic DNA

SEQ ID NO: 95577 - DNA, 32 bp, Homo sapiens
  misc_feature 1..32: note = chr6:37776736-37776768
  misc_feature 1..32: note = hypo
  source 1..32: mol_type = genomic DNA
caccagtcttaacctttcgacttcatcctgta

SEQ ID NO: 95578 - DNA, 21 bp, Homo sapiens
  misc_feature 1..21: note = chr6:37791857-37791878
  misc_feature 1..21: note = hypo
  source 1..21: mol_type = genomic DNA
tattaacgtcatatttttagg

SEQ ID NO: 95579 - DNA, 34 bp, Homo sapiens; identical to SEQ ID NO: 40810
  misc_feature 1..34: note = chr6:38018000-38018034
  misc_feature 1..34: note = hypo
  source 1..34: mol_type = genomic DNA

SEQ ID NO: 95580 - DNA, 98 bp, Homo sapiens
  misc_feature 1..98: note = chr6:38101874-38101972
  misc_feature 1..98: note = hypo
  source 1..98: mol_type = genomic DNA
tgttttgttgtgtcccgaatgccacatctagataagatgcttctggaaaaccgggtccacagcatggtcaccttttggtctcccgctgtacctgggta

SEQ ID NO: 95581 - DNA, 30 bp, Homo sapiens; identical to SEQ ID NO: 40811
  misc_feature 1..30: note = chr6:38137726-38137756
  misc_feature 1..30: note = hypo
  source 1..30: mol_type = genomic DNA

SEQ ID NO: 95582 - DNA, 43 bp, Homo sapiens
  misc_feature 1..43: note = chr6:38183138-38183181
  misc_feature 1..43: note = hypo
  source 1..43: mol_type = genomic DNA
ggcaagcttcaatgtcggcctccgggctcgctaagcaaatagt

SEQ ID NO: 95583 - DNA, 30 bp, Homo sapiens
  misc_feature 1..30: note = chr6:382294-382324
  misc_feature 1..30: note = hypo
  source 1..30: mol_type = genomic DNA
cagaatgccggcacgcgctgtgcaatgccc

SEQ ID NO: 95584 - DNA, 30 bp, Homo sapiens; identical to SEQ ID NO: 40813
  misc_feature 1..30: note = chr6:38684078-38684108
  misc_feature 1..30: note = hypo
  source 1..30: mol_type = genomic DNA

SEQ ID NO: 95585 - DNA, 153 bp, Homo sapiens
  misc_feature 1..153: note = chr6:3881645-3881798
  misc_feature 1..153: note = hypo
  source 1..153: mol_type = genomic DNA
tccaggagaaggactcgcagggtcatcttagagtttgcctaattgagttacagattcccactaccttactttttaagtttttaaaacatcatgttaaaatacacaggacataaaatttgccacctttaaccatttggaagtggacggttcagt

SEQ ID NO: 95586 - DNA, 30 bp, Homo sapiens
  misc_feature 1..30: note = chr6:38848809-38848839
  misc_feature 1..30: note = hypo
  source 1..30: mol_type = genomic DNA
acaaaaacaaaaccccgcacaatggatatc

SEQ ID NO: 95587 - DNA, 114 bp, Homo sapiens
  misc_feature 1..114: note = chr6:39016211-39016325
  misc_feature 1..114: note = hyper
  source 1..114: mol_type = genomic DNA
gggaccctgaatgggcgggggttgctgtagctttcctcagctgggagacccgggaggaggtccggggtgccagggtgggaggagggcctggcttgtcgctgaaagccggccagg

SEQ ID NO: 95588 - DNA, 240 bp, Homo sapiens; identical to SEQ ID NO: 30470
  misc_feature 1..240: note = chr6:39016390-39016630
  misc_feature 1..240: note = hyper
  source 1..240: mol_type = genomic DNA

SEQ ID NO: 95589 - DNA, 256 bp, Homo sapiens
  misc_feature 1..256: note = chr6:39016678-39016934
  misc_feature 1..256: note = hyper
  source 1..256: mol_type = genomic DNA
cggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgc

SEQ ID NO: 95590 - DNA, 570 bp, Homo sapiens
  misc_feature 1..570: note = chr6:391173-391743
  misc_feature 1..570: note = hyper
  source 1..570: mol_type = genomic DNA
tctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 95591 - DNA, 20 bp, Homo sapiens
  misc_feature 1..20: note = chr6:391744-391764
  misc_feature 1..20: note = hyper
  source 1..20: mol_type = genomic DNA
cactctcagtttcaccgctc

SEQ ID NO: 95592 - DNA, 135 bp, Homo sapiens; identical to SEQ ID NO: 517
  misc_feature 1..135: note = chr6:391765-391900
  misc_feature 1..135: note = hyper
  source 1..135: mol_type = genomic DNA

SEQ ID NO: 95593 - DNA, 307 bp, Homo sapiens
  misc_feature 1..307: note = chr6:39197084-39197391
  misc_feature 1..307: note = hyper
  source 1..307: mol_type = genomic DNA
gtggggccccactcacgcggcccggggtgggcgaacaccagcggggctgaaagggcgccctggaccgcggatgcgtaaggagcgggaagaacacaggacttgactctgggcagacacgtgggccgcttctccacgcgtcgctcctccgcgcgccactagcagtatgcgccgcgcccgcctccgcacgcctctttaaccagcgcccggcgcgctctgcccccttgctccgggctccgaccggggaggagcccaggcgggccccgccccttccccgcacaagcagcccggcgagcgcaggagtgagcgc

SEQ ID NO: 95594 - DNA, 25 bp, Homo sapiens
  misc_feature 1..25: note = chr6:392409-392434
  misc_feature 1..25: note = hyper
  source 1..25: mol_type = genomic DNA
gctctcccgggcctgctccggggtc

SEQ ID NO: 95595 - DNA, 372 bp, Homo sapiens; identical to SEQ ID NO: 519
  misc_feature 1..372: note = chr6:392587-392959
  misc_feature 1..372: note = hyper
  source 1..372: mol_type = genomic DNA

SEQ ID NO: 95596 - DNA, 911 bp, Homo sapiens
  misc_feature 1..911: note = chr6:39281088-39281999
  misc_feature 1..911: note = hyper
  source 1..911: mol_type = genomic DNA
gcctttctgggcagccgcgcggcggcggcgcgcccagtccttgtgtccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggctcctacggccgcgccctcgctcctgcgcatccttagacccggcgcccctgccgtcccagctcccagttcgcaaacgtgcgcccgggttccccctctggaagcggccaggtgtggcgtttagctctttgccacgggtgcgggtgcgaccaacccccaagcaggctcaaacgcgccctttcccgggtcaggccgggcggggccggttacgcgcgcgccccctgccgtagtcgtcctcgcccccaaatttggatgtgtccccaggcatctgcctcctcaccgggccagcatgccctctcgcccccaagtaggactcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 95597 - DNA, 115 bp, Homo sapiens; identical to SEQ ID NO: 520
  misc_feature 1..115: note = chr6:393124-393239
  misc_feature 1..115: note = hyper
  source 1..115: mol_type = genomic DNA

SEQ ID NO: 95598 - DNA, 233 bp, Homo sapiens; identical to SEQ ID NO: 521
  misc_feature 1..233: note = chr6:393240-393473
  misc_feature 1..233: note = hyper
  source 1..233: mol_type = genomic DNA

SEQ ID NO: 95599 - DNA, 766 bp, Homo sapiens
  misc_feature 1..766: note = chr6:39759800-39760566
  misc_feature 1..766: note = hyper
  source 1..766: mol_type = genomic DNA
gcccagaggaggagccggggagaaacccgctgcccaggtggccacttttgcctctttgacccttccatgtttccaaaacagaaggggccctgagaacgctccctgccaaagtggggaacagctaccctcattgtacgcctcgccctgccggtggcgctctccccccgcctgcgttcggtctgaaagtgtgaaaattacaaatcccaagaaactgcaatcagaagtctacctagggaaaattcagagtaaccttgccataaatatcccgctccaagacgcctgacgtcagagcggggcgggcggacgggcgcgaggccgggcctggaggggcggcagccgcggcttcccggggatagcgcggagcacgcagcagcgagcggagcgcgggcggcggcgccgtacctcgggctgcgggagcgcgggcgccctggggtcctcggagtaagtgcggccggccctggcgctccccgtcttggggcccgggccgcggggagccctctccgctgggctcccacacttctctccctctgctttctttagcatgccccgcggggcttggggaggcagcagctccgcaggctggcggttttgtttctccaaagtgtttgcaggagccgccgaccccggagtgggctcccagggcctgtgtgtgtgtgagttgtgtgtgtgtatgagtgtgattgcgtgtgtctgtactggcacatctggacataggaaatgtctttggaaaactttttaaaaatgttttttgcggctttgaaacctg

SEQ ID NO: 95600 - DNA, 125 bp, Homo sapiens
  misc_feature 1..125: note = chr6:398564-398689
  misc_feature 1..125: note = hypo
  source 1..125: mol_type = genomic DNA
cagttacagagagagcgctccaagtttccttccaaagctgtgcactggctcgtttctccatcagctttggttttccagttggtctccagctcatctttgcctcacaagagcgtgccctgctagtt

SEQ ID NO: 95601 - DNA, 443 bp, Homo sapiens
  misc_feature 1..443: note = chr6:39901919-39902362
  misc_feature 1..443: note = hyper
  source 1..443: mol_type = genomic DNA
ggtccctcccagaagcggtcaagcagataggccgggagctactgggggaaaagggcagtgtgccggggccactcctgccccgggaagctgtggacgcaggcggggtgggctcacctccgaggcagctcgcgcggactccccggggcagggctgggtcaccggagcccctgagctgcagctccgggcgctggacctcagaagccgccgcagcatccgggacagtggccgcgccgccatgaagcctgatacgagcggaaccgcagcccgcttcgggagcacactggccgggcactcgcccccggggtcatcccagcaagggcggggaggggcagggggagggcgggacccgcgcagccaataggcgaggacgcagtcccgcgtggccttgtgggagctgtagtacgctccctgtgcccactttcctgggccggggtagcgctcta

SEQ ID NO: 95602 - DNA, 33 bp, Homo sapiens
  misc_feature 1..33: note = chr6:4020063-4020096
  misc_feature 1..33: note = hypo
  source 1..33: mol_type = genomic DNA
tttatttatttgagacggcgtttttgcttttgt

SEQ ID NO: 95603 - DNA, 33 bp, Homo sapiens
  misc_feature 1..33: note = chr6:4020336-4020369
  misc_feature 1..33: note = hypo
  source 1..33: mol_type = genomic DNA
ggccctaacatttcaaaacgtttggaattcagg

SEQ ID NO: 95604 - DNA, 43 bp, Homo sapiens; identical to SEQ ID NO: 40814
  misc_feature 1..43: note = chr6:40244038-40244081
  misc_feature 1..43: note = hypo
  source 1..43: mol_type = genomic DNA

SEQ ID NO: 95605 - DNA, 195 bp, Homo sapiens
  misc_feature 1..195: note = chr6:40317758-40317953
  misc_feature 1..195: note = hypo
  source 1..195: mol_type = genomic DNA
agggctgaaccacaccgggtcagccctgtgcttggacagtgtctcactccagcagcatatcacagcaaggccgggagaggagaaaagcatcgtgcattcataaaccctttcatgtgccagagtgaatgcaaatgcacacactctcacattcacatgtacacactgacacacacccactctcgtacccacactgac

SEQ ID NO: 95606 - DNA, 35 bp, Homo sapiens
  misc_feature 1..35: note = chr6:40360217-40360252
  misc_feature 1..35: note = hypo
  source 1..35: mol_type = genomic DNA
tgaagtccaggagctcgttgcgcaccaccaccttc

SEQ ID NO: 95607 - DNA, 340 bp, Homo sapiens
  misc_feature 1..340: note = chr6:40554520-40554860
  misc_feature 1..340: note = hyper
  source 1..340: mol_type = genomic DNA
agagaagggggtgtccgcatgagcacctaggatgcggggagtcttcaagagaaaaagaaagggatgcaaagttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 95608 - DNA, 40 bp, Homo sapiens
  misc_feature 1..40: note = chr6:40555175-40555215
  misc_feature 1..40: note = hyper
  source 1..40: mol_type = genomic DNA
gcacactgccccccacgcgcgcgcgcatacgcgcgtaccc

SEQ ID NO: 95609 - DNA, 579 bp, Homo sapiens
  misc_feature 1..579: note = chr6:40555275-40555854
  misc_feature 1..579: note = hyper
  source 1..579: mol_type = genomic DNA
atcacacgctccaatctgggagggagtcgggcgggctgcggagacagcgcagggccagcagtggagaaaacccagcggccagaggcgcccaggaacccggcggccgtgcgcaccgtccccgccgagctctccggcgcggcagcccccagtggcgaaccgcggagctgcaggagccgaaggcagcctctgcgcccgctgccctgcccgctgccgagcgcacccgcttccgagacgaccaacaccgccgcggaaaccagagggattcacggtcctggcaggggtggcgcggggacgcacggtggggcgggagtgggctggggccgcagtcgcggagggaggtgggcaggccgcgagccccggaaccgggagggcggtctccgcggtccagcggcacgggcagcccctgcggaaggcgagccgggcggccagggctgcacctctgcagctggcgacggcgctgccacctcacgtgcctagcgcgccctgcagccgtcagcccgccgcctgctggaggaaaacccgaccgcgccggccctaggctgggagtgggggctggggcgatcgcgcccacccagtcct

SEQ ID NO: 95610 - DNA, 30 bp, Homo sapiens
  misc_feature 1..30: note = chr6:41160377-41160407
  misc_feature 1..30: note = hypo
  source 1..30: mol_type = genomic DNA
tggtctccgcctggccgccctcctccccag

SEQ ID NO: 95611 - DNA, 228 bp, Homo sapiens
  misc_feature 1..228: note = chr6:41337024-41337252
  misc_feature 1..228: note = hyper
  source 1..228: mol_type = genomic DNA
aggcaacaggtgggacggggagccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcccgggccttccggagcaatcttgcctaagcgttcatatttaacg

SEQ ID NO: 95612 - DNA, 338 bp, Homo sapiens
  misc_feature 1..338: note = chr6:41339221-41339559
  misc_feature 1..338: note = hyper
  source 1..338: mol_type = genomic DNA
tgcttccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 95613 - DNA, 426 bp, Homo sapiens
  misc_feature 1..426: note = chr6:41339601-41340027
  misc_feature 1..426: note = hyper
  source 1..426: mol_type = genomic DNA
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgcacattccggaggaggcgcgcg

SEQ ID NO: 95614 - DNA, 897 bp, Homo sapiens
  misc_feature 1..897: note = chr6:41340707-41341604
  misc_feature 1..897: note = hyper
  source 1..897: mol_type = genomic DNA
ggcacattcccagtgcgggcgctcgcagcaccacctcgcctggccgcccccagtcctgacccctttctagcgctggatcggccgggtccggcctccgtgctcgcggggtcgtccgtcggcgctggctagttaagaaaaataaacaacgttccaaatgaaggcgattcctttcaacccaagctccgccgcctgccagagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgccccccaccgggccgggacctccgccagcggtcctcggcgcccttcctgccccctccccccagcggtctcggccccatcccgaaccgccaccctgggatccccagccctcctgcgccctcgaggccaccgggctcctgcgagcaacgcttccctgcggcgaccgcgcgctgggatcactcaacaccaagaaaaaaaaaatgcactgggaacgacagaaacctgccttagcgaactatcctctagtggatcgggcgtggggggctgcttccagataggacccctgctcaccctgcagggtgcggccgggacaactacgggcgccactgcggaaggcctgacctgatccggcacggtgtggccaccgtgggcccacagagggtgaaggggtagcttatgctgagtgggggtgtccacctggacagaccaggcgagcctcgctcctggtgcgggagctagttttccctggatcttccgcggcagagaagcctgcgtccgggaccagcagagtgagccgac

SEQ ID NO: 95615 - DNA, 532 bp, Homo sapiens
  misc_feature 1..532: note = chr6:41341760-41342292
  misc_feature 1..532: note = hyper
  source 1..532: mol_type = genomic DNA
cgggaaggagtcagaaacagtcccgggcgcagagcgaagaaatcctgggacctcggcaagagggcctcaccactggagatggggtagctacgccgtgtggctgggggaggggtggtagggggcgcctagccagttgcaggggcctcgggactttccatggcctcacccctcttctaggacacgtggccagcgtcctccaggccaccactggggatgagggtgctcgagcctcggtgcccagagtgttgggaggagcggcggcgcacccgcttcctccgaattcctgcatcgcaacgctgggccgcaccgaaggcggtaggatgtgccaggcgtaaagctccgattggcttcgagagagtcgggggcaggcgaagacgcggaccacgcgggcttcctgtcctctttattcccagctctttttcgcgggataagcgtgtctgacggcttaagtgcagtctccctgcgtccctgcctgagctttccagctcccaattacttcgcgggattgggagccgagcgctctccctggagc

SEQ ID NO: 95616 - DNA, 923 bp, Homo sapiens
  misc_feature 1..923: note = chr6:41342779-41343702
  misc_feature 1..923: note = hyper
  source 1..923: mol_type = genomic DNA
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctggttggggagcgacgagggggaggtcgggggggaagccagaagagtttgcaaagaaatgcaacccctcttttatctcgctcctaggtctcatttacctggcgagggcctccaggcctggggagggggtgtgagatgagggaagttggggcagagtggtgagatgtcttttatccccttgggacctggtcggcttaaaccgcttctttgaaaatggaacgcgactttcagacaaggcgaacgtggacgccgaggc

SEQ ID NO: 95617 - DNA, 145 bp, Homo sapiens
  misc_feature 1..145: note = chr6:4135160-4135305
  misc_feature 1..145: note = hyper
  source 1..145: mol_type = genomic DNA
cttcaaggccaccaccgtgtttcggttttgttccctatgcacagattcgtgcgggttcccgggaccccagggaggtgcagcgtgcttcttagccgttactctgtacccggccatttcactttatagcatacgtgttctccaagaa

SEQ ID NO: 95618 - DNA, 30 bp, Homo sapiens
  misc_feature 1..30: note = chr6:41395227-41395257
  misc_feature 1..30: note = hyper
  source 1..30: mol_type = genomic DNA
agcgcaaagcgggggcgcctacccccaggc

SEQ ID NO: 95619 - DNA, 557 bp, Homo sapiens
  misc_feature 1..557: note = chr6:41438018-41438575
  misc_feature 1..557: note = hyper
  source 1..557: mol_type = genomic DNA
actgagctgagaaggcggtgagggccaggcattgcattggtcctcgccttctcggggcgccgctccccacgcagtctccctgctcgagctcgggaagaggagacaccttcctttcccaccctggagagtctggtggtccccgagcgccccgccccacccgcgccctcagggacggccagggccgggccgcgcgtcctaggcacccggagcgagctgctaagccggactggacggcgggagccatctgggccagcgcgggggccggggaagttcaaggcccgggcactgcgcagcgccgagggggatgacccgccgtctccggggcgccagcgccggctagttgctcaacctgctggattagtcactcggcgggacccgcgggaccgtcggaaaaacgcgaagggagcgctaacgcgcagtgggagggaaggagaggactgaagagagacgggggaggggagaggaggggtcggctgccaggcctaggtggggtgaatccgcagctgggctgactcaagcggaggagccggaaggacaccccgcgaggcttcggggcg

SEQ ID NO: 95620 - DNA, 235 bp, Homo sapiens
  misc_feature 1..235: note = chr6:41472913-41473148
  misc_feature 1..235: note = hyper
  source 1..235: mol_type = genomic DNA
gcgcggcgcgagggacgcggcatctggaattgcgctgcgctcacggccaaggccgattgtttagtctgcgcggcggggcgggcggcccgcgcggtggccccacatctggagcctcggccagacggccctgctggcggctggccggggtgcgtgtgcatttttaactctgggatttgctgacaagttaagaagtcagaaagtcagtgacggcgggaactggcgaggcgctcaagga

SEQ ID NO: 95621 - DNA, 186 bp, Homo sapiens
  misc_feature 1..186: note = chr6:41605766-41605952
  misc_feature 1..186: note = hyper
  source 1..186: mol_type = genomic DNA
actgagaaacttgatcgcgcccatctttggggcaaagagatttggaggccgcaattattcagacagttccacgaagtggttgaggtttctctctttctcctgattttccagaaacttttgcagagtttggacaggcaaaggaaaacgtgcagcccgcggatctccgggcctcagagagcagggagt

SEQ ID NO: 95622 - DNA, 320 bp, Homo sapiens; identical to SEQ ID NO: 2812
  misc_feature 1..320: note = chr6:41606037-41606357
  misc_feature 1..320: note = hyper
  source 1..320: mol_type = genomic DNA

SEQ ID NO: 95623 - DNA, 95 bp, Homo sapiens; identical to SEQ ID NO: 30490
  misc_feature 1..95: note = chr6:41606527-41606622
  misc_feature 1..95: note = hyper
  source 1..95: mol_type = genomic DNA

SEQ ID NO: 95624 - DNA, 153 bp, Homo sapiens
  misc_feature 1..153: note = chr6:41709830-41709983
  misc_feature 1..153: note = hypo
  source 1..153: mol_type = genomic DNA
gggatggggtgtggtcgggtggctgggagaggattcgagaggaagcccaggaaggaaggccctggagcaagactgactggagccagatgcccgctgggatgcctccaaaccccaaagcattgagcactgagcctcagtcgtccagggcggccg

SEQ ID NO: 95625 - DNA, 35 bp, Homo sapiens; identical to SEQ ID NO: 40816
  misc_feature 1..35: note = chr6:41715572-41715607
  misc_feature 1..35: note = hypo
  source 1..35: mol_type = genomic DNA

SEQ ID NO: 95626 - DNA, 192 bp, Homo sapiens
  misc_feature 1..192: note = chr6:41773568-41773760
  misc_feature 1..192: note = hypo
  source 1..192: mol_type = genomic DNA
ctgagtggagcatggcgaagggcgacactagggcccacttcccggaccacatgactcggaagagggtgtgcagttcacggcagagggaaatgtgctttgaactcggctccttgttctggatgagctccagactccgactaatggaggccctgccgttccagcagaagccctcccgctcgcatgcctcggccc

SEQ ID NO: 95627 - DNA, 37 bp, Homo sapiens
  misc_feature 1..37: note = chr6:41919768-41919805
  misc_feature 1..37: note = hypo
  source 1..37: mol_type = genomic DNA
ggattacaggcatgagccaccacgcccagcctagatc

SEQ ID NO: 95628 - DNA, 20 bp, Homo sapiens
  misc_feature 1..20: note = chr6:42062066-42062086
  misc_feature 1..20: note = hypo
  source 1..20: mol_type = genomic DNA
gcctgagcaacacagcgaca

SEQ ID NO: 95629 - DNA, 23 bp, Homo sapiens
  misc_feature 1..23: note = chr6:42066001-42066024
  misc_feature 1..23: note = hypo
  source 1..23: mol_type = genomic DNA
agccaccgcgcccagccaaggaa

SEQ ID NO: 95630 - DNA, 20 bp, Homo sapiens
  misc_feature 1..20: note = chr6:42076874-42076894
  misc_feature 1..20: note = hypo
  source 1..20: mol_type = genomic DNA
ttaaatagggcagtccggcc

SEQ ID NO: 95631 - DNA, 155 bp, Homo sapiens
  misc_feature 1..155: note = chr6:42090718-42090873
  misc_feature 1..155: note = hypo
  source 1..155: mol_type = genomic DNA
tatgcatcaccctggcgatggcttgattcagactggggagggcaagagagaaccccagaaaacacaaccttgctgccacccactgttctatggacccagctctcagacgcagagggacaggccgggcgcggtggctcacgcccgtaatcccagaa

SEQ ID NO: 95632 - DNA, 61 bp, Homo sapiens
  misc_feature 1..61: note = chr6:42110212-42110273
  misc_feature 1..61: note = hyper
  source 1..61: mol_type = genomic DNA
ggaccttccctccctcgccctgccctgccccggactgaactcagcacggtttccccagggg

SEQ ID NO: 95633 - DNA, 77 bp, Homo sapiens
  misc_feature 1..77: note = chr6:42110870-42110947
  misc_feature 1..77: note = hypo
  source 1..77: mol_type = genomic DNA
gagaatgtgggatgacgaaatcttggcattctgtgtctgtacatcacattgtttttctttttcttttcttttctttt

SEQ ID NO: 95634 - DNA, 90 bp, Homo sapiens
  misc_feature 1..90: note = chr6:42184556-42184646
  misc_feature 1..90: note = hypo
  source 1..90: mol_type = genomic DNA
aaacaaaaacaaaaacggtggtctcaaagtgtagtctgaggacgtctgtggggtctgagacactttcaggggatccgggaaatcaaaact

SEQ ID NO: 95635 - DNA, 176 bp, Homo sapiens; identical to SEQ ID NO: 40822
  misc_feature 1..176: note = chr6:42190336-42190512
  misc_feature 1..176: note = hypo
  source 1..176: mol_type = genomic DNA

SEQ ID NO: 95636 - DNA, 38 bp, Homo sapiens
  misc_feature 1..38: note = chr6:42419139-42419177
  misc_feature 1..38: note = hyper
  source 1..38: mol_type = genomic DNA
gggaacctggcccctcgtccccccgacaagagtgtgct

SEQ ID NO: 95637 - DNA, 41 bp, Homo sapiens
  misc_feature 1..41: note = chr6:42441227-42441268
  misc_feature 1..41: note = hypo
  source 1..41: mol_type = genomic DNA
gatggcgtcttcctccgggcgaatcacgaggtcaggagttt

SEQ ID NO: 95638 - DNA, 30 bp, Homo sapiens
  misc_feature 1..30: note = chr6:42626581-42626611
  misc_feature 1..30: note = hypo
  source 1..30: mol_type = genomic DNA
aaattaatgtcttgacgagtttttcccaac

SEQ ID NO: 95639 - DNA, 30 bp, Homo sapiens
  misc_feature 1..30: note = chr6:42762875-42762905
  misc_feature 1..30: note = hypo
  source 1..30: mol_type = genomic DNA
aacgtgacaaaaagtcgggtgcggtggctc

SEQ ID NO: 95640 - DNA, 35 bp, Homo sapiens
  misc_feature 1..35: note = chr6:4276412-4276447
  misc_feature 1..35: note = hypo
  source 1..35: mol_type = genomic DNA
accaatctggttaatcaacacggttgcacctgctg

SEQ ID NO: 95641 - DNA, 43 bp, Homo sapiens
  misc_feature 1..43: note = chr6:42773440-42773483
  misc_feature 1..43: note = hypo
  source 1..43: mol_type = genomic DNA
aaagaggacaaggaacgggccaggtgcggtggctcacacctgt

SEQ ID NO: 95642 - DNA, 43 bp, Homo sapiens
  misc_feature 1..43: note = chr6:42773723-42773766
  misc_feature 1..43: note = hypo
  source 1..43: mol_type = genomic DNA
agtgagactccatctcaaaaaaaaaaaacgaaggaagaagtag

SEQ ID NO: 95643 - DNA, 224 bp, Homo sapiens; identical to SEQ ID NO: 40824
  misc_feature 1..224: note = chr6:42813314-42813538
  misc_feature 1..224: note = hypo
  source 1..224: mol_type = genomic DNA

SEQ ID NO: 95644 - DNA, 37 bp, Homo sapiens; identical to SEQ ID NO: 40825
  misc_feature 1..37: note = chr6:42846392-42846429
  misc_feature 1..37: note = hypo
  source 1..37: mol_type = genomic DNA

SEQ ID NO: 95645 - DNA, 96 bp, Homo sapiens; identical to SEQ ID NO: 40826
  misc_feature 1..96: note = chr6:42846609-42846705
  misc_feature 1..96: note = hypo
  source 1..96: mol_type = genomic DNA

SEQ ID NO: 95646 - DNA, 28 bp, Homo sapiens
  misc_feature 1..28: note = chr6:42868404-42868432
  misc_feature 1..28: note = hypo
  source 1..28: mol_type = genomic DNA
gagccaccgtgcccggccagcttgattt

SEQ ID NO: 95647 - DNA, 176 bp, Homo sapiens; identical to SEQ ID NO: 30491
  misc_feature 1..176: note = chr6:42879393-42879569
  misc_feature 1..176: note = hyper
  source 1..176: mol_type = genomic DNA

SEQ ID NO: 95648 - DNA, 139 bp, Homo sapiens; identical to SEQ ID NO: 30492
  misc_feature 1..139: note = chr6:42879621-42879760
  misc_feature 1..139: note = hyper
  source 1..139: mol_type = genomic DNA

SEQ ID NO: 95649 - DNA, 38 bp, Homo sapiens
  misc_feature 1..38: note = chr6:42928321-42928359
  misc_feature 1..38: note = hyper
  source 1..38: mol_type = genomic DNA
cctagcccaggattgcgaggcagcgccctccctgcagc

SEQ ID NO: 95650 - DNA, 26 bp, Homo sapiens
  misc_feature 1..26: note = chr6:42951450-42951476
  misc_feature 1..26: note = hypo
  source 1..26: mol_type = genomic DNA
gggattacaggcgtgagacaccgtgc

SEQ ID NO: 95651 - DNA, 37 bp, Homo sapiens
  misc_feature 1..37: note = chr6:43119834-43119871
  misc_feature 1..37: note = hypo
  source 1..37: mol_type = genomic DNA
tcggcctcccaaagtgagccaccgctcaaagacgtga

SEQ ID NO: 95652 - DNA, 30 bp, Homo sapiens
  misc_feature 1..30: note = chr6:43149410-43149440
  misc_feature 1..30: note = hypo
  source 1..30: mol_type = genomic DNA
aaagttttgcggggccgaggaccttctccc

SEQ ID NO: 95653 - DNA, 38 bp, Homo sapiens
  misc_feature 1..38: note = chr6:43193505-43193543
  misc_feature 1..38: note = hypo
  source 1..38: mol_type = genomic DNA
ctggaggatcagcctcgaagtatcgatccagcagggcc

SEQ ID NO: 95654 - DNA, 265 bp, Homo sapiens
  misc_feature 1..265: note = chr6:43211197-43211462
  misc_feature 1..265: note = hyper
  source 1..265: mol_type = genomic DNA
ctgatgctggcggcgcggtgcattgtgggcagctccccgctctgccgctgccgccgccgtcgcccaaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 95655 - DNA, 89 bp, Homo sapiens
  misc_feature 1..89: note = chr6:43211478-43211567
  misc_feature 1..89: note = hyper
  source 1..89: mol_type = genomic DNA
cgggggctccttcgtgggctcagggggctccgcctggctcgcctcccagcgcagccttcttgggctcccctccgcgctgctgtcgccgc

SEQ ID NO: 95656 - DNA, 106 bp, Homo sapiens
  misc_feature 1..106: note = chr6:43215365-43215471
  misc_feature 1..106: note = hyper
  source 1..106: mol_type = genomic DNA
tcctgacctctgagtcgtgtgtgtgtgcgtgtgtgcttggcgcgtgtgcgcacccgcgtgctttagtggggaggctcagttcacgggagtgcggggttggagagga

SEQ ID NO: 95657 - DNA, 438 bp, Homo sapiens; identical to SEQ ID NO: 30494
  misc_feature 1..438: note = chr6:43237245-43237683
  misc_feature 1..438: note = hyper
  source 1..438: mol_type = genomic DNA

SEQ ID NO: 95658 - DNA, 164 bp, Homo sapiens
  misc_feature 1..164: note = chr6:43242769-43242933
  misc_feature 1..164: note = hyper
  source 1..164: mol_type = genomic DNA
tggccactcactaaccggccctcacgcactcacactcacacccacactcacacactctccctccgtagctgcgcgcacttcgcccactctccggaccctgcactagcggccccggccgggagggcacgaggactgcgcagccggacccccgcaggtccccaagc

SEQ ID NO: 95659 - DNA, 42 bp, Homo sapiens; identical to SEQ ID NO: 30496
  misc_feature 1..42: note = chr6:43243433-43243475
  misc_feature 1..42: note = hyper
  source 1..42: mol_type = genomic DNA

SEQ ID NO: 95660 - DNA, 178 bp, Homo sapiens
  misc_feature 1..178: note = chr6:43244096-43244274
  misc_feature 1..178: note = hyper
  source 1..178: mol_type = genomic DNA
cggcgtcggggggtggccccaggcccgggtagaaaagcatgcactgagccccctgcccctagactgcgagtactgtacaaatccaacacttgaaaccgacacgcacacgcgcggcgccgccacgggggtgggacacggacacgcacccacgcgcacacggccgcgcacgggcggggag

SEQ ID NO: 95661 - DNA, 217 bp, Homo sapiens
  misc_feature 1..217: note = chr6:43251405-43251622
  misc_feature 1..217: note = hypo
  source 1..217: mol_type = genomic DNA
agcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgcca

SEQ ID NO: 95662 - DNA, 92 bp, Homo sapiens
  misc_feature 1..92: note = chr6:43276520-43276612
  misc_feature 1..92: note = hyper
  source 1..92: mol_type = genomic DNA
tccagctcatagctccgctccaggcagcgcacgcggcacacagtaggtacgccgctgcggctcagttccgccccctccgcaggctccaccca

SEQ ID NO: 95663 - DNA, 22 bp, Homo sapiens
  misc_feature 1..22: note = chr6:4334950-4334972
  misc_feature 1..22: note = hypo
  source 1..22: mol_type = genomic DNA
gtagacccgagctgttcctatt

SEQ ID NO: 95664 - DNA, 169 bp, Homo sapiens
  misc_feature 1..169: note = chr6:434224-434393
  misc_feature 1..169: note = hypo
  source 1..169: mol_type = genomic DNA
tgtgagccgcaaagtcgggcctgggcttcagccctgctactgcgactctgccgggacaaagggaggcactgatccccacaggccatcccagacactgatacatttttgacttgccagcatcttcgctaccttctctttcattttcctataatcccgtttcctttcacag

SEQ ID NO: 95665 - DNA, 67 bp, Homo sapiens
  misc_feature 1..67: note = chr6:43423602-43423669
  misc_feature 1..67: note = hyper
  source 1..67: mol_type = genomic DNA
ctgccttcgcttgtccgccgctcatcacgcttctcatatagatctatgcacacgcaggcaatcgctc

SEQ ID NO: 95666 - DNA, 206 bp, Homo sapiens
  misc_feature 1..206: note = chr6:43424414-43424620
  misc_feature 1..206: note = hypo
  source 1..206: mol_type = genomic DNA
actgcactccagcttgggggacagagcaaaactccgacccccgcccccccccaaaaaaagacaaggacccagaacataatttctagtttgtgcaggacaacagggcagaggtcaggaacgctagcgcccatctctagtccttcagattgagatttcaccatctttaaattcaaaacatcggaaggagcagtcgctagtcggggcag

SEQ ID NO: 95667 - DNA, 103 bp, Homo sapiens
  misc_feature 1..103: note = chr6:43425406-43425509
  misc_feature 1..103: note = hypo
  source 1..103: mol_type = genomic DNA
cccctttttttttttttttaaacaatgaacatctataacttgttttttgttgttgtttgtttgtttttccttgagattatcactctgtcgcccaggctggagt

SEQ ID NO: 95668 - DNA, 71 bp, Homo sapiens
  misc_feature 1..71: note = chr6:43476085-43476156
  misc_feature 1..71: note = hypo
  source 1..71: mol_type = genomic DNA
acggcaatggcaaggcggctccagcccttaggggtgatgccagggttggcactcagcgttagctccttcaa

SEQ ID NO: 95669 - DNA, 209 bp, Homo sapiens
  misc_feature 1..209: note = chr6:43478536-43478745
  misc_feature 1..209: note = hypo
  source 1..209: mol_type = genomic DNA
tcctcgccaagatggcggcctcatcagggaggccccaggggccacggctgggcagagccagcttgagctgctggggagaagggtaccccatagggtccctagggcaggggagcctcagatagatgcaaggtcctggtgccacaccttctcaggtacgcagggcactgttgacatctgagggtgtgtccgtgccgcgagactggggcagc

SEQ ID NO: 95670 - DNA, 30 bp, Homo sapiens; identical to SEQ ID NO: 14862
  misc_feature 1..30: note = chr6:43486338-43486368
  misc_feature 1..30: note = hypo
  source 1..30: mol_type = genomic DNA

SEQ ID NO: 95671 - DNA, 74 bp, Homo sapiens
  misc_feature 1..74: note = chr6:43612825-43612899
  misc_feature 1..74: note = hyper
  source 1..74: mol_type = genomic DNA
cgctgacctgatggacgccgacagcctcctgctgtctctggagctggcgtccggcagtgggcagggcctcagcc

SEQ ID NO: 95672 - DNA, 312 bp, Homo sapiens
  misc_feature 1..312: note = chr6:43613052-43613364
  misc_feature 1..312: note = hyper
  source 1..312: mol_type = genomic DNA
cgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacggtcaagaggtggttgagggaaagggcggggatggggatgtctcggaatctgaggctagggcggagcctgagagggcggggcaatggacgggcgatgtcccccggagggcggggccttgcgagagcttgttctc

SEQ ID NO: 95673 - DNA, 149 bp, Homo sapiens
  misc_feature 1..149: note = chr6:43639599-43639748
  misc_feature 1..149: note = hypo
  source 1..149: mol_type = genomic DNA
tgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaa

SEQ ID NO: 95674 - DNA, 30 bp, Homo sapiens
  misc_feature 1..30: note = chr6:43706822-43706852
  misc_feature 1..30: note = hypo
  source 1..30: mol_type = genomic DNA
caccttttctgaggacgctgtgcaggccaa

SEQ ID NO: 95675 - DNA, 72 bp, Homo sapiens; identical to SEQ ID NO: 40831
  misc_feature 1..72: note = chr6:43748463-43748535
  misc_feature 1..72: note = hypo
  source 1..72: mol_type = genomic DNA

SEQ ID NO: 95676 - DNA, 30 bp, Homo sapiens
  misc_feature 1..30: note = chr6:43749564-43749594
  misc_feature 1..30: note = hypo
  source 1..30: mol_type = genomic DNA
ggcctgggggctgaccggctgggtgggggt

SEQ ID NO: 95677 - DNA, 30 bp, Homo sapiens
  misc_feature 1..30: note = chr6:43750186-43750216
  misc_feature 1..30: note = hypo
  source 1..30: mol_type = genomic DNA
tgagaagctgaaagccgattccaggtgtgg

SEQ ID NO: 95678 - DNA, 37 bp, Homo sapiens
  misc_feature 1..37: note = chr6:43893966-43894003
  misc_feature 1..37: note = hypo
  source 1..37: mol_type = genomic DNA
tacaggcgtgagccaccgtgcccggcctgaccagctc

SEQ ID NO: 95679 - DNA, 23 bp, Homo sapiens
  misc_feature 1..23: note = chr6:43970452-43970475
  misc_feature 1..23: note = hyper
  source 1..23: mol_type = genomic DNA
gtgcagacgctggcccggatgtc

SEQ ID NO: 95680 - DNA, 73 bp, Homo sapiens
  misc_feature 1..73: note = chr6:44044377-44044450
  misc_feature 1..73: note = hyper
  source 1..73: mol_type = genomic DNA
ccggagcagctgacccgctggcggtgggccaggtcgcggcggggcctggaggcagcaacgtgcggcgcggcat

SEQ ID NO: 95681 - DNA, 100 bp, Homo sapiens
  misc_feature 1..100: note = chr6:44241060-44241160
  misc_feature 1..100: note = hypo
  source 1..100: mol_type = genomic DNA
tggcactgccaagcccgccatgagctgcagcaccgtgttgatgtgagcagtgtgcgggaacgtgtgggccgcatgcagcaagccacgccctgcatctggt

SEQ ID NO: 95682 - DNA, 30 bp, Homo sapiens
  misc_feature 1..30: note = chr6:44250199-44250229
  misc_feature 1..30: note = hypo
  source 1..30: mol_type = genomic DNA
acaagtccagctcctcgaggactgggtggt

SEQ ID NO: 95683 - DNA, 350 bp, Homo sapiens
  misc_feature 1..350: note = chr6:44264917-44265267
  misc_feature 1..350: note = hyper
  source 1..350: mol_type = genomic DNA
gtaacccagggaaaccggcagtgcagtgggaggtagggagatgaggaagcttccgcacccgcgggagggattacagccctcgggtgatgggaacggacggcctttcggagaagcctagggccccagggcttgggaccgctctcctccacgccctacggatgccccactttccccctcttcttcccagtccctcccctcgcctcactcggatccccagccccgggccagacggtttgcagacagtgactgtggtggggaggaggcgcggggcgtcctcgcgtggagggcgtggggtctcccgtgggtacggaccggcgcttccccgccacggaaaacgcaacccaggcaat

SEQ ID NO: 95684 - DNA, 279 bp, Homo sapiens
  misc_feature 1..279: note = chr6:44265528-44265807
  misc_feature 1..279: note = hyper
  source 1..279: mol_type = genomic DNA
gccgctgccgctgcgcgccaggcacgcggcttactcgcgcgcagggtggccaggcccggcctcgggacggttccgtggaagcggccgctttgcgggtagtgggactgtggccttgcgctatgccctgtgcttccgtgggacgtgtctaggaacgggtgggctttctgcgggaggcgggggtcgggcagggctgctggtctggagtgcttgtgctctcttggtagcttttgtgtggcaatggatagggagctggtccaggaaaagcgtctgtggaagaag

SEQ ID NO: 95685 - DNA, 41 bp, Homo sapiens; identical to SEQ ID NO: 14865
  misc_feature 1..41: note = chr6:44437145-44437186
  misc_feature 1..41: note = hypo
  source 1..41: mol_type = genomic DNA

SEQ ID NO: 95686 - DNA, 53 bp, Homo sapiens
  misc_feature 1..53: note = chr6:44443969-44444022
  misc_feature 1..53: note = hypo
  source 1..53: mol_type = genomic DNA
gtaggtgttacaaagcgaggcccagcctgggtctggcacggtgaatcctcctt

SEQ ID NO: 95687 - DNA, 51 bp, Homo sapiens
  misc_feature 1..51: note = chr6:44695868-44695919
  misc_feature 1..51: note = hypo
  source 1..51: mol_type = genomic DNA
ctggggcaatgatggcgtcaggcctgtggaaataagcgccaggtttgaata

SEQ ID NO: 95688 - DNA, 244 bp, Homo sapiens
  misc_feature 1..244: note = chr6:448910-449154
  misc_feature 1..244: note = hypo
  source 1..244: mol_type = genomic DNA
ctgtgagagaacaaacgtgtgttgctgaagcccggagtgcacgcccagcgcgtggtgctcgttaaggcaatcagagcaaagtgacccagcacccttctagagaaatggtttcatatcgaagcttggaagtcaccgagccccctgattttataactgaggaaatggaggcaccccgtgttgggtcccacagctcaccagctcagccagtgttccctgagcctggcgctggcgggccctgggcacc

SEQ ID NO: 95689 - DNA, 30 bp, Homo sapiens
  misc_feature 1..30: note = chr6:45346268-45346298
  misc_feature 1..30: note = hyper
  source 1..30: mol_type = genomic DNA
tccctaccctgacctcgcacagaatctgtt

SEQ ID NO: 95690 - DNA, 520 bp, Homo sapiens
  misc_feature 1..520: note = chr6:45387578-45388098
  misc_feature 1..520: note = hyper
  source 1..520: mol_type = genomic DNA
accaggtgtcatagccggtggcgcagaatcgcttctcggagtcaccgagggtggcagtggcaggcggcggctgtggggcgggaggggcgcggcttggggctagtgtctgtggagggatttggggaagaggcaggaacgtggagagaaacgtgggaaagggaaagaccgacgagggaggcgtggagcagtgcatggaggaagggcaggtaaaaataaagccccaattaggaaggacagagtagtatcccctgaactccatccttacccctcgagagcgcacacctggctaccccgcacccccacctctgctcccgcggtctggcagaccctcagtcccccgcgcatctcttcagcggggcgatcccgagtcacgcaaccacagccccccaagctcatcttgtactcgaaagggctccagagtccgcgactggcaccaggcccccatcttccgtgcccctcatgctctcagagcccttccaggccccttctagggcgcagacccgggcgtgggctcagcgag

SEQ ID NO: 95691 - DNA, 38 bp, Homo sapiens; identical to SEQ ID NO: 30505
  misc_feature 1..38: note = chr6:45388359-45388397
  misc_feature 1..38: note = hyper
  source 1..38: mol_type = genomic DNA

SEQ ID NO: 95692 - DNA, 55 bp, Homo sapiens
  misc_feature 1..55: note = chr6:45388792-45388847
  misc_feature 1..55: note = hyper
  source 1..55: mol_type = genomic DNA
ataaataaacagccacggaagcattttgaattttttagttcgtatttttaatttt

SEQ ID NO: 95693 - DNA, 683 bp, Homo sapiens
  misc_feature 1..683: note = chr6:45390864-45391547
  misc_feature 1..683: note = hyper
  source 1..683: mol_type = genomic DNA
ggggctcagtccctccgcgcaaatccctccctctcccacctgtgcccgctgccaccccgacttcagccctagtccccctgacccgttcagcactcctcatgcctcctgcctggccttgattctcactcactccttcgcgccgtctccctttcccccaggatccccaaagtacccactcttgcactgcgagcggacttgctccaccccgcccctttcccgggggcgaggatccccggcattgtcccctggggctcccgcgtccttccgggacatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcagggggcctg

SEQ ID NO: 95694 - DNA, 16 bp, Homo sapiens
  misc_feature 1..16: note = chr6:45492559-45492575
  misc_feature 1..16: note = hypo
  source 1..16: mol_type = genomic DNA
atggtagaggctgggc

SEQ ID NO: 95695 - DNA, 119 bp, Homo sapiens; identical to SEQ ID NO: 40835
  misc_feature 1..119: note = chr6:45609047-45609166
  misc_feature 1..119: note = hypo
  source 1..119: mol_type = genomic DNA

SEQ ID NO: 95696 - DNA, 265 bp, Homo sapiens
  misc_feature 1..265: note = chr6:45982726-45982991
  misc_feature 1..265: note = hyper
  source 1..265: mol_type = genomic DNA
tttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaac

SEQ ID NO: 95697 - DNA, 468 bp, Homo sapiens
  misc_feature 1..468: note = chr6:45983215-45983683
  misc_feature 1..468: note = hyper
  source 1..468: mol_type = genomic DNA
ccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaatagccggcggctgcagggcggggtcagccgggcggggacgcggcggggacaccccggc

SEQ ID NO: 95698 - DNA, 203 bp, Homo sapiens
  misc_feature 1..203: note = chr6:46138598-46138801
  misc_feature 1..203: note = hyper
  source 1..203: mol_type = genomic DNA
tggaggagactccctcgggcgcgccgcgggtaacggcgggagggtgactggaggaacgcccccggaacgcgcaggagctcacctgcgctcaactctggagcggagcacctgaccgcgccgcttccccgccccgcctcctggcttctattggctgctgcagagatagtcacttctgcctgggttgcccccgaaagccaggctcc

SEQ ID NO: 95699 - DNA, 207 bp, Homo sapiens
  misc_feature 1..207: note = chr6:46161493-46161700
  misc_feature 1..207: note = hypo
  source 1..207: mol_type = genomic DNA
acaacaacaaaaaaacgatgggttgttcaacacaaaggactgactgagaattggacaaattttatgtcatcatataatttggattggtaggtgcaacaaagcgtgagttttgaagtgagtcttggtagtaaactgctgtttggttaacgagctggttcctaggtgagcagtctattgtctcggtaagagaaccgcttctccatttca

SEQ ID NO: 95700 - DNA, 36 bp, Homo sapiens
  misc_feature 1..36: note = chr6:4647938-4647974
  misc_feature 1..36: note = hyper
  source 1..36: mol_type = genomic DNA
aggcacccttggaaccgaagccgcctggggaggcag

SEQ ID NO: 95701 - DNA, 922 bp, Homo sapiens
  misc_feature 1..922: note = chr6:46702603-46703525
  misc_feature 1..922: note = hyper
  source 1..922: mol_type = genomic DNA
aaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacgcgacccaagcgctccaaacccgactgcttctcgccgacagcactgcgagcctccgaccagccgctgtccccctggctgcgggccgagcagctctggcaggcggcgggcgggtgggctgcgcgcgggctgtgtcctgggtccgcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgctcaccagctcctttccgcagacctgatgccgatcagatttactccctgctgaattcaccccccagtcaggccggttttccttgtttcaccgtgttctctgaatacactgaattactccgagcatctatagttggcaatgccctgcgcattttccgcactccgatacactttacac

SEQ ID NO: 95702 - DNA, 16 bp, Homo sapiens
  misc_feature 1..16: note = chr6:46951843-46951859
  misc_feature 1..16: note = hypo
  source 1..16: mol_type = genomic DNA
ggagtcttgctctgtc

SEQ ID NO: 95703 - DNA, 93 bp, Homo sapiens
  misc_feature 1..93: note = chr6:47202360-47202453
  misc_feature 1..93: note = hypo
  source 1..93: mol_type = genomic DNA
tggggggtttaagtgcgtgtgtgaggtctgctgcgatgcccgtacctttggtaataaaggaaccgttcctgctcagcgcggaggagccgctgg

SEQ ID NO: 95704 - DNA, 127 bp, Homo sapiens
  misc_feature 1..127: note = chr6:47539998-47540125
  misc_feature 1..127: note = hypo
  source 1..127: mol_type = genomic DNA
cgcccggatccactgcgatggtgtacaagtgctgggtgacgaattgttctgtatcttgttgtatttacatggtgcgacatttgtcaaacattactgaaatgcatatttaaaacgggttcattttatt

SEQ ID NO: 95705 - DNA, 389 bp, Homo sapiens
  misc_feature 1..389: note = chr6:4775154-4775543
  misc_feature 1..389: note = hyper
  source 1..389: mol_type = genomic DNA
accgcttaaggggaacggcgattcgactcgcagtgacttaagggttggcgtggtgcttgttcctgggcgtggggaggacaggaaaccgcggggtctgtgagacgccccgtggttgttgaaacgctgttggggggcacaaacgaatagggctttaggaagaaaactggtgggaggagccttgtggctccaaggtaggttaggaactggagcgagatggagcacggaggagtgaggcggcccgaaggatgcccggggagacatggaggaactggcgagggcttcccgatgcagggcctgggggagagggtgaactaatgcctctgcagtgccccgtggggaagttccgcatactcggccagagtgatcggagttggcggctgtctggggga

SEQ ID NO: 95706 - DNA, 32 bp, Homo sapiens
  misc_feature 1..32: note = chr6:47924450-47924482
  misc_feature 1..32: note = hypo
  source 1..32: mol_type = genomic DNA
gagccactgctcctggccgagagtatggtttt

SEQ ID NO: 95707 - DNA, 186 bp, Homo sapiens
  misc_feature 1..186: note = chr6:4804538-4804724
  misc_feature 1..186: note = hypo
  source 1..186: mol_type = genomic DNA
agtcatgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggcca

SEQ ID NO: 95708 - DNA, 33 bp, Homo sapiens
  misc_feature 1..33: note = chr6:4836425-4836458
  misc_feature 1..33: note = hypo
  source 1..33: mol_type = genomic DNA
accggagctgttcctattcggccatcttggctc

SEQ ID NO: 95709 - DNA, 273 bp, Homo sapiens
  misc_feature 1..273: note = chr6:4853849-4854122
  misc_feature 1..273: note = hypo
  source 1..273: mol_type = genomic DNA
tttagattactgcatcgagtccctgtctcctgcctttcttctcccaatatccacattcctgtcaggaatatcttttaaaaaggaaacaaaacaaaacaccaggcagctgtcacctttgcgtacaggatagagcccatcaccgtttgtgtggcacactggctcctcacacctgtccccacacctgccccagcttctcctgccatgccacagcacacctgcgtgtgcagaacagcatggcaggcacctcttagctggcctcgtgtgctcccgtgc

SEQ ID NO: 95710 - DNA, 30 bp, Homo sapiens
  misc_feature 1..30: note = chr6:4858773-4858803
  misc_feature 1..30: note = hypo
  source 1..30: mol_type = genomic DNA
agccacgggatcgagcgccaccctggccag

SEQ ID NO: 95711 - DNA, 65 bp, Homo sapiens
  misc_feature 1..65: note = chr6:4874127-4874192
  misc_feature 1..65: note = hypo
  source 1..65: mol_type = genomic DNA
gctcattctggttcccgccttctgcctgtctgtacctgggtacacatgtgcgtgtcttttgagcc

SEQ ID NO: 95712 - DNA, 43 bp, Homo sapiens
  misc_feature 1..43: note = chr6:48951303-48951346
  misc_feature 1..43: note = hypo
  source 1..43: mol_type = genomic DNA
gctggtgggccactccgagtgcggggcccgcaattgcggccag

SEQ ID NO: 95713 - DNA, 89 bp, Homo sapiens
  misc_feature 1..89: note = chr6:49002323-49002412
  misc_feature 1..89: note = hypo
  source 1..89: mol_type = genomic DNA
caaaaaggtgttgcctcagaagtggggaataataagccttataattaatacttctctattgccatttaacaaagcgagacccaaatggc

SEQ ID NO: 95714 - DNA, 83 bp, Homo sapiens
  misc_feature 1..83: note = chr6:4910864-4910947
  misc_feature 1..83: note = hypo
  source 1..83: mol_type = genomic DNA
caaaggctcaaggagcgagcatgtctggttgaggtctgcagaaactatgaagagggaaaaggtgtctccgtgggcctggaagg

SEQ ID NO: 95715 - DNA, 33 bp, Homo sapiens; identical to SEQ ID NO: 40728
  misc_feature 1..33: note = chr6:4920708-4920741
  misc_feature 1..33: note = hypo
  source 1..33: mol_type = genomic DNA

SEQ ID NO: 95716 - DNA, 101 bp, Homo sapiens
  misc_feature 1..101: note = chr6:4931677-4931778
  misc_feature 1..101: note = hypo
  source 1..101: mol_type = genomic DNA
attccaggtcataggcgttctaggcagagggaagaacacatgcaaaggtcctgagatgggcacaaccctgggtgacatgagaaccccgggtgatgtgagaa

SEQ ID NO: 95717 - DNA, 172 bp, Homo sapiens; identical to SEQ ID NO: 40837
  misc_feature 1..172: note = chr6:49464924-49465096
  misc_feature 1..172: note = hypo
  source 1..172: mol_type = genomic DNA

SEQ ID NO: 95718 - DNA, 275 bp, Homo sapiens
  misc_feature 1..275: note = chr6:4951177-4951452
  misc_feature 1..275: note = hypo
  source 1..275: mol_type = genomic DNA
aaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaagtggaagccacctaccgaaattgtgtttta

SEQ ID NO: 95719 - DNA, 424 bp, Homo sapiens
  misc_feature 1..424: note = chr6:49518576-49519000
  misc_feature 1..424: note = hyper
  source 1..424: mol_type = genomic DNA
cagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattat

SEQ ID NO: 95720 - DNA, 20 bp, Homo sapiens
  misc_feature 1..20: note = chr6:49576100-49576120
  misc_feature 1..20: note = hypo
  source 1..20: mol_type = genomic DNA
ctcttttttttgagacggag

SEQ ID NO: 95721 - DNA, 164 bp, Homo sapiens; identical to SEQ ID NO: 40838
  misc_feature 1..164: note = chr6:49590413-49590577
  misc_feature 1..164: note = hypo
  source 1..164: mol_type = genomic DNA

SEQ ID NO: 95722 - DNA, 43 bp, Homo sapiens; identical to SEQ ID NO: 40839
  misc_feature 1..43: note = chr6:49590817-49590860
  misc_feature 1..43: note = hypo
  source 1..43: mol_type = genomic DNA

SEQ ID NO: 95723 - DNA, 26 bp, Homo sapiens
  misc_feature 1..26: note = chr6:50207704-50207730
  misc_feature 1..26: note = hypo
  source 1..26: mol_type = genomic DNA
ggcgagcgaggcgtggagcagtgacg

SEQ ID NO: 95724 - DNA, 197 bp, Homo sapiens
  misc_feature 1..197: note = chr6:5026576-5026773
  misc_feature 1..197: note = hyper
  source 1..197: mol_type = genomic DNA
tgcggagggagggagcgaggagggagggggacagcttagcctcccgcctcccagagcctctcctgaggctcccacccagcgcctttctttccttcctcccttcgtttatttctgggacccctccccacaaactttctttaaagcctggtcacgtgaggtctcctctgaggttttgctctctgcgggtctggacggag

SEQ ID NO: 95725 - DNA, 30 bp, Homo sapiens
  misc_feature 1..30: note = chr6:50352067-50352097
  misc_feature 1..30: note = hypo
  source 1..30: mol_type = genomic DNA
tgcaaattaataccacgatcatataccact

SEQ ID NO: 95726 - DNA, 424 bp, Homo sapiens
  misc_feature 1..424: note = chr6:50674326-50674750
  misc_feature 1..424: note = hyper
  source 1..424: mol_type = genomic DNA
taggccctatggttgcggctcaattcgtgcaacctcagttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactgcaaaagaagcctagaccaggcctccgtctgggtgttttc

SEQ ID NO: 95727 - DNA, 735 bp, Homo sapiens
  misc_feature 1..735: note = chr6:50681604-50682339
  misc_feature 1..735: note = hyper
  source 1..735: mol_type = genomic DNA
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatcttaataataaaaggggggagtgaagagaaagagatagagacggaaagaaagattctcagaaaagcaaagaaaagggactggtggggaagcagtagatgcacaagggggatggggaaaacgcaccccttttggaatgggcttattcaaggaaagggaagcagaaaagagggagtcggattccctccctcgaatgactaaggaagggagcaagttgaacgatttgcacagactggattttttaaaatatatggacaatgattttgagcagcccgggc

SEQ ID NO: 95728 - DNA, 236 bp, Homo sapiens; identical to SEQ ID NO: 2816
  misc_feature 1..236: note = chr6:50682448-50682684
  misc_feature 1..236: note = hyper
  source 1..236: mol_type = genomic DNA

SEQ ID NO: 95729 - DNA, 230 bp, Homo sapiens; identical to SEQ ID NO: 2817
  misc_feature 1..230: note = chr6:50682711-50682941
  misc_feature 1..230: note = hyper
  source 1..230: mol_type = genomic DNA

SEQ ID NO: 95730 - DNA, 366 bp, Homo sapiens
  misc_feature 1..366: note = chr6:50682991-50683357
  misc_feature 1..366: note = hyper
  source 1..366: mol_type = genomic DNA
cgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcaggtaaataagcatgcagcgaatttgtctgctc

SEQ ID NO: 95731 - DNA, 88 bp, Homo sapiens
  misc_feature 1..88: note = chr6:50684010-50684098
  misc_feature 1..88: note = hyper
  source 1..88: mol_type = genomic DNA
acgtgcactcaaaaccgcagcccagttaggtaatttacaagtttatttttgctcttccagccattacattttacgtaaaatgcacctc

SEQ ID NO: 95732 - DNA, 64 bp, Homo sapiens
  misc_feature 1..64: note = chr6:50684905-50684969
  misc_feature 1..64: note = hyper
  source 1..64: mol_type = genomic DNA
catttttcaaaagagcggattagaacatttgcaagcactagacaaagagcgaatcccgtgcaaa

SEQ ID NO: 95733 - DNA, 161 bp, Homo sapiens
  misc_feature 1..161: note = chr6:50689869-50690030
  misc_feature 1..161: note = hyper
  source 1..161: mol_type = genomic DNA
tatttgccactgcctcggaggcgcagctccctgcgtgctgactctcggttaatggtgtacgcgattttgcccgcagctccggctctccaaccatcagaaccaataatctttactttaccctgtgctcgcgtatcgatagcttctttcgcctcgggcgtagg

SEQ ID NO: 95734 - DNA, 178 bp, Homo sapiens
  misc_feature 1..178: note = chr6:50690519-50690697
  misc_feature 1..178: note = hyper
  source 1..178: mol_type = genomic DNA
ctaaaaaggggggggcgggggatgggagaggaaaaaatgaaaaaagtgaagaggggaagcgcccttgtttcgctttgtgatcattctgccttgcagccccaggctaatttcagaagcttaaacactgcggtagcctctgggccacgcgaagagggagcggacccggccatgggcaggc

SEQ ID NO: 95735 - DNA, 30 bp, Homo sapiens
  misc_feature 1..30: note = chr6:50691065-50691095
  misc_feature 1..30: note = hyper
  source 1..30: mol_type = genomic DNA
cagagccttggaatccgggatggagaaagc

SEQ ID NO: 95736 - DNA, 424 bp, Homo sapiens; identical to SEQ ID NO: 30521
  misc_feature 1..424: note = chr6:50691789-50692213
  misc_feature 1..424: note = hyper
  source 1..424: mol_type = genomic DNA

SEQ ID NO: 95737 - DNA, 257 bp, Homo sapiens
  misc_feature 1..257: note = chr6:50692299-50692556
  misc_feature 1..257: note = hyper
  source 1..257: mol_type = genomic DNA
cgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtcttgtcctaccccgcagttcacaccctgcaacggggtagttgtttt

SEQ ID NO: 95738 - DNA, 30 bp, Homo sapiens
  misc_feature 1..30: note = chr6:50786551-50786581
  misc_feature 1..30: note = hyper
  source 1..30: mol_type = genomic DNA
gatcattacagacagcggagtcctgagaag

SEQ ID NO: 95739 - DNA, 713 bp, Homo sapiens
  misc_feature 1..713: note = chr6:50787164-50787877
  misc_feature 1..713: note = hyper
  source 1..713: mol_type = genomic DNA
aggacagagaattagcgggaaagaagtagatggctggagatatggatggatagagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 95740 - DNA, 452 bp, Homo sapiens; identical to SEQ ID NO: 30524
  misc_feature 1..452: note = chr6:50787949-50788401
  misc_feature 1..452: note = hyper
  source 1..452: mol_type = genomic DNA

SEQ ID NO: 95741 - DNA, 205 bp, Homo sapiens
  misc_feature 1..205: note = chr6:50789374-50789579
  misc_feature 1..205: note = hyper
  source 1..205: mol_type = genomic DNA
tctccactgaatgaacgtcatttacaatagtaggggagctctgcgctcgctgctgcttcacgctccatttgtcctctattctccctttaaagtactcgtgtaatattaatagtcatgaatatcaattattatgaggcggtgtaggcaagcggagggaggaaggggcggccgagcagtctgagcccagcttcgggtgaaagaggac

SEQ ID NO: 95742 - DNA, 372 bp, Homo sapiens
  misc_feature 1..372: note = chr6:50791123-50791495
  misc_feature 1..372: note = hyper
  source 1..372: mol_type = genomic DNA
ggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 95743 - DNA, 82 bp, Homo sapiens
  misc_feature 1..82: note = chr6:50791550-50791632
  misc_feature 1..82: note = hyper
  source 1..82: mol_type = genomic DNA
cggccatcccggaatggaagacgtccaggtaaccacaaacaaacaaacaaacaaacaaaaaagaccacgaataaggaatgct

SEQ ID NO: 95744 - DNA, 429 bp, Homo sapiens
  misc_feature 1..429: note = chr6:50793335-50793764
  misc_feature 1..429: note = hyper
  source 1..429: mol_type = genomic DNA
atagtcttgtcaaagcgtcggaaaggatttagtgtttatgtgaacggagcacctcggggccaagttgttgctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccgcggtgatgacagacctcccaaggccagggtgaagttgactgatgcagggcaggtgacaaagaccaggggttatgtttccaggaccacagcctcgaatccgaaggcttccaatc

SEQ ID NO: 95745 - DNA, 192 bp, Homo sapiens
  misc_feature 1..192: note = chr6:50794608-50794800
  misc_feature 1..192: note = hyper
  source 1..192: mol_type = genomic DNA
tgagttgtttttctgcgcttccgcatgcagtcctaattaaatctttacgatcctccctgtgacgattaagcgccagcatgctgcgtgaatatcctgtacaaaaacccagcaggcggccgtaattagatagaaaatcagacaagagccttctcattaactaccacaactaccccacgtcgctgatgaggcgtt

SEQ ID NO: 95746 - DNA, 228 bp, Homo sapiens
  misc_feature 1..228: note = chr6:50798960-50799188
  misc_feature 1..228: note = hyper
  source 1..228: mol_type = genomic DNA
agtagagagagcaaacgagtggagtgaaggtagccagcgtgataaatggctctttcatttgaagatctccagagctcgtttacggctaattttctgtattggccccctttgagctattaatgcaatctgcagggaccgtggcccctctcctcttagctgccccattagagctcccattaagctgcctagtctcaactccatggcgggagtgggcggggggagtaatga

SEQ ID NO: 95747 - DNA, 564 bp, Homo sapiens; identical to SEQ ID NO: 30531
  misc_feature 1..564: note = chr6:50803804-50804368
  misc_feature 1..564: note = hyper
  source 1..564: mol_type = genomic DNA

SEQ ID NO: 95748 - DNA, 108 bp, Homo sapiens
  misc_feature 1..108: note = chr6:50805738-50805846
  misc_feature 1..108: note = hyper
  source 1..108: mol_type = genomic DNA
cggtttgaatttacccgcgggcaggcgcaaagcagcaaatgtcacgttactcacctccctggtggaaggtaagcaagacgtgtggccatttcacgaagtggctgagct

SEQ ID NO: 95749 - DNA, 128 bp, Homo sapiens
  misc_feature 1..128: note = chr6:50808631-50808759
  misc_feature 1..128: note = hyper
  source 1..128: mol_type = genomic DNA
caggcctgcagtgggcggcgctgcgtgcgcccgcacgtttctcttgcaggcgcggcccaaacagccgcgctcatttatttagtgttggaggacgcggtttgtcccgttgacagcgtaatttaaagaaa

SEQ ID NO: 95750 - DNA, 163 bp, Homo sapiens; identical to SEQ ID NO: 30534
  misc_feature 1..163: note = chr6:50810551-50810714
  misc_feature 1..163: note = hyper
  source 1..163: mol_type = genomic DNA

SEQ ID NO: 95751 - DNA, 669 bp, Homo sapiens
  misc_feature 1..669: note = chr6:50810936-50811605
  misc_feature 1..669: note = hyper
  source 1..669: mol_type = genomic DNA
cggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacc

SEQ ID NO: 95752 - DNA, 385 bp, Homo sapiens
  misc_feature 1..385: note = chr6:50811816-50812201
  misc_feature 1..385: note = hyper
  source 1..385: mol_type = genomic DNA
tgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaat

SEQ ID NO: 95753 - DNA, 640 bp, Homo sapiens
  misc_feature 1..640: note = chr6:50813299-50813939
  misc_feature 1..640: note = hyper
  source 1..640: mol_type = genomic DNA
cagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagccca

SEQ ID NO: 95754 - DNA, 30 bp, Homo sapiens; identical to SEQ ID NO: 30538
  misc_feature 1..30: note = chr6:50814569-50814599
  misc_feature 1..30: note = hyper
  source 1..30: mol_type = genomic DNA

SEQ ID NO: 95755 - DNA, 397 bp, Homo sapiens
  misc_feature 1..397: note = chr6:50817023-50817420
  misc_feature 1..397: note = hyper
  source 1..397: mol_type = genomic DNA
gacagccctgggctgcgtgtcacagctccccggcccctttgttacagtgttagcaggctgtagagggagtaaggaaagagcagtagctagaacctctaggtcgttgaccggcccagcgcagggaccctgagaccgccagatccggtgggcggcttacagtggcccagaacgcacccgccggctcgtgttagcgggttaagggcttgattaaaaatagtgctggaaggaagacccgattatttttttatgaagccacattccttttcttcatttgcaaataacagttccgtagggtcccttcccagggaccctgggcgccgaagttaggggccacctgagagttgttggcccggtgggaagtgtcccttcctgagggcgctctcggcttctcagggca

SEQ ID NO: 95756 - DNA, 72 bp, Homo sapiens
  misc_feature 1..72: note = chr6:50817685-50817757
  misc_feature 1..72: note = hyper
  source 1..72: mol_type = genomic DNA
gggtggggtgtggggcgggggggcgcgctctcctcccgttcctctccgccgggatcgcggtatcctagggga

SEQ ID NO: 95757 - DNA, 648 bp, Homo sapiens
  misc_feature 1..648: note = chr6:50818360-50819008
  misc_feature 1..648: note = hyper
  source 1..648: mol_type = genomic DNA
gggcgtaaccccagctgctgtgacgggccagggctcgcagctcgcctgctagagtttgtggcgcgccctcgggatcagggcactggggtttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 95758 - DNA, 153 bp, Homo sapiens
  misc_feature 1..153: note = chr6:50819287-50819440
  misc_feature 1..153: note = hyper
  source 1..153: mol_type = genomic DNA
acactggaaattcagcgtccggactctcgatcagatgccctagagctcagaagcacctgattgcgcggaaggctggtggtggttacttgggcaaagagagtgcgactcgaaactcgagtttctcggatttaggaaatccgatctttagacagt

SEQ ID NO: 95759 - DNA, 30 bp, Homo sapiens
  misc_feature 1..30: note = chr6:508264-508294
  misc_feature 1..30: note = hypo
  source 1..30: mol_type = genomic DNA
tgcatttgttacagtcgaaagacctacact

SEQ ID NO: 95760 - DNA, 30 bp, Homo sapiens
  misc_feature 1..30: note = chr6:5084912-5084942
  misc_feature 1..30: note = hyper
  source 1..30: mol_type = genomic DNA
ctgggcagatgggggcggcggctcctgcct

SEQ ID NO: 95761 - DNA, 692 bp, Homo sapiens
  misc_feature 1..692: note = chr6:5085637-5086329
  misc_feature 1..692: note = hyper
  source 1..692: mol_type = genomic DNA
gctccttccacggcccgaggagttagttaagtctccagaggggcccggttcggcccgagcaagtccaggggcgaacggcgtcatggagcccataggggcgcggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 95762 - DNA, 48 bp, Homo sapiens
  misc_feature 1..48: note = chr6:52102871-52102919
  misc_feature 1..48: note = hypo
  source 1..48: mol_type = genomic DNA
catatcttcccagttcgaggcagggggcactaccgtcccaaggttttc

SEQ ID NO: 95763 - DNA, 88 bp, Homo sapiens; identical to SEQ ID NO: 40842
  misc_feature 1..88: note = chr6:52156845-52156933
  misc_feature 1..88: note = hypo
  source 1..88: mol_type = genomic DNA

SEQ ID NO: 95764 - DNA, 106 bp, Homo sapiens
  misc_feature 1..106: note = chr6:52226691-52226797
  misc_feature 1..106: note = hyper
  source 1..106: mol_type = genomic DNA
tgagggcggttaaggcgtctctgtctcaaactctccggattttttgcagctaccagggactgcgagggtctgcgtcctgggtggaaggaagcggcgtcagtcaact

SEQ ID NO: 95765 - DNA, 125 bp, Homo sapiens
  misc_feature 1..125: note = chr6:52227751-52227876
  misc_feature 1..125: note = hyper
  source 1..125: mol_type = genomic DNA
ttggctggatgggaacgccgcggtggggtgtcggaggtggctggtggggctggaacgctgggaacgtctgtctaggctatgagaacgcagcgccctcggtggaacagggtcgtagataactcgag

SEQ ID NO: 95766 - DNA, 114 bp, Homo sapiens
  misc_feature 1..114: note = chr6:52268175-52268289
  misc_feature 1..114: note = hypo
  source 1..114: mol_type = genomic DNA
ccgccccacggggcacgagtggcgctactacttcttcagcctctttcagaaacacaacgaggtggtcaacgtctggacccatttactggcagccctggccgtcctcttgcgatt

SEQ ID NO: 95767 - DNA, 30 bp, Homo sapiens
  misc_feature 1..30: note = chr6:52344375-52344405
  misc_feature 1..30: note = hypo
  source 1..30: mol_type = genomic DNA
ttttactcctgattgcgtgagagaacatca

SEQ ID NO: 95768 - DNA, 180 bp, Homo sapiens
  misc_feature 1..180: note = chr6:52928858-52929038
  misc_feature 1..180: note = hypo
  source 1..180: mol_type = genomic DNA
agcctgggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtctca

SEQ ID NO: 95769 - DNA, 32 bp, Homo sapiens
  misc_feature 1..32: note = chr6:52929278-52929310
  misc_feature 1..32: note = hypo
  source 1..32: mol_type = genomic DNA
tgggccaccgcgcccagcggatatactgcatt

SEQ ID NO: 95770 - DNA, 102 bp, Homo sapiens
  misc_feature 1..102: note = chr6:53052001-53052103
  misc_feature 1..102: note = hypo
  source 1..102: mol_type = genomic DNA
catttttaaatcacacgctgcagataactgattaagtgctgtcattgctctaacaatgcaatgtacaaaaggatagccaggacacttcgcagggcctcaaga

SEQ ID NO: 95771 - DNA, 30 bp, Homo sapiens
  misc_feature 1..30: note = chr6:53212219-53212249
  misc_feature 1..30: note = hyper
  source 1..30: mol_type = genomic DNA
catctaatgcaaaaccgcctgtttctatct

SEQ ID NO: 95772 - DNA, 1193 bp, Homo sapiens
  misc_feature 1..1193: note = chr6:53212645-53213838
  misc_feature 1..1193: note = hyper
  source 1..1193: mol_type = genomic DNA
ggaacggttgcaagacgcagttcagcaagaacaactcttgctctaggcattgctccgtcgacccgaggtggtggggtgggagagtcttaccggcgtggaaacagtaaaaaggcacttttccttacaactcgcaagacaacacacactctagctcccccggcgcagagcacaaccgcccccccgccgcgcgcctccctcgcagccaaccgctcccgcctctccagggatcaggctcccagaaagggccgccccggtcgcccccgagtccccgccctctcgctttcccaccagcctcatccctccctgagtaccaagggctgccgttgtctggtttcaataaaaactgaagcggtcccgagctagcaggcttccctccgaggggcggacggaaggtccgcagggttaacggaagcggagagaacaggacaaaaaggaaaggccggagagtccccccagcggcgcccggtgcccgcagaccctcgcacaggctcttcgaactcacccgggtttcgccgactccaaagaaagcgcgctccctccgagagcgctcccccggctctcccgccgcgcgctccggcccgcagggcgggaggacccaggcggacagatccatccctccgcgtctggtgtgggcacggtgtcgtgccccgcggcgcctgtcagcgcgcacaggtgggaccgcagcacagagaacgctcccgagcgccctgcctcagcctcggcgtggggcgagccgcccgcgcccgcacccgcacccctttccccgcgcccgaggagccgggctgtaccccggagccggcggagctggaggccgcgggcggagcgcgggttgccccggcagctctttctcggcaccaggtccgagacctaacggcagttctctctgaccgcttcccggccgcgcgctcgcgcgggtgtcatggccgagcggcggcccccgacgaagtttcccggagctgacggctttaccttttagcccaaggggcggcagcagctttgagcagcagcaaggcggcggcggcggagggagcgcgggtggcagccggcgcagaggcggatgtagaaggagacaccggtggctaggacccgcgcgatgggaagaggaaggcgccggctatctacaatcagaacgtgggctgaccgtgacgtcacaatggcgcggccagccaatcgggacccgaaggatgaatcaa

SEQ ID NO: 95773 - DNA, 30 bp, Homo sapiens
  misc_feature 1..30: note = chr6:53214185-53214215
  misc_feature 1..30: note = hyper
  source 1..30: mol_type = genomic DNA
agggttaaatgcccacggagaccgccggag

SEQ ID NO: 95774 - DNA, 30 bp, Homo sapiens
  misc_feature 1..30: note = chr6:53438260-53438290
  misc_feature 1..30: note = hypo
  source 1..30: mol_type = genomic DNA
tgctgctagctctcccgctctgttcctggc

SEQ ID NO: 95775 - DNA, 72 bp, Homo sapiens
  misc_feature 1..72: note = chr6:53517059-53517131
  misc_feature 1..72: note = hyper
  source 1..72: mol_type = genomic DNA
aggctgaagtgcgtgcgcttctggttcatgctggccaggtgtatccaggtgttgaagcggggatcgtatctg

SEQ ID NO: 95776 - DNA, 514 bp, Homo sapiens
  misc_feature 1..514: note = chr6:55443691-55444205
  misc_feature 1..514: note = hyper
  source 1..514: mol_type = genomic DNA
ctggctgtcagtgtgcgcatgagggtggggacaccctgggccgcgaggtggtacctgcgcggggtcgagcgcccctgccactgaatccccgatccagagatgctcccggagaagctgctggtagctgaggcagtgcttcaccgcggatggcacattccccatggcggagcctggggcggcagtcggcgaggggagggagactggaggaggatgaggggcgggcaccgcgctgggaaactgcgccagctcgggagcgcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgactgtatcttaacgtgcccacctactt

SEQ ID NO: 95777 - DNA, 19 bp, Homo sapiens
  misc_feature 1..19: note = chr6:55678574-55678593
  misc_feature 1..19: note = hypo
  source 1..19: mol_type = genomic DNA
acaccgtctcaaaaaaaaa

SEQ ID NO: 95778 - DNA, 433 bp, Homo sapiens
  misc_feature 1..433: note = chr6:56112173-56112606
  misc_feature 1..433: note = hyper
  source 1..433: mol_type = genomic DNA
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccctggaggcggagcccgggagataaggttcgcgctccccacccgccccctttccttggccgaagaccagagggtggattttggatctggatcttgaagggcgaactgctagtgtcgccctggtggaaacactcagttcaaatcctgctagcatcagaaaatgcacgattgaggattgaaaacgagggtgaaggaggaccagggaagcgcgaggagagaggcaa

SEQ ID NO: 95779 - DNA, 41 bp, Homo sapiens
  misc_feature 1..41: note = chr6:56407898-56407939
  misc_feature 1..41: note = hyper
  source 1..41: mol_type = genomic DNA
ggcagaacctggcaccgggagatccgcgaagaaattatttt

SEQ ID NO: 95780 - DNA, 49 bp, Homo sapiens
  misc_feature 1..49: note = chr6:56707974-56708023
  misc_feature 1..49: note = hyper
  source 1..49: mol_type = genomic DNA
ttcccctctccccctcgtaacccccggacagtatcgcagtcagcaagac

SEQ ID NO: 95781 - DNA, 279 bp, Homo sapiens
  misc_feature 1..279: note = chr6:56708790-56709069
  misc_feature 1..279: note = hyper
  source 1..279: mol_type = genomic DNA
cctgagaaacaaagccgcagatcgctccaccgctgtgcgcagccccctgctgaggggccagcggctctccctgggtaagggatgatcggggggagggttggaaatactttcttccacccatctttttggcgtgggaggattcaggtcactctgtgacagcacagggcaaggagggcacgggggtccgcgtctaggggacatcccggggacagggtgaggaggcctctgcaggtggccccgcgcatcagcgcctgacagccgggccgcgcctgcgcctga

SEQ ID NO: 95782 - DNA, 113 bp, Homo sapiens; identical to SEQ ID NO: 30548
  misc_feature 1..113: note = chr6:56716187-56716300
  misc_feature 1..113: note = hyper
  source 1..113: mol_type = genomic DNA

SEQ ID NO: 95783 - DNA, 306 bp, Homo sapiens; identical to SEQ ID NO: 30549
  misc_feature 1..306: note = chr6:56716389-56716695
  misc_feature 1..306: note = hyper
  source 1..306: mol_type = genomic DNA

SEQ ID NO: 95784 - DNA, 1567 bp, Homo sapiens
  misc_feature 1..1567: note = chr6:56818703-56820270
  misc_feature 1..1567: note = hyper
  source 1..1567: mol_type = genomic DNA
gttgggaaagcacatcgcagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatgcctccctttctggagcttgcggtgccagcagcagaagaagacgatggtggcgatggtgcccagcagaagcaacaagaggaagagggcacattggatgctgtagggtctcagcaagacgaggaaagccgcggcgatcatggtgcgggcgaggcgagggcgactcgacggcggggctggagggcggcggcacaggcacccgcgctgggcgcacgccgggacggcgggcacgggtgagcgcggctcagcgcgtcatgcctggcgctcgcggccccgcgcccagcccaatggctgcgcaccccgcgccagccgcgctacgcgagtgatccagggctgcggggagcgcttgccatgactcagcagacagcgacgaggctgcgactcggcggctgggatcctctcccctccctccccaggcgcccccgcccccgtccgtgcgcagcccccgggcgcagccccgccggggacgcggcgagtggggaggagcagcgccgccgccgcggccgcccgggccccgcgcatcgtcctgcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccgggtgagctattgc

SEQ ID NO: 95785 - DNA, 144 bp, Homo sapiens
  misc_feature 1..144: note = chr6:56820756-56820900
  misc_feature 1..144: note = hyper
  source 1..144: mol_type = genomic DNA
gcacggaaggtatagcgagagcgctgcagtgtgcctttctgcggacggccacggccacctggccaggaagcggctgctgcagcagtcattctgcggcatcttgcggccttggcgggcggtgctgtgccgcgttctgctgccccc

SEQ ID NO: 95786 - DNA, 81 bp, Homo sapiens
  misc_feature 1..81: note = chr6:57694608-57694689
  misc_feature 1..81: note = hypo
  source 1..81: mol_type = genomic DNA
ctaaggacaaagaaccgccagtaacaacatgcaggcacacacacatacgcacatactcatatatatcgatatagatataga

SEQ ID NO: 95787 - DNA, 85 bp, Homo sapiens
  misc_feature 1..85: note = chr6:5783294-5783379
  misc_feature 1..85: note = hypo
  source 1..85: mol_type = genomic DNA
agcctccctgcctcacgcctcggggctgactggctctgacgtggttcggctgtgctgttccagcctgggacggagcaccccgctg

SEQ ID NO: 95788 - DNA, 30 bp, Homo sapiens; identical to SEQ ID NO: 40846
  misc_feature 1..30: note = chr6:57979515-57979545
  misc_feature 1..30: note = hypo
  source 1..30: mol_type = genomic DNA

SEQ ID NO: 95789 - DNA, 91 bp, Homo sapiens
  misc_feature 1..91: note = chr6:57985540-57985631
  misc_feature 1..91: note = hypo
  source 1..91: mol_type = genomic DNA
ggtctacactttctgcgatattgaaagcaatatcatactcttcccgcagaatattaggactaatatcacggggtgggtgtacagcttctgc

SEQ ID NO: 95790 - DNA, 98 bp, Homo sapiens
  misc_feature 1..98: note = chr6:58002802-58002900
  misc_feature 1..98: note = hypo
  source 1..98: mol_type = genomic DNA
cactctttgataatgcgagtaatatcatcctatttccccctgaatattaggaacatcacagcgagcgtgtacaccccctgtgatattgggtgtagtat

SEQ ID NO: 95791 - DNA, 92 bp, Homo sapiens
  misc_feature 1..92: note = chr6:58147419-58147511
  misc_feature 1..92: note = hyper
  source 1..92: mol_type = genomic DNA
tggcgtgcagaaaaccgcatctcccgaaatcccagaacgtaaacgtcgcccaggtactcgctctcttgtcattctccgggatgtaaaagact

SEQ ID NO: 95792 - DNA, 218 bp, Homo sapiens
  misc_feature 1..218: note = chr6:58147758-58147976
  misc_feature 1..218: note = hyper
  source 1..218: mol_type = genomic DNA
gggcacaggcccggcggcggagccctgctcccctcccttatcagtaccgcggttagtgctctgctttatggccgcagcaatctcagacactttcggagcgtgttttttttttcttgtcctttcgctccccttttcgggcgccagctttcaaaccagaccaaaggtgtgctttcccccattatctcccagccttctttccttttcgcctctactcaagg

SEQ ID NO: 95793 - DNA, 39 bp, Homo sapiens
  misc_feature 1..39: note = chr6:58148912-58148951
  misc_feature 1..39: note = hyper
  source 1..39: mol_type = genomic DNA
tcttcacgggttgctcggaagctacggaagcaaagtaga

SEQ ID NO: 95794 - DNA, 22 bp, Homo sapiens
  misc_feature 1..22: note = chr6:58149309-58149331
  misc_feature 1..22: note = hyper
  source 1..22: mol_type = genomic DNA
cgatccccgtacgggccacagg

SEQ ID NO: 95795 - DNA, 26 bp, Homo sapiens
  misc_feature 1..26: note = chr6:58180231-58180257
  misc_feature 1..26: note = hyper
  source 1..26: mol_type = genomic DNA
ccgcagccctggagccgggcagtgag

SEQ ID NO: 95796 - DNA, 35 bp, Homo sapiens; identical to SEQ ID NO: 40847
  misc_feature 1..35: note = chr6:58504069-58504104
  misc_feature 1..35: note = hypo
  source 1..35: mol_type = genomic DNA

SEQ ID NO: 95797 - DNA, 185 bp, Homo sapiens
  misc_feature 1..185: note = chr6:5851459-5851644
  misc_feature 1..185: note = hyper
  source 1..185: mol_type = genomic DNA
cgctgcacctcggggcgtgttctcccacccatctgtgctcaggcatcccttccctctcctctggattttgtttaggcctatttgcaatttcttaaaaaaaaaaaaaaatctaataaatagttggagcctgaaagagagctggccaatgaaacgccgcgttggggcattaccgcatcggtgaggcc

SEQ ID NO: 95798 - DNA, 191 bp, Homo sapiens
  misc_feature 1..191: note = chr6:5851645-5851836
  misc_feature 1..191: note = hyper
  source 1..191: mol_type = genomic DNA
cccattggctggcgtgccctgaggcgatggctgcgtttccccggcaccgccccgcgccggtgcccacgcgtcccgggcttcaggggagcacctgggaagcgctgggggtcgcgtgcccttggccggaggcctggtcacccgcaggccctgccatcctcggcttggccgctgctgcccgcgcgcctgtggcg

SEQ ID NO: 95799 - DNA, 148 bp, Homo sapiens
  misc_feature 1..148: note = chr6:58588027-58588175
  misc_feature 1..148: note = hypo
  source 1..148: mol_type = genomic DNA
ggtgtacaccccctgcgatatcgggagtaatatcatcctcttttctcctgaatattaggaataacatcaaagggtggttgtacaccacctacgatattaatagcatcttctctttctgtagacattaggaacaatatcacagtggggg

SEQ ID NO: 95800 - DNA, 181 bp, Homo sapiens; identical to SEQ ID NO: 40731
  misc_feature 1..181: note = chr6:5892797-5892978
  misc_feature 1..181: note = hypo
  source 1..181: mol_type = genomic DNA

SEQ ID NO: 95801 - DNA, 1253 bp, Homo sapiens
  misc_feature 1..1253: note = chr6:5996021-5997274
  misc_feature 1..1253: note = hyper
  source 1..1253: mol_type = genomic DNA
gcctgaagcccactccgtcccactcccaatactcccaccatctcatcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcccttctctccacagtcggagcagaagggcgcctgccttttattttgacaagcaatgggcttagttgtgagcacttgtttgcccccaatatgtagaggaaaagatactgataggaggcggcgtgctacgatggcaaaaatggagaagaccctccctctttatcctggttctcctccttgttaaatagattcgtatttaagataggcacagacattctaatttgaattccaggggttgaactccagttagaatcatcctatttatacgcagaccgaaaataaccattgaaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagcgctccgggcgcagggacgcatgtgttgctgg

SEQ ID NO: 95802 - DNA, 386 bp, Homo sapiens
  misc_feature 1..386: note = chr6:5997513-5997899
  misc_feature 1..386: note = hyper
  source 1..386: mol_type = genomic DNA
caagaaatcagatttcgatttctctgaacccagagacctgcatgcagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgctggagcccttaatggcggttccttcgcaagctgcctctggccaccgcacaggaagaggcgaatcgtggttaggccgagcctgcgaggatcgtggtta

SEQ ID NO: 95803 - DNA, 260 bp, Homo sapiens; identical to SEQ ID NO: 525
  misc_feature 1..260: note = chr6:6003269-6003529
  misc_feature 1..260: note = hyper
  source 1..260: mol_type = genomic DNA

SEQ ID NO: 95804 - DNA, 395 bp, Homo sapiens; identical to SEQ ID NO: 526
  misc_feature 1..395: note = chr6:6004349-6004744
  misc_feature 1..395: note = hyper
  source 1..395: mol_type = genomic DNA

SEQ ID NO: 95805 - DNA, 514 bp, Homo sapiens
  misc_feature 1..514: note = chr6:6004836-6005350
  misc_feature 1..514: note = hyper
  source 1..514: mol_type = genomic DNA
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgttcaaaacgcgtccctcaggcacg

SEQ ID NO: 95806 - DNA, 129 bp, Homo sapiens
  misc_feature 1..129: note = chr6:6006283-6006412
  misc_feature 1..129: note = hyper
  source 1..129: mol_type = genomic DNA
agaaaagtatatctacgtaaatttggctgaattcatcctcttcaatggtaagcatgttaaaatatgtggtctgaagttccctatcactctcgatttgcccaccagccgggtctgcggtgcccgtgcaaa

SEQ ID NO: 95807 - DNA, 996 bp, Homo sapiens
  misc_feature 1..996: note = chr6:6006674-6007670
  misc_feature 1..996: note = hyper
  source 1..996: mol_type = genomic DNA
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtgaaatatatctgccgttcaacttaagtcccatcctacgtttagtcaaaccatttgcgaccgcagacctttaaatagttagtttagagaacgcgggggaaagccaaaaaataggcattgccaacaagttccgggagcgacagagactttatgcactgggaaggcagagggaggagagaaagagagggagcgaggaagagacagaaagagagagagagagagaaagagagagagagagagaggctgaggggggggggagagctgggaatggttcactccattagaagggggcggaggaagtacagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 95808 - DNA, 101 bp, Homo sapiens
  misc_feature 1..101: note = chr6:6007671-6007772
  misc_feature 1..101: note = hyper
  source 1..101: mol_type = genomic DNA
attaattcgaaagcgctcctcggccgcccgccccctgcgcttgcctaccctctttttctccaacccagcagctgagctctgggcgcagcctggagcgcgtg

SEQ ID NO: 95809 - DNA, 617 bp, Homo sapiens
  misc_feature 1..617: note = chr6:6007832-6008449
  misc_feature 1..617: note = hyper
  source 1..617: mol_type = genomic DNA
acgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatttaccaaccaactctcagcgctttaggaaatttccaaggcaagcgctggtgtgcggacttctttctaatcttgatgcgcctcttgggcttatttgttgggctacacacacacgtacccacacgcacacacgtacatcacgtacgcacacgcacacccggacccacacacacctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 95810 - DNA, 863 bp, Homo sapiens
  misc_feature 1..863: note = chr6:6008689-6009552
  misc_feature 1..863: note = hyper
  source 1..863: mol_type = genomic DNA
tagggccaatcttgccgtccccatactcagatatttggagatgcatagacaaagggggagaaaggtgcaaaataacgggggtaggacaggctgtggagggtagggggccgaggggaagctgcgggggtcctactgcagcacttggtgacgtgaggtgtctgcaatgtgcggcccctaactcacgtcccgcgggagcctcagactcccatgcagccttcctggccctgggggcggagtcatgtctccccgcccctggttatgtcaccggcctgcgggcggggcggttgggggctcgccttccggtgtccaggggcacggtggcggccccgggtgtttcctttccccgagctcggaggctccgggaagaaccgaaaacgtgggcggacaaggggtggggcgggggctggtggcgagaggggggcgtttctcggaccctcccccgacgtcttccaatggcagggcgggaggctttccgaggggcggggcctcaggggggttgccacgcggcccggcccacggctccgcccctcgctcggggttccgcgtggggccggcccagctttcccggaccaggccaccagctgcgggcccccaacctcgctcagactcgtgcagagcccaggcttgggagtggcttaaggttttttgccctcaacgtccttgccttcctcctgcttatccacctgggatcttcacagcatcattttctgggatcctctccaacccctcccctgtaactctgagcgtggggcgctggggatgtggagtaggcagggctgagggcctcaatgaagcgggtgaacccacgcgcgtgcgcacagccgcccgcgccgcgccccgggccgatccggttcttgcccttg

SEQ ID NO: 95811 - DNA, 30 bp, Homo sapiens; identical to SEQ ID NO: 14827
  misc_feature 1..30: note = chr6:6045657-6045687
  misc_feature 1..30: note = hypo
  source 1..30: mol_type = genomic DNA

SEQ ID NO: 95812 - DNA, 30 bp, Homo sapiens; identical to SEQ ID NO: 40733
  misc_feature 1..30: note = chr6:6055082-6055112
  misc_feature 1..30: note = hypo
  source 1..30: mol_type = genomic DNA

SEQ ID NO: 95813 - DNA, 40 bp, Homo sapiens
  misc_feature 1..40: note = chr6:6058547-6058587
  misc_feature 1..40: note = hypo
  source 1..40: mol_type = genomic DNA
gggaaaaccccttcccgccctggctcgggctcctggcctc

SEQ ID NO: 95814 - DNA, 216 bp, Homo sapiens
  misc_feature 1..216: note = chr6:6180497-6180713
  misc_feature 1..216: note = hypo
  source 1..216: mol_type = genomic DNA
gtcttccccaactgccgattcttggctgagagcctttctctgtgcccggcagcacccgtccaccctgtgccagagcaattctcacccagcacagtgagggctgccttctgcttttctccccagctgcatgggaaggcagggctgtacatgtatccagctctacacagcactggaagatggcagatggtaagagccagctgtcgtgtggatgtatgt

SEQ ID NO: 95815 - DNA, 30 bp, Homo sapiens
  misc_feature 1..30: note = chr6:6199350-6199380
  misc_feature 1..30: note = hypo
  source 1..30: mol_type = genomic DNA
aacacttccttagtgcgaagtggtgttcta

SEQ ID NO: 95816 - DNA, 30 bp, Homo sapiens
  misc_feature 1..30: note = chr6:62692207-62692237
  misc_feature 1..30: note = hypo
  source 1..30: mol_type = genomic DNA
tccctctgagacccacggaaatgactataa

SEQ ID NO: 95817 - DNA, 27 bp, Homo sapiens
  misc_feature 1..27: note = chr6:62849167-62849194
  misc_feature 1..27: note = hypo
  source 1..27: mol_type = genomic DNA
ttcatatgggccaggcgcagtggctca

SEQ ID NO: 95818 - DNA, 519 bp, Homo sapiens
  misc_feature 1..519: note = chr6:62995356-62995875
  misc_feature 1..519: note = hyper
  source 1..519: mol_type = genomic DNA
taaaaataaaaataccgatctgtagctacgaagctcttagaacactacattgatcaccatttacttccaaactgctttcccttccctctgcgaagtgaaaatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccc

SEQ ID NO: 95819 - DNA, 53 bp, Homo sapiens; identical to SEQ ID NO: 561
  misc_feature 1..53: note = chr6:62996077-62996130
  misc_feature 1..53: note = hyper
  source 1..53: mol_type = genomic DNA

SEQ ID NO: 95820 - DNA, 83 bp, Homo sapiens; identical to SEQ ID NO: 562
  misc_feature 1..83: note = chr6:62996131-62996214
  misc_feature 1..83: note = hyper
  source 1..83: mol_type = genomic DNA

SEQ ID NO: 95821 - DNA, 496 bp, Homo sapiens
  misc_feature 1..496: note = chr6:62996215-62996711
  misc_feature 1..496: note = hyper
  source 1..496: mol_type = genomic DNA
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtatttccgatgacctacatctcagggacgcagtaggatgttcattgataaacaaataaagcggctcgaagaaata

SEQ ID NO: 95822 - DNA, 30 bp, Homo sapiens
  misc_feature 1..30: note = chr6:63080264-63080294
  misc_feature 1..30: note = hypo
  source 1..30: mol_type = genomic DNA
ccggacacattttggcgacccagaggggac

SEQ ID NO: 95823 - DNA, 37 bp, Homo sapiens; identical to SEQ ID NO: 14828
  misc_feature 1..37: note = chr6:6367079-6367116
  misc_feature 1..37: note = hypo
  source 1..37: mol_type = genomic DNA

SEQ ID NO: 95824 - DNA, 83 bp, Homo sapiens
  misc_feature 1..83: note = chr6:63983649-63983732
  misc_feature 1..83: note = hypo
  source 1..83: mol_type = genomic DNA
tatttaatagaatctcggagggccagaaaatcaggttcagaagaacaggcttgactgttccagagacccgacagccactggca

SEQ ID NO: 95825 - DNA, 155 bp, Homo sapiens
  misc_feature 1..155: note = chr6:64150663-64150818
  misc_feature 1..155: note = hypo
  source 1..155: mol_type = genomic DNA
cgtcaccatgaccaacgcagatagcgagggcggaaacctccgccaccagctggacagcaacaaacaggacctgagcctcagcaacctggatgaagacccggtcaaggagctggctgcccttccaaagactaccacactggatctgtcttgtaata

SEQ ID NO: 95826 - DNA, 68 bp, Homo sapiens
  misc_feature 1..68: note = chr6:64734852-64734920
  misc_feature 1..68: note = hypo
  source 1..68: mol_type = genomic DNA
gggactttcgcctatcgcccagtggtatgacaatcaccatgtggtgagaccatcgcctattgccgagc

SEQ ID NO: 95827 - DNA, 34 bp, Homo sapiens
  misc_feature 1..34: note = chr6:64921720-64921754
  misc_feature 1..34: note = hypo
  source 1..34: mol_type = genomic DNA
tagtttggccaggtacggtggctcacacctgtaa

SEQ ID NO: 95828 - DNA, 180 bp, Homo sapiens
  misc_feature 1..180: note = chr6:6534755-6534935
  misc_feature 1..180: note = hypo
  source 1..180: mol_type = genomic DNA
ggagaggccctggagcgcctgcaaaccccgtgggacccaggcgtccaggcaccgcgcccaggagagccagctctgagcatccccggggggccactccttctgccaggagcctgaaacccaaacgcgagagatcaggacccccgagtgcagcctcttcccaccacccgaaccatcatggct

SEQ ID NO: 95829 - DNA, 702 bp, Homo sapiens
  misc_feature 1..702: note = chr6:6546520-6547222
  misc_feature 1..702: note = hyper
  source 1..702: mol_type = genomic DNA
ctggcaggaaccagccgcagtgaagccaccgcaaccgcagccgcagccgcggaggggaggccgtgcacccgcccgccgggagagccgcgcgcctgagccgggcgcacgtgggaagtgggccacgagactggagtccaccgagatggaggccccggcactcgggctcaggcctttgtgcttagcacgtactgttggaatccagcacgccctgctccggcgggcgcctccgatcctgaagcgcgcacctgggaactcacgcaccgcccagccgcgaggggcttggcctggctgaaagccacattattctcgaaaacaaccgtgggaagcacacgctgagctcccggggcccctagagtatgcaaagaggccggccctgcgagactaaataagtctctccccctaggacctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 95830 - DNA, 71 bp, Homo sapiens
  misc_feature 1..71: note = chr6:6720969-6721040
  misc_feature 1..71: note = hypo
  source 1..71: mol_type = genomic DNA
catccgtgtgcaaaacggcattatgtacaatagctgaaggatggaggcaactcaagcgtccatcaacaaca

SEQ ID NO: 95831 - DNA, 30 bp, Homo sapiens
  misc_feature 1..30: note = chr6:6745438-6745468
  misc_feature 1..30: note = hypo
  source 1..30: mol_type = genomic DNA
caaaagaacagaactcgcacaatataaaca

SEQ ID NO: 95832 - DNA, 198 bp, Homo sapiens; identical to SEQ ID NO: 40736
  misc_feature 1..198: note = chr6:6891420-6891618
  misc_feature 1..198: note = hypo
  source 1..198: mol_type = genomic DNA

SEQ ID NO: 95833 - DNA, 30 bp, Homo sapiens
  misc_feature 1..30: note = chr6:6921408-6921438
  misc_feature 1..30: note = hypo
  source 1..30: mol_type = genomic DNA
acaggtgagccagtccgtgccaacgtttac

SEQ ID NO: 95834 - DNA, 326 bp, Homo sapiens; identical to SEQ ID NO: 30560
  misc_feature 1..326: note = chr6:69344323-69344649
  misc_feature 1..326: note = hyper
  source 1..326: mol_type = genomic DNA

SEQ ID NO: 95835 - DNA, 1099 bp, Homo sapiens
  misc_feature 1..1099: note = chr6:69344943-69346042
  misc_feature 1..1099: note = hyper
  source 1..1099: mol_type = genomic DNA
tctctctcacacacccgcccgcgcccccggcaggcagaactccaggaagtcgcagcggccgcgccgcgcgagccgagcctctggcgggcggcggggcgcaccgcagctgtgcataagaagggcgcgcggcacccgggacgcgcgcgcacacgagcacgcgggaggccgccgcgcggacgcgctcccgggacacgcgcaccccccgcgcgcgcgcccaagggagagcgagcactgcgcgccggcgcgcacacccgagacagagctttactatctcgctccctctcgcgcctccctcctcgctgggcattcaaacagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggtaaggaagggggtccaggggtcaccttttctctgccgggggtcgccaccgtggagctttgggcttaatgtttgagaagggaggaaaatgaaaggaaaggctgttgctggcggatggggaggctgtgagcagatccgactgtctgcattt

SEQ ID NO: 95836 - DNA, 370 bp, Homo sapiens; identical to SEQ ID NO: 30563
  misc_feature 1..370: note = chr6:69942843-69943213
  misc_feature 1..370: note = hyper
  source 1..370: mol_type = genomic DNA

SEQ ID NO: 95837 - DNA, 38 bp, Homo sapiens
  misc_feature 1..38: note = chr6:70310230-70310268
  misc_feature 1..38: note = hypo
  source 1..38: mol_type = genomic DNA
gcaaggcaagctgggcgtggtggctcatgcctgtaatc

SEQ ID NO: 95838 - DNA, 73 bp, Homo sapiens
  misc_feature 1..73: note = chr6:7051765-7051838
  misc_feature 1..73: note = hyper
  source 1..73: mol_type = genomic DNA
gggcgctgcatccgccttccgagatgctggcagcccgggacggcctagcgcggccctctccttatttatccac

SEQ ID NO: 95839 - DNA, 48 bp, Homo sapiens
  misc_feature 1..48: note = chr6:7051873-7051921
  misc_feature 1..48: note = hyper
  source 1..48: mol_type = genomic DNA
cgcccccttcctcgcgcggagcccagcggcagtcgagggcctggctgg

SEQ ID NO: 95840 - DNA, 38 bp, Homo sapiens; identical to SEQ ID NO: 30564
  misc_feature 1..38: note = chr6:70576959-70576997
  misc_feature 1..38: note = hyper
  source 1..38: mol_type = genomic DNA

SEQ ID NO: 95841 - DNA, 344 bp, Homo sapiens
  misc_feature 1..344: note = chr6:70577295-70577639
  misc_feature 1..344: note = hyper
  source 1..344: mol_type = genomic DNA
ccggaacgtcccagtcgcggcgcgaggaagacgcggccccagcctctgccgcctccgctgtcagagtcccgaggccaccgccgagagcgcgccggcgccgcagccacagcggccgagaaccaggaggcggcgccgggcggcccagctagggcgctgcagggtcgcgaggaagtttgttggcccggaaccaagcacgccgtcgggcacgctagctccccgagagcaggcgggcgcgtaagcgaacccccttagaggttacggagggagcgggaagccggcaagagggtgggcagaggagctgggggacaggcgggtgccacaggagcccccgaggagcttcattt

SEQ ID NO: 95842 - DNA, 86 bp, Homo sapiens; identical to SEQ ID NO: 30566
  misc_feature 1..86: note = chr6:70991963-70992049
  misc_feature 1..86: note = hyper
  source 1..86: mol_type = genomic DNA

SEQ ID NO: 95843 - DNA, 985 bp, Homo sapiens
  misc_feature 1..985: note = chr6:70992136-70993121
  misc_feature 1..985: note = hyper
  source 1..985: mol_type = genomic DNA
cgtcccggagccgccagcaccgctagctggactcggggttagtgcagctacggcgggctggaggagcgggagagggagcgtgcctggattcccgccttttccagcaaggcctgctgttgacagtgaccaggaggtggggcgggggagggggtgaggtgcgggaagtaagaagcaataacaggctaagaattaaacctcggtctccagtcacctattaccttcagcgccagagcctgcagtagggaggacccagattggggaggagccccccttcctagaccaaggggtcatctacggctctggacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctccatcccatccaccccagtgcagcttctggctgtcctcggagacttcccgggtggcctgtgcc

SEQ ID NO: 95844 - DNA, 30 bp, Homo sapiens
  misc_feature 1..30: note = chr6:710606-710636
  misc_feature 1..30: note = hyper
  source 1..30: mol_type = genomic DNA
ataaaggcaggactgcgagtcaaacccggg

SEQ ID NO: 95845 - DNA, 257 bp, Homo sapiens
  misc_feature 1..257: note = chr6:711053-711310
  misc_feature 1..257: note = hyper
  source 1..257: mol_type = genomic DNA
tccagtggcatttcccgtcttacacgatgagcttcatccacgttctccataaccccctccccgccacgggaagcgtcagccacctggaacagccctattctgctcggttgtaaaaagcgtcaggcgcttttgatttgaaaagcgttaggcctgggaatcgctgttgctccctcggtgggcacgccctgctgacacgccctagcccaccggggaagccactggccacgagggagcgaggcgcacgggtgtcttccctc

SEQ ID NO: 95846 - DNA, 84 bp, Homo sapiens
  misc_feature 1..84: note = chr6:7120320-7120404
  misc_feature 1..84: note = hypo
  source 1..84: mol_type = genomic DNA
cccacccccaccccccgcccgccttttttagctatttctttacttgcactgtgttttagttgattaaaaattatgtacctaggc

SEQ ID NO: 95847 - DNA, 30 bp, Homo sapiens
  misc_feature 1..30: note = chr6:71277663-71277693
  misc_feature 1..30: note = hypo
  source 1..30: mol_type = genomic DNA
aggcgtgagccaccgcgcccggtccgcaaa

SEQ ID NO: 95848 - DNA, 30 bp, Homo sapiens; identical to SEQ ID NO: 40737
  misc_feature 1..30: note = chr6:7132823-7132853
  misc_feature 1..30: note = hypo
  source 1..30: mol_type = genomic DNA

SEQ ID NO: 95849 - DNA, 107 bp, Homo sapiens
  misc_feature 1..107: note = chr6:71589506-71589613
  misc_feature 1..107: note = hypo
  source 1..107: mol_type = genomic DNA
aagtacacgtgatggcgggattgtgagatgggacagcaagccactgaagctgagtgcacagagaacacaaggaaaataacttgagcgaggctcgggggtggggatgc

SEQ ID NO: 95850 - DNA, 217 bp, Homo sapiens
  misc_feature 1..217: note = chr6:71665506-71665723
  misc_feature 1..217: note = hyper
  source 1..217: mol_type = genomic DNA
ccctcgcccacccagcggggcaggctggcctttacctcctggaagagctccagactataggtgttgtcgtcgtcagcgaagaagagcacgccgggctgcgcgcgctggtgctggtgcctctggcgcagccaggcgaggcccgcgttgcgctgctcagtggcgcgcggcagcccgggccgcttgtagcgccgcggcgtgggcacgtgcaggtgagtgc

SEQ ID NO: 95851 - DNA, 736 bp, Homo sapiens
  misc_feature 1..736: note = chr6:71665945-71666681
  misc_feature 1..736: note = hyper
  source 1..736: mol_type = genomic DNA
tcccgtgagccgggccgcccctgcggagcgggagtcgggcgcccccgcggcccaccgcgtagggagagaagtaggggcgcggggtgagcgggggcactggcctgcgcgtgtccacgtcgagcatgatgatgacaattaggatccagggcaggaggataaagaagcgggtgaaaagcgcggacttcatggtgcacgctccctggcctctcggacaccccagagaggggcgagccgagggaccccagtgcgcagcttggacagcggcggcgccagcacttagggagtggtgatgggtgcgctgtccatggggccgagggcgctgcagagacctggagccgcggggctcactacctgggcgtggaggagcggcaggttcgcgcaagctagagcgacaaggggtgcaggcgggcgggcaggggctgcccccgactccaggtgagctggcgggaagcgggactcggtccagccgcgcgccgccggtcccggagttgtgccgagtgcgggaaaggcgctgatccccaccgcgctctttctgaagagtggaagccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcc

SEQ ID NO: 95852 - DNA, 288 bp, Homo sapiens
  misc_feature 1..288: note = chr6:71666698-71666986
  misc_feature 1..288: note = hyper
  source 1..288: mol_type = genomic DNA
cgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggtggaggagc

SEQ ID NO: 95853 - DNA, 30 bp, Homo sapiens
  misc_feature 1..30: note = chr6:71868836-71868866
  misc_feature 1..30: note = hypo
  source 1..30: mol_type = genomic DNA
acgcatgtgctaccacgcccgacctcatct

SEQ ID NO: 95854 - DNA, 22 bp, Homo sapiens
  misc_feature 1..22: note = chr6:71955640-71955662
  misc_feature 1..22: note = hypo
  source 1..22: mol_type = genomic DNA
atttgtgtctgtgcccgctacg

SEQ ID NO: 95855 - DNA, 184 bp, Homo sapiens
  misc_feature 1..184: note = chr6:7204204-7204388
  misc_feature 1..184: note = hypo
  source 1..184: mol_type = genomic DNA
ggtggctgcagtgtccggtgcatttcaccaggagcatcctgcgagccctgggagctgcctggctgacggcattcccacagcgagcctacagactgtgggtttacacttcatgccaggctgactttagatttttctaagggctggctttggaggtcagcacaggtgcttacgcattgtctaacct

SEQ ID NO: 95856 - DNA, 30 bp, Homo sapiens
  misc_feature 1..30: note = chr6:7204910-7204940
  misc_feature 1..30: note = hypo
  source 1..30: mol_type = genomic DNA
gagtgactttccttacggtaccattcactc

SEQ ID NO: 95857 - DNA, 118 bp, Homo sapiens; identical to SEQ ID NO: 30572
  misc_feature 1..118: note = chr6:72129732-72129850
  misc_feature 1..118: note = hyper
  source 1..118: mol_type = genomic DNA

SEQ ID NO: 95858 - DNA, 119 bp, Homo sapiens; identical to SEQ ID NO: 30573
  misc_feature 1..119: note = chr6:72129926-72130045
  misc_feature 1..119: note = hyper
  source 1..119: mol_type = genomic DNA

SEQ ID NO: 95859 - DNA, 309 bp, Homo sapiens
  misc_feature 1..309: note = chr6:72130190-72130499
  misc_feature 1..309: note = hyper
  source 1..309: mol_type = genomic DNA
cgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagaccccaattggctaggagcccttccctccgcagcggctcg

SEQ ID NO: 95860 - DNA, 27 bp, Homo sapiens
  misc_feature 1..27: note = chr6:7237769-7237796
  misc_feature 1..27: note = hypo
  source 1..27: mol_type = genomic DNA
tttaagcgctcgcgttggggcttgcag

SEQ ID NO: 95861 - DNA, 100 bp, Homo sapiens
  misc_feature 1..100: note = chr6:72596035-72596135
  misc_feature 1..100: note = hyper
  source 1..100: mol_type = genomic DNA
gcgaggtgctgtgcacgttggcgactgtaggggtagcggccggggcacgcgtggctcggacccggggagtgggcgggtgggtgcccgtgggcggagcggc

SEQ ID NO: 95862 - DNA, 179 bp, Homo sapiens
  misc_feature 1..179: note = chr6:72596136-72596315
  misc_feature 1..179: note = hyper
  source 1..179: mol_type = genomic DNA
ccgggactgagtggctggcagctatgtctgcgagagcagcggcatcaccctggatggaagcctctgagactccgcctaactgacacccaaactctccctctccctcccgcagccccaaattggaggcagcagagcctgggagcagcctccacggcggcagcggccgccccagtcccagc

SEQ ID NO: 95863 - DNA, 543 bp, Homo sapiens
  misc_feature 1..543: note = chr6:72596541-72597084
  misc_feature 1..543: note = hyper
  source 1..543: mol_type = genomic DNA
gaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtaagccagccccagccgcgccatccatgcctccgtgcctccatccgtccattcaccactcactcccctagtcctcgcggctgagtgtggggaaggggctgccagggtgctgggtgcggacggaggcgcccgccttgggccaggggcgcggggcttgagcagggaagaggtcaggggaccggaggagggagggg

SEQ ID NO: 95864 - DNA, 38 bp, Homo sapiens
  misc_feature 1..38: note = chr6:7279451-7279489
  misc_feature 1..38: note = hypo
  source 1..38: mol_type = genomic DNA
aatctatcttggggccgggtgcggtggctcacgcctgt

SEQ ID NO: 95865 - DNA, 30 bp, Homo sapiens
  misc_feature 1..30: note = chr6:72806875-72806905
  misc_feature 1..30: note = hypo
  source 1..30: mol_type = genomic DNA
catgaacataaggggcgttgtgaatgtgga

SEQ ID NO: 95866 - DNA, 30 bp, Homo sapiens
  misc_feature 1..30: note = chr6:73063627-73063657
  misc_feature 1..30: note = hypo
  source 1..30: mol_type = genomic DNA
aacccaggctttggccgggcacggtggctc

SEQ ID NO: 95867 - DNA, 342 bp, Homo sapiens; identical to SEQ ID NO: 30579
  misc_feature 1..342: note = chr6:73329784-73330126
  misc_feature 1..342: note = hyper
  source 1..342: mol_type = genomic DNA

SEQ ID NO: 95868 - DNA, 494 bp, Homo sapiens; identical to SEQ ID NO: 30580
  misc_feature 1..494: note = chr6:73330620-73331114
  misc_feature 1..494: note = hyper
  source 1..494: mol_type = genomic DNA

SEQ ID NO: 95869 - DNA, 123 bp, Homo sapiens; identical to SEQ ID NO: 566
  misc_feature 1..123: note = chr6:73331115-73331238
  misc_feature 1..123: note = hyper
  source 1..123: mol_type = genomic DNA

SEQ ID NO: 95870 - DNA, 612 bp, Homo sapiens; identical to SEQ ID NO: 30582
  misc_feature 1..612: note = chr6:73331239-73331851
  misc_feature 1..612: note = hyper
  source 1..612: mol_type = genomic DNA

SEQ ID NO: 95871 - DNA, 1216 bp, Homo sapiens; identical to SEQ ID NO: 30583
  misc_feature 1..1216: note = chr6:73331875-73333091
  misc_feature 1..1216: note = hyper
  source 1..1216: mol_type = genomic DNA

SEQ ID NO: 95872 - DNA, 28 bp, Homo sapiens
  misc_feature 1..28: note = chr6:736009-736037
  misc_feature 1..28: note = hypo
  source 1..28: mol_type = genomic DNA
aacgtattagctggccgggcgtgatggc

SEQ ID NO: 95873 - DNA, 126 bp, Homo sapiens
  misc_feature 1..126: note = chr6:736749-736875
  misc_feature 1..126: note = hypo
  source 1..126: mol_type = genomic DNA
gtcatggaaagagtacgccccgtgtacccaccacgcaactgaacagtaacacggcacggggagcgtgggaggctccggcttgtttctccgcccctgtgtttccgcctaactcgaaggagccactgc

SEQ ID NO: 95874 - DNA, 179 bp, Homo sapiens; identical to SEQ ID NO: 40850
  misc_feature 1..179: note = chr6:73764839-73765018
  misc_feature 1..179: note = hypo
  source 1..179: mol_type = genomic DNA

SEQ ID NO: 95875 - DNA, 489 bp, Homo sapiens
  misc_feature 1..489: note = chr6:73972632-73973121
  misc_feature 1..489: note = hyper
  source 1..489: mol_type = genomic DNA
tctctgtcccttcaccggactaaccgagttcgagaccacaggggggtcaggtagccaaggctgggctttgacggtaggaatgaaggaggtgagggtggcgcgccgcaggcctgggccactccctgagtagggcggcggcggcggcggcggcggcggcggcagcggcggcagcggctgcaggcctggccgattgtgaggagacagcggtacctcctgggccgcgcacccgacccttccaggggtcccggctcgcgccgcggccgcgcgaggcgcgctcgagcggaagtggcggcgaccccgccggaagcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctg

SEQ ID NO: 95876 - DNA, 681 bp, Homo sapiens; identical to SEQ ID NO: 8540
  misc_feature 1..681: note = chr6:74019413-74020094
  misc_feature 1..681: note = hyper
  source 1..681: mol_type = genomic DNA

SEQ ID NO: 95877 - DNA, 15 bp, Homo sapiens
  misc_feature 1..15: note = chr6:74161177-74161192
  misc_feature 1..15: note = hyper
  source 1..15: mol_type = genomic DNA
ggaaggtagggactg

SEQ ID NO: 95878 - DNA, 89 bp, Homo sapiens
  misc_feature 1..89: note = chr6:74161232-74161321
  misc_feature 1..89: note = hyper
  source 1..89: mol_type = genomic DNA
cgccaagcagctcaccttcacgtgctcatagtagctcccggtgttcagcagcccgacgcctctgaacgcggagtcgcacttcagtctga

SEQ ID NO: 95879 - DNA, 114 bp, Homo sapiens; identical to SEQ ID NO: 30587
  misc_feature 1..114: note = chr6:74161684-74161798
  misc_feature 1..114: note = hyper
  source 1..114: mol_type = genomic DNA

SEQ ID NO: 95880 - DNA, 235 bp, Homo sapiens
  misc_feature 1..235: note = chr6:74161830-74162065
  misc_feature 1..235: note = hyper
  source 1..235: mol_type = genomic DNA
cgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaaccccaggctgggaagtcgctgggagccacgc

SEQ ID NO: 95881 - DNA, 100 bp, Homo sapiens
  misc_feature 1..100: note = chr6:74234126-74234226
  misc_feature 1..100: note = hypo
  source 1..100: mol_type = genomic DNA
taccatggcttgccacgtgaaaatgatttttaaatcttttcatctgctgtagctacctctgaagaaaagatgatggcccggtgcggtggctcacgcctgt

SEQ ID NO: 95882 - DNA, 38 bp, Homo sapiens; identical to SEQ ID NO: 30589
  misc_feature 1..38: note = chr6:74405585-74405623
  misc_feature 1..38: note = hyper
  source 1..38: mol_type = genomic DNA

SEQ ID NO: 95883 - DNA, 102 bp, Homo sapiens
  misc_feature 1..102: note = chr6:74405913-74406015
  misc_feature 1..102: note = hyper
  source 1..102: mol_type = genomic DNA
tgtagcccaggcagacgccgtcgagatgcagggcccaccgctcctgaccgccgcccacctcctctgcgtgtgcaccgccgcgctggccgtggctcccgggta

SEQ ID NO: 95884 - DNA, 38 bp, Homo sapiens
  misc_feature 1..38: note = chr6:74406224-74406262
  misc_feature 1..38: note = hyper
  source 1..38: mol_type = genomic DNA
atgaagttgtttaagcgtctccccggccataacaactt

SEQ ID NO: 95885 - DNA, 93 bp, Homo sapiens
  misc_feature 1..93: note = chr6:74698077-74698170
  misc_feature 1..93: note = hypo
  source 1..93: mol_type = genomic DNA
cctttaccttaaaagcgggaaacaaaagattagcattatctctttttggtactaaagagaaaagataacttgtttcaaaaacatttctgacaa

SEQ ID NO: 95886 - DNA, 30 bp, Homo sapiens
  misc_feature 1..30: note = chr6:75167870-75167900
  misc_feature 1..30: note = hypo
  source 1..30: mol_type = genomic DNA
aagatttaacatagacgtaattacgtgaaa

SEQ ID NO: 95887 - DNA, 87 bp, Homo sapiens
  misc_feature 1..87: note = chr6:7543263-7543350
  misc_feature 1..87: note = hyper
  source 1..87: mol_type = genomic DNA
ccagcggaaacagaccgagggcgtcatttgggtgggtggggaagagatcctgtccctgctttgaccgggtctcgggagctggactct

SEQ ID NO: 95888 - DNA, 30 bp, Homo sapiens
  misc_feature 1..30: note = chr6:7562793-7562823
  misc_feature 1..30: note = hypo
  source 1..30: mol_type = genomic DNA
tatctgaagtaaagccgtgatggtgtgcgt

SEQ ID NO: 95889 - DNA, 52 bp, Homo sapiens; identical to SEQ ID NO: 30591
  misc_feature 1..52: note = chr6:75914106-75914158
  misc_feature 1..52: note = hyper
  source 1..52: mol_type = genomic DNA

SEQ ID NO: 95890 - DNA, 138 bp, Homo sapiens; identical to SEQ ID NO: 30592
  misc_feature 1..138: note = chr6:75914461-75914599
  misc_feature 1..138: note = hyper
  source 1..138: mol_type = genomic DNA

SEQ ID NO: 95891 - DNA, 240 bp, Homo sapiens
  misc_feature 1..240: note = chr6:75914881-75915121
  misc_feature 1..240: note = hyper
  source 1..240: mol_type = genomic DNA
gagctgggaaaagtccgccaagaatgagtaccctagtgctgcctaacccaccatctcggatgctctgaaaggtaggggaggaaggagccagaacactccactaggaatctgttacgagatgccacacacacccgtgcagcctcgacgagctgcagagcactcagcgggccctccaaagaattccgcaccgtgcgtcaccaaaataccttcccagcgcccccgccgcacgcctgccctccc

SEQ ID NO: 95892 - DNA, 214 bp, Homo sapiens
  misc_feature 1..214: note = chr6:75915170-75915384
  misc_feature 1..214: note = hyper
  source 1..214: mol_type = genomic DNA
cggcgcgccctccattgaaatcgacagcatctacagatgaaactcctctagaaacggaaacactgaacgggatgctttgcgtgcacaaaaccttgctcagctcttaagaaaagcaacattcccctctccctcaaaaaccccaaagaatcaccaaatcccagtatacaaggcaacgctctagcccacctacactattacaagtccaaactgtcct

SEQ ID NO: 95893 - DNA, 563 bp, Homo sapiens
  misc_feature 1..563: note = chr6:75915426-75915989
  misc_feature 1..563: note = hyper
  source 1..563: mol_type = genomic DNA
cgccgtttcccgagttgtctctgggaatgatgggggtaggggaaaggggacagaaaccaggctgacctgaggcggcggcaacagggagaggtagcggcggcgacagcggcttcccggcgtcggagaagctggtgctcggtgtggcccccacacgccccggcgataggcgctgcactccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcgagcattccttcggcgtgaggtggcgatcgccgtagtagcagtgccccgctggggggcgggg

SEQ ID NO: 95894 - DNA, 190 bp, Homo sapiens
  misc_feature 1..190: note = chr6:75916269-75916459
  misc_feature 1..190: note = hyper
  source 1..190: mol_type = genomic DNA
gggtgcacttaaaaccgatttacaggatttccattaactaactgtctgtacacgcggcgcgccttctgtctttttcaatctccaagcgcgattggaaacccggacagccgcccgcgcggggctcagtgatgggatggctttcccagtcctttctcactcccctggtgcttcaggacggaactgggaggct

SEQ ID NO: 95895 - DNA, 40 bp, Homo sapiens
  misc_feature 1..40: note = chr6:75918553-75918593
  misc_feature 1..40: note = hyper
  source 1..40: mol_type = genomic DNA
tcctagtgtgataaacggtaaagaacgggtaaccctcttc

SEQ ID NO: 95896 - DNA, 17 bp, Homo sapiens
  misc_feature 1..17: note = chr6:76006457-76006474
  misc_feature 1..17: note = hypo
  source 1..17: mol_type = genomic DNA
cccgcctcagcctccct

SEQ ID NO: 95897 - DNA, 1514 bp, Homo sapiens
  misc_feature 1..1514: note = chr6:7726255-7727769
  misc_feature 1..1514: note = hyper
  source 1..1514: mol_type = genomic DNA
tggctgccagcctgtcggttaccgcggggcggggagtcccggggctggagtgaggtacctgagccgggcgcgcagcagaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 95898 - DNA, 1035 bp, Homo sapiens; identical to SEQ ID NO: 30276
  misc_feature 1..1035: note = chr6:7728086-7729121
  misc_feature 1..1035: note = hyper
  source 1..1035: mol_type = genomic DNA

SEQ ID NO: 95899 - DNA, 183 bp, Homo sapiens
  misc_feature 1..183: note = chr6:7764169-7764352
  misc_feature 1..183: note = hypo
  source 1..183: mol_type = genomic DNA
ctccgttggatcaagcgtatgtgtcctgcgttcatttctaggtctgtaaacaaacacagctgttgagtgaaggatccgtcttcagaaatggtgaaaaaacagccatgccctgccagtgagagcgcagcaggggagagttgttccagggcttgggaggagcaggcgaggcgcagcagggccggg

SEQ ID NO: 95900 - DNA, 27 bp, Homo sapiens
  misc_feature 1..27: note = chr6:78061285-78061312
  misc_feature 1..27: note = hypo
  source 1..27: mol_type = genomic DNA
agaaatactgctgggcgcagtggctca

SEQ ID NO: 95901 - DNA, 100 bp, Homo sapiens; identical to SEQ ID NO: 30597
  misc_feature 1..100: note = chr6:78172176-78172276
  misc_feature 1..100: note = hyper
  source 1..100: mol_type = genomic DNA

SEQ ID NO: 95902 - DNA, 892 bp, Homo sapiens
  misc_feature 1..892: note = chr6:78172322-78173214
  misc_feature 1..892: note = hyper
  source 1..892: mol_type = genomic DNA
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggcatggagcggacgaaggagagggcggaaggaccgtggcgatcgcaggtttgtcccc

SEQ ID NO: 95903 - DNA, 25 bp, Homo sapiens
  misc_feature 1..25: note = chr6:78173701-78173726
  misc_feature 1..25: note = hyper
  source 1..25: mol_type = genomic DNA
ctaggagcagcgctgcgccgcgcct

SEQ ID NO: 95904 - DNA, 285 bp, Homo sapiens
  misc_feature 1..285: note = chr6:78173771-78174056
  misc_feature 1..285: note = hyper
  source 1..285: mol_type = genomic DNA
cggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaaggggcaggtgtctgggggagctggagggacgcggcgtgcaccagcccgggagaagcgtgcgagctacggagcagatgggctctttatatagagtccaggtccggtccgccagagca

SEQ ID NO: 95905 - DNA, 234 bp, Homo sapiens; identical to SEQ ID NO: 30600
  misc_feature 1..234: note = chr6:78175915-78176149
  misc_feature 1..234: note = hyper
  source 1..234: mol_type = genomic DNA

SEQ ID NO: 95906 - DNA, 84 bp, Homo sapiens; identical to SEQ ID NO: 30601
  misc_feature 1..84: note = chr6:78176445-78176529
  misc_feature 1..84: note = hyper
  source 1..84: mol_type = genomic DNA

SEQ ID NO: 95907 - DNA, 44 bp, Homo sapiens; identical to SEQ ID NO: 30602
  misc_feature 1..44: note = chr6:78176790-78176834
  misc_feature 1..44: note = hyper
  source 1..44: mol_type = genomic DNA

SEQ ID NO: 95908 - DNA, 30 bp, Homo sapiens
  misc_feature 1..30: note = chr6:7844836-7844866
  misc_feature 1..30: note = hypo
  source 1..30: mol_type = genomic DNA
ccccccttccccacccgcagccatccccac

SEQ ID NO: 95909 - DNA, 362 bp, Homo sapiens
  misc_feature 1..362: note = chr6:7911626-7911988
  misc_feature 1..362: note = hypo
  source 1..362: mol_type = genomic DNA
gaaagaaagtcaaagcggcctcttctagacaagaaggcacctagcaggactgactggggtcctactgtgccctcatttatgccggttactaaaatgaatgacagcacgcctgctatggctgaactcagcctgtggaatggcccgaaggcatccctgcccagcgactcataactcgcacctgcacacacaccttacagcagatggtaatcgaaagctccagccctaccccggggatctgaagctaaattagaatcaccgggttgctctccgggatcctgcctgctctttgattatcctcaatccaggaagccccaggtagttaactcctggcttggcaacaggggacgcgcccactgtctcac

SEQ ID NO: 95910 - DNA, 39 bp, Homo sapiens
  misc_feature 1..39: note = chr6:7920126-7920165
  misc_feature 1..39: note = hypo
  source 1..39: mol_type = genomic DNA
ctctgagagctgtagcgaggaatgcgaagggggcaagga

SEQ ID NO: 95911 - DNA, 54 bp, Homo sapiens
  misc_feature 1..54: note = chr6:79620288-79620342
  misc_feature 1..54: note = hyper
  source 1..54: mol_type = genomic DNA
ggaaatggactaggtcgtaacaagaaaaagtgatatcaagcccgggcagaaggg

SEQ ID NO: 95912 - DNA, 211 bp, Homo sapiens; identical to SEQ ID NO: 30604
  misc_feature 1..211: note = chr6:79620474-79620685
  misc_feature 1..211: note = hyper
  source 1..211: mol_type = genomic DNA

SEQ ID NO: 95913 - DNA, 191 bp, Homo sapiens; identical to SEQ ID NO: 30605
  misc_feature 1..191: note = chr6:79620686-79620877
  misc_feature 1..191: note = hyper
  source 1..191: mol_type = genomic DNA

SEQ ID NO: 95914 - DNA, 30 bp, Homo sapiens; identical to SEQ ID NO: 40853
  misc_feature 1..30: note = chr6:79699310-79699340
  misc_feature 1..30: note = hypo
  source 1..30: mol_type = genomic DNA

SEQ ID NO: 95915 - DNA, 52 bp, Homo sapiens
  misc_feature 1..52: note = chr6:80341274-80341326
  misc_feature 1..52: note = hyper
  source 1..52: mol_type = genomic DNA
gcgggaggcgcgcggcgctcgtcactgcgcgtccttgcgctcagccggtccg

SEQ ID NO: 95916 - DNA, 1078 bp, Homo sapiens
  misc_feature 1..1078: note = chr6:80656522-80657600
  misc_feature 1..1078: note = hyper
  source 1..1078: mol_type = genomic DNA
aaggaatcctgtgcacggggaagagggaggcgagctcgggagatgtgggagcacagggtggggcggctcctgcgaggagctcctggctgcacaggctccatctgatatgtcagctcccgcatccgagagctgatgagagatggagggagctcagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 95917 - DNA, 265 bp, Homo sapiens
  misc_feature 1..265: note = chr6:82461332-82461597
  misc_feature 1..265: note = hyper
  source 1..265: mol_type = genomic DNA
ctttgttcaccccctcgggtaagaagtccaacaggcagtccagcacgacgtccttcacagtctgaaactccccttccccgcgcaggtcggcgcagaagatgaggtccaggtccttgtagcccaggccgctgtcctggtgcaggacatggctggctgccgagccgttgaggcgcacgtcgcggacgccaatgcgcttctcggccaggcgccgccgcaccaccttcacgatcaggctcggctgcagctcgagcgtggggaagttgcc

SEQ ID NO: 95918 - DNA, 30 bp, Homo sapiens
  misc_feature 1..30: note = chr6:82462799-82462829
  misc_feature 1..30: note = hyper
  source 1..30: mol_type = genomic DNA
gtctttagatcatcacggttgggctccgga

SEQ ID NO: 95919 - DNA, 31 bp, Homo sapiens
  misc_feature 1..31: note = chr6:82958615-82958646
  misc_feature 1..31: note = hypo
  source 1..31: mol_type = genomic DNA
taagcttaagttggccgggcgcggtggctca

SEQ ID NO: 95920 - DNA, 43 bp, Homo sapiens
  misc_feature 1..43: note = chr6:83073208-83073251
  misc_feature 1..43: note = hyper
  source 1..43: mol_type = genomic DNA
tcagggtgaattccacgagattcaccagcggttttgctccagt

SEQ ID NO: 95921 - DNA, 71 bp, Homo sapiens
  misc_feature 1..71: note = chr6:83073519-83073590
  misc_feature 1..71: note = hyper
  source 1..71: mol_type = genomic DNA
ccaggggctggggtgcgaagagagtcggcgcccgcaacgcggagccgggaagtcgtcgctactctggtgga

SEQ ID NO: 95922 - DNA, 32 bp, Homo sapiens
  misc_feature 1..32: note = chr6:83073803-83073835
  misc_feature 1..32: note = hyper
  source 1..32: mol_type = genomic DNA
gaggggctggcggggcgcgggctggggggcga

SEQ ID NO: 95923 - DNA, 312 bp, Homo sapiens
  misc_feature 1..312: note = chr6:83074517-83074829
  misc_feature 1..312: note = hyper
  source 1..312: mol_type = genomic DNA
gggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccg

SEQ ID NO: 95924 - DNA, 88 bp, Homo sapiens
  misc_feature 1..88: note = chr6:83458754-83458842
  misc_feature 1..88: note = hypo
  source 1..88: mol_type = genomic DNA
ttgtaaggagtgaaatcctcattaaactgagttttatgttgaagcataatctctataaaatcagtaaacactgcgcatatgcagtggt

SEQ ID NO: 95925 - DNA, 272 bp, Homo sapiens; identical to SEQ ID NO: 568
  misc_feature 1..272: note = chr6:84417429-84417701
  misc_feature 1..272: note = hyper
  source 1..272: mol_type = genomic DNA

SEQ ID NO: 95926 - DNA, 156 bp, Homo sapiens
  misc_feature 1..156: note = chr6:84417908-84418064
  misc_feature 1..156: note = hyper
  source 1..156: mol_type = genomic DNA
cgtgacaccgtccccattctcccccggcccccacatagggccagactcaccccctggggacccccctgtcaatcagcactttccccgcaacctgacccgcgggtgctggactagccacaacgtgcgttggggttattccctgggcgccgcacccac

SEQ ID NO: 95927 - DNA, 464 bp, Homo sapiens; identical to SEQ ID NO: 30610
  misc_feature 1..464: note = chr6:84418260-84418724
  misc_feature 1..464: note = hyper
  source 1..464: mol_type = genomic DNA

SEQ ID NO: 95928 - DNA, 64 bp, Homo sapiens; identical to SEQ ID NO: 30611
  misc_feature 1..64: note = chr6:84418725-84418789
  misc_feature 1..64: note = hyper
  source 1..64: mol_type = genomic DNA

SEQ ID NO: 95929 - DNA, 131 bp, Homo sapiens; identical to SEQ ID NO: 30612
  misc_feature 1..131: note = chr6:84419071-84419202
  misc_feature 1..131: note = hyper
  source 1..131: mol_type = genomic DNA

SEQ ID NO: 95930 - DNA, 126 bp, Homo sapiens; identical to SEQ ID NO: 2842
  misc_feature 1..126: note = chr6:84419203-84419329
  misc_feature 1..126: note = hyper
  source 1..126: mol_type = genomic DNA

SEQ ID NO: 95931 - DNA, 85 bp, Homo sapiens
  misc_feature 1..85: note = chr6:84419330-84419415
  misc_feature 1..85: note = hyper
  source 1..85: mol_type = genomic DNA
attttaaatgtcagatcctgccggccatccgcgaccgtcacctgtgcgtcttcagctcctcaggctcctccgcttgtctcagtta

SEQ ID NO: 95932 - DNA, 79 bp, Homo sapiens; identical to SEQ ID NO: 40855
  misc_feature 1..79: note = chr6:84513478-84513557
  misc_feature 1..79: note = hypo
  source 1..79: mol_type = genomic DNA

SEQ ID NO: 95933 - DNA, 219 bp, Homo sapiens
  misc_feature 1..219: note = chr6:84562711-84562930
  misc_feature 1..219: note = hyper
  source 1..219: mol_type = genomic DNA
gtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgc

SEQ ID NO: 95934 - DNA, 354 bp, Homo sapiens; identical to SEQ ID NO: 2845
  misc_feature 1..354: note = chr6:84562931-84563285
  misc_feature 1..354: note = hyper
  source 1..354: mol_type = genomic DNA

SEQ ID NO: 95935 - DNA, 437 bp, Homo sapiens; identical to SEQ ID NO: 2846
  misc_feature 1..437: note = chr6:84563416-84563853
  misc_feature 1..437: note = hyper
  source 1..437: mol_type = genomic DNA

SEQ ID NO: 95936 - DNA, 66 bp, Homo sapiens
  misc_feature 1..66: note = chr6:84743425-84743491
  misc_feature 1..66: note = hyper
  source 1..66: mol_type = genomic DNA
gccccgcgccgcctccgctgcgggtcgggagcgcgcgtctccgccgcacctcggatctaggagcta

SEQ ID NO: 95937 - DNA, 30 bp, Homo sapiens
  misc_feature 1..30: note = chr6:84847017-84847047
  misc_feature 1..30: note = hypo
  source 1..30: mol_type = genomic DNA
acttgaacatgctagcgagccttacaacgg

SEQ ID NO: 95938 - DNA, 39 bp, Homo sapiens; identical to SEQ ID NO: 30618
  misc_feature 1..39: note = chr6:85471957-85471996
  misc_feature 1..39: note = hyper
  source 1..39: mol_type = genomic DNA

SEQ ID NO: 95939 - DNA, 2365 bp, Homo sapiens
  misc_feature 1..2365: note = chr6:85472324-85474689
  misc_feature 1..2365: note = hyper
  source 1..2365: mol_type = genomic DNA
ccctgcagatccacccgcggggcctgcggcgagggcagaggggtcccgggccgggccagggagcgcgccggagaccccttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgcttttaaaagttaggaaacaaaaaagagcacccattggctggaaccccaagggaggcagatgcaggaagcacagagctgcaccgctaggcgcagcaaacagccgcggccgaaggcgcgggtcgccgagtgggcggcggccgcccgcgaggcgagcctggaagcagtatctgaaccgtctggagggtgaccaggttgcgcggcgagctttgcgactgacacggccaatgcgctagtggctgagtggccttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaactgatgcgccagagaggactaacatgggtaaaaaacactctgtggacacaaattagggattgtaattgaaatttgttgccttgatctgtcagcacttccaggcaggagagcggtgggaagaacttgctcattagtgtcaataaagcggcgggggcggagcccgggtccctgtccatcacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcccggctttaaactagacgttcaacaagttagaaaatcaggaatctttcaaggttccgtaaattgccgtcccacttccgtatcgcttaatgttgcta

SEQ ID NO: 95940 - DNA, 39 bp, Homo sapiens
  misc_feature 1..39: note = chr6:85474894-85474933
  misc_feature 1..39: note = hyper
  source 1..39: mol_type = genomic DNA
atgtcagaaaaagcacgccctttccgcagcccacctttt

SEQ ID NO: 95941 - DNA, 60 bp, Homo sapiens
  misc_feature 1..60: note = chr6:85475862-85475922
  misc_feature 1..60: note = hyper
  source 1..60: mol_type = genomic DNA
tattgtagaagagaacgcgcggttcctggaggccggacaccacagcgggagtaggaacct

SEQ ID NO: 95942 - DNA, 211 bp, Homo sapiens
  misc_feature 1..211: note = chr6:85476191-85476402
  misc_feature 1..211: note = hyper
  source 1..211: mol_type = genomic DNA
ttagccgaaggcaggcgccggcagggagagctaagaggccgcctagagagtttgggccgggagtgggagtgggacaaggcgggagctaacttagctggagtagacgccagaagaagttccgttcagctgaggtgccccgccccaatcccaggctctcggggaccccaagaagggagctacccggtgcttctccgagcggtccttacagctt

SEQ ID NO: 95943 - DNA, 267 bp, Homo sapiens
  misc_feature 1..267: note = chr6:85476998-85477265
  misc_feature 1..267: note = hyper
  source 1..267: mol_type = genomic DNA
agcccactccaacctcggctcctggagaaggggcgtcgaatctctcttgggcatgggagggaaagacattccgagttggctgggcggagtggcagccttgagagtgacgagtgacagcaaagcctcgtcctagcaaggccttttaccaacagcgcggcatgccctttcgaggagagcgccaggccctcgcactttgcaagtcaagagagcaaagaaagcggggacagggcgcgtaatcgcaatgtccggtcgcgcgtgtgcacgtgt

SEQ ID NO: 95944 - DNA, 38 bp, Homo sapiens
  misc_feature 1..38: note = chr6:85478418-85478456
  misc_feature 1..38: note = hyper
  source 1..38: mol_type = genomic DNA
ttctcgcctctccttcggatctgcgttaatgaaaatat

SEQ ID NO: 95945 - DNA, 200 bp, Homo sapiens
  misc_feature 1..200: note = chr6:85478694-85478894
  misc_feature 1..200: note = hyper
  source 1..200: mol_type = genomic DNA
cgtccttctcaattccgattagctgagactgaagccctctacaaaggacctgtgcagcccacggaacaactccgcagttctcaggtagaagaatcagaatcaggtctgagcccgcggagtatctctttaagcgctgattttttaaaatcaatgatcgtttctcattggggctccagggaggtgctcggtttctggagtgt

SEQ ID NO: 95946 - DNA, 30 bp, Homo sapiens
  misc_feature 1..30: note = chr6:85481458-85481488
  misc_feature 1..30: note = hyper
  source 1..30: mol_type = genomic DNA
tctttagatttccatcgtggaggcataggg

SEQ ID NO: 95947 - DNA, 396 bp, Homo sapiens
  misc_feature 1..396: note = chr6:85482401-85482797
  misc_feature 1..396: note = hyper
  source 1..396: mol_type = genomic DNA
agccaaattattccccgacggctccaatattgtgccagagtcccagagtcagttatttttatgtctgactgtatttcacatgtgcagggtgataaataaaatccgtctcaagctacaaactatctgagtgtgatgaggaacaatcgacaaaaattaacccagccaaagcgttggggttcaagcgagcgactggaccataaatcagcgtcgcggtggcgtcgggaagctgagcgctcggaggtgcactcagctgcctctgggttcgcccagtccgagagcggggctccgccgcgggagcccgggcaggaatcggactccgccaggggttcggagtcttctggggaaagggcgtgttgggagagaaaggcaagcccacgcaggagcgacctcctaatt

SEQ ID NO: 95948 - DNA, 310 bp, Homo sapiens
  misc_feature 1..310: note = chr6:85482857-85483167
  misc_feature 1..310: note = hyper
  source 1..310: mol_type = genomic DNA
gtgtaaaatcaaaaaagacttgggaggcaaacttgggtgggaagcactgaggaaggcgaaacaattcccaacttatctggatcccagacgagtccctctgattgcttaagtcactagaaaaggagattcgtctcagcgattaacaatgataccctttttaagagagatcaaagaaggcgcctagggaagctctacaacgcggcttcttggagttctgaggccgcctgcgcattcactttccagtgtaagcccccgctccggaatcccggctccagcccagcccgcgcccccttccctggaaagacctggc

SEQ ID NO: 95949 - DNA, 314 bp, Homo sapiens
  misc_feature 1..314: note = chr6:85483210-85483524
  misc_feature 1..314: note = hyper
  source 1..314: mol_type = genomic DNA
cggggctggtccgaccggtcgcttccagctctctccacctgttggaaagcccaggcccaagaaccgcgccagcggcggcagcacgtcactcggcggccacggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 95950 - DNA, 173 bp, Homo sapiens; identical to SEQ ID NO: 8572
  misc_feature 1..173: note = chr6:85483759-85483932
  misc_feature 1..173: note = hyper
  source 1..173: mol_type = genomic DNA

SEQ ID NO: 95951 - DNA, 69 bp, Homo sapiens; identical to SEQ ID NO: 2850
  misc_feature 1..69: note = chr6:85484557-85484626
  misc_feature 1..69: note = hyper
  source 1..69: mol_type = genomic DNA

SEQ ID NO: 95952 - DNA, 217 bp, Homo sapiens; identical to SEQ ID NO: 2851
  misc_feature 1..217: note = chr6:85484716-85484933
  misc_feature 1..217: note = hyper
  source 1..217: mol_type = genomic DNA

SEQ ID NO: 95953 - DNA, 61 bp, Homo sapiens
  misc_feature 1..61: note = chr6:86159448-86159509
  misc_feature 1..61: note = hyper
  source 1..61: mol_type = genomic DNA
cagagaggacccaggcgcggggcggacccctccaattccttcctcgcgcccccgaaagagc

SEQ ID NO: 95954 - DNA, 125 bp, Homo sapiens; identical to SEQ ID NO: 30627
  misc_feature 1..125: note = chr6:86159778-86159903
  misc_feature 1..125: note = hyper
  source 1..125: mol_type = genomic DNA

SEQ ID NO: 95955 - DNA, 262 bp, Homo sapiens
  misc_feature 1..262: note = chr6:86160146-86160408
  misc_feature 1..262: note = hyper
  source 1..262: mol_type = genomic DNA
agggcgccgaggtggcgcacttcatgaacgccctgcgctacgatgccatggtaagacccgagcccgcgcccgggatagtagtcccggactgagagaggagccgggctggaaaagcagcggatggcagagtgtggcaagcctaggtccagggcgcggagagatgtggggataaagtgagactccggccagtgtgccagctggatgcatagaagtcccttggacgattcgtcttaaacggacgttattgcgcccccactatgag

SEQ ID NO: 95956 - DNA, 77 bp, Homo sapiens; identical to SEQ ID NO: 40856
  misc_feature 1..77: note = chr6:86302345-86302422
  misc_feature 1..77: note = hypo
  source 1..77: mol_type = genomic DNA

SEQ ID NO: 95957 - DNA, 30 bp, Homo sapiens; identical to SEQ ID NO: 40857
  misc_feature 1..30: note = chr6:86415082-86415112
  misc_feature 1..30: note = hypo
  source 1..30: mol_type = genomic DNA

SEQ ID NO: 95958 - DNA, 84 bp, Homo sapiens
  misc_feature 1..84: note = chr6:87646860-87646944
  misc_feature 1..84: note = hyper
  source 1..84: mol_type = genomic DNA
cgccagggctgtggccggcaaggggctcaggaggtgagtcccttgcccacacctccaaccccgctggcccggtttataacatgg

SEQ ID NO: 95959 - DNA, 92 bp, Homo sapiens; identical to SEQ ID NO: 30629
  misc_feature 1..92: note = chr6:87647217-87647309
  misc_feature 1..92: note = hyper
  source 1..92: mol_type = genomic DNA

SEQ ID NO: 95960 - DNA, 54 bp, Homo sapiens; identical to SEQ ID NO: 30630
  misc_feature 1..54: note = chr6:87647316-87647370
  misc_feature 1..54: note = hyper
  source 1..54: mol_type = genomic DNA

SEQ ID NO: 95961 - DNA, 209 bp, Homo sapiens
  misc_feature 1..209: note = chr6:87647371-87647580
  misc_feature 1..209: note = hyper
  source 1..209: mol_type = genomic DNA
ctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttccc

SEQ ID NO: 95962 - DNA, 27 bp, Homo sapiens
  misc_feature 1..27: note = chr6:87770042-87770069
  misc_feature 1..27: note = hypo
  source 1..27: mol_type = genomic DNA
cgcaagaggctacgttttccattccaa

SEQ ID NO: 95963 - DNA, 761 bp, Homo sapiens
  misc_feature 1..761: note = chr6:87861548-87862309
  misc_feature 1..761: note = hyper
  source 1..761: mol_type = genomic DNA
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccctggcttggcccccaggctctgcgccgcttgtctgtagcagacacaactcagctcccttactgtcctcaggcccggctatttcaagaattccagaaaaagagtgcaccggcgtgtgcgggccggtgctgcccggaaaacccgtgaagcaggcacgcacggcccggatgcaagcacat

SEQ ID NO: 95964 - DNA, 186 bp, Homo sapiens
  misc_feature 1..186: note = chr6:88875382-88875568
  misc_feature 1..186: note = hyper
  source 1..186: mol_type = genomic DNA
cagctaagtaaacaccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctct

SEQ ID NO: 95965 - DNA, 617 bp, Homo sapiens
  misc_feature 1..617: note = chr6:88875621-88876238
  misc_feature 1..617: note = hyper
  source 1..617: mol_type = genomic DNA
cggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgc

SEQ ID NO: 95966 - DNA, 193 bp, Homo sapiens; identical to SEQ ID NO: 30635
  misc_feature 1..193: note = chr6:88876284-88876477
  misc_feature 1..193: note = hyper
  source 1..193: mol_type = genomic DNA

SEQ ID NO: 95967 - DNA, 111 bp, Homo sapiens; identical to SEQ ID NO: 2853
  misc_feature 1..111: note = chr6:88876630-88876741
  misc_feature 1..111: note = hyper
  source 1..111: mol_type = genomic DNA

SEQ ID NO: 95968 - DNA, 322 bp, Homo sapiens; identical to SEQ ID NO: 2854
  misc_feature 1..322: note = chr6:88876742-88877064
  misc_feature 1..322: note = hyper
  source 1..322: mol_type = genomic DNA

SEQ ID NO: 95969 - DNA, 357 bp, Homo sapiens; identical to SEQ ID NO: 30638
  misc_feature 1..357: note = chr6:88877065-88877422
  misc_feature 1..357: note = hyper
  source 1..357: mol_type = genomic DNA

SEQ ID NO: 95970 - DNA, 67 bp, Homo sapiens
  misc_feature 1..67: note = chr6:88877474-88877541
  misc_feature 1..67: note = hyper
  source 1..67: mol_type = genomic DNA
cgtactatatctggaccctatatttgaactacgtggtgagaatctgtgaaagcgagcctctcaggga

SEQ ID NO: 95971 - DNA, 37 bp, Homo sapiens
  misc_feature 1..37: note = chr6:88982725-88982762
  misc_feature 1..37: note = hypo
  source 1..37: mol_type = genomic DNA
taaaagattctcagccgggctcggtgtctcacgcctg

SEQ ID NO: 95972 - DNA, 49 bp, Homo sapiens
  misc_feature 1..49: note = chr6:89792319-89792368
  misc_feature 1..49: note = hyper
  source 1..49: mol_type = genomic DNA
ggtcctctttcgtgtcgtgtcttgcttactaccgcgttacaagtgttgg

SEQ ID NO: 95973 - DNA, 48 bp, Homo sapiens
  misc_feature 1..48: note = chr6:89827453-89827501
  misc_feature 1..48: note = hyper
  source 1..48: mol_type = genomic DNA
gcctccgccgggcctcggccgtgctccgcggcgcggctgttaccccgc

SEQ ID NO: 95974 - DNA, 48 bp, Homo sapiens
  misc_feature 1..48: note = chr6:89827745-89827793
  misc_feature 1..48: note = hyper
  source 1..48: mol_type = genomic DNA
agccgcagaggccggcgcagagggggcgcagcgcggcgccagcctgga

SEQ ID NO: 95975 - DNA, 120 bp, Homo sapiens
  misc_feature 1..120: note = chr6:89849217-89849337
  misc_feature 1..120: note = hypo
  source 1..120: mol_type = genomic DNA
ccacccttatgaccttatttcactttaattacctccctaaagtcctgctcccaaatacagtcacactggaggttagcacttggacctgtagttccagctactctggatgctgaggtggag

SEQ ID NO: 95976 - DNA, 20 bp, Homo sapiens
  misc_feature 1..20: note = chr6:89849397-89849417
  misc_feature 1..20: note = hypo
  source 1..20: mol_type = genomic DNA
gcccgcgtggcagagcaaga

SEQ ID NO: 95977 - DNA, 85 bp, Homo sapiens
  misc_feature 1..85: note = chr6:89857318-89857403
  misc_feature 1..85: note = hypo
  source 1..85: mol_type = genomic DNA
cagcgagagacatatcgtatttaatgagttaagggtcaagaatgaagagcggtgggcagatcagttgaggtctggagttcgagac

SEQ ID NO: 95978 - DNA, 120 bp, Homo sapiens
  misc_feature 1..120: note = chr6:89857583-89857703
  misc_feature 1..120: note = hypo
  source 1..120: mol_type = genomic DNA
cctgggcaacagagcgaggcctcctcttaaaaaaaaaaagagcggcggcttcatgtcagagtttgagcactgtagaaccgccaaaaaaaagctaaactttgagaaatgtacactcttttt

SEQ ID NO: 95979 - DNA, 417 bp, Homo sapiens
  misc_feature 1..417: note = chr6:90120876-90121293
  misc_feature 1..417: note = hyper
  source 1..417: mol_type = genomic DNA
ccgcgcgctcactcccgggcaggcactgccatgtccaggtggtgataccgagagcagataaggtgtcctgacaacggtgtttgcgtggatcccgggaaatctgcggcctctcggagactcccacaacagcttggcgagcatccccccgccgccccgcgggtctccccagccactacctgggtgggcccctcccgcggcgacgcggggcgagactgacacccgcagctgccgacgaccctgccagtcacgccgccgccggctgcctttttttagccacgacatctgaccctggcttcaacagcaccgttctgggagagaggtcccagggcgcgcccgcggtcccctcccctccccaaccgccagacgctgcggagagcttggggtgaggggcgcgggaggcaccggctctgaaagggg

SEQ ID NO: 95980 - DNA, 87 bp, Homo sapiens
  misc_feature 1..87: note = chr6:90121597-90121684
  misc_feature 1..87: note = hyper
  source 1..87: mol_type = genomic DNA
cggaggagtcgggcccgtctccgtagtccgctagccccaccagctcatcctcctcctcctcctcctccgcgtcgtcctcgtcctgcg

SEQ ID NO: 95981 - DNA, 30 bp, Homo sapiens
  misc_feature 1..30: note = chr6:90122393-90122423
  misc_feature 1..30: note = hyper
  source 1..30: mol_type = genomic DNA
agctagggtcccaagcgggtggcctcccaa

SEQ ID NO: 95982 - DNA, 826 bp, Homo sapiens
  misc_feature 1..826: note = chr6:90142902-90143728
  misc_feature 1..826: note = hyper
  source 1..826: mol_type = genomic DNA
cggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtaccaggcgacctcgccggctccctgggacccccgcttacaccggggtgggcgcctcaggtcggggaggacgctgtcgggggaagggggcgctgctccctcggcaccccaggatcgccgactgcccgcggaggagacccggacaccgcgcctcgccccctggcctgcggcctccgaaaacgcccggcgcgagggggtccccccggggcgcctccctcttcgcctggcatcagttgcctccctggaatatggaacttcgggcgagggaggtggagaactttcttctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcggggactggagggg

SEQ ID NO: 95983 - DNA, 30 bp, Homo sapiens
  misc_feature 1..30: note = chr6:90349357-90349387
  misc_feature 1..30: note = hypo
  source 1..30: mol_type = genomic DNA
gggacttgcttgcctcgcctgttagcatcc

SEQ ID NO: 95984 - DNA, 239 bp, Homo sapiens
  misc_feature 1..239: note = chr6:90367251-90367490
  misc_feature 1..239: note = hypo
  source 1..239: mol_type = genomic DNA
ggaaaagcaaaacaccgttaaaggtatacattgcctgaagtctaaattccatgtttccttcctggagagctttctgaaaaacaacacgaacctgattctcccatctagagctaccagtctaacaactttttcttattatgcacaccacttaaatacagccgatattccggggtttgtcctgggaggcatataaaaataagtagcagtcatgtaccacacaacaacgtttcagtcaagga

SEQ ID NO: 95985 - DNA, 30 bp, Homo sapiens
  misc_feature 1..30: note = chr6:90596072-90596102
  misc_feature 1..30: note = hypo
  source 1..30: mol_type = genomic DNA
gcagagaatctttaacgtggacctgtacga

SEQ ID NO: 95986 - DNA, 94 bp, Homo sapiens
  misc_feature 1..94: note = chr6:90644578-90644672
  misc_feature 1..94: note = hypo
  source 1..94: mol_type = genomic DNA
caaggaacaggtctccgacacgggagctgcatgtgccgtaacatgaatgcaatctggcaggcggcgtgggcatgtgtgtcggaaagagagattt

SEQ ID NO: 95987 - DNA, 185 bp, Homo sapiens; identical to SEQ ID NO: 40861
  misc_feature 1..185: note = chr6:90661223-90661408
  misc_feature 1..185: note = hypo
  source 1..185: mol_type = genomic DNA

SEQ ID NO: 95988 - DNA, 30 bp, Homo sapiens
  misc_feature 1..30: note = chr6:90995490-90995520
  misc_feature 1..30: note = hyper
  source 1..30: mol_type = genomic DNA
gggcagtttacagtgcggccagctgagtgc

SEQ ID NO: 95989 - DNA, 418 bp, Homo sapiens
  misc_feature 1..418: note = chr6:91004761-91005179
  misc_feature 1..418: note = hyper
  source 1..418: mol_type = genomic DNA
tgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 95990 - DNA, 423 bp, Homo sapiens
  misc_feature 1..423: note = chr6:91005208-91005631
  misc_feature 1..423: note = hyper
  source 1..423: mol_type = genomic DNA
cgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccgg

SEQ ID NO: 95991 - DNA, 42 bp, Homo sapiens
  misc_feature 1..42: note = chr6:91005660-91005702
  misc_feature 1..42: note = hyper
  source 1..42: mol_type = genomic DNA
cgcggccaaggtcctcgcggagcagcccgggatgcgcacgcc

SEQ ID NO: 95992 - DNA, 1010 bp, Homo sapiens; identical to SEQ ID NO: 30644
  misc_feature 1..1010: note = chr6:91320285-91321295
  misc_feature 1..1010: note = hyper
  source 1..1010: mol_type = genomic DNA

SEQ ID NO: 95993 - DNA, 166 bp, Homo sapiens
  misc_feature 1..166: note = chr6:94126125-94126291
  misc_feature 1..166: note = hyper
  source 1..166: mol_type = genomic DNA
gtgaaataaacattgcgagattactgtttattgccattctgctacccctcagctcagcctgggggtggaagcaagggacctaagcagacagcagtgatggccaagttaagagagaaacaaactaacaaattaaaacaaaacagaacccggcccgagaacgtttaat

SEQ ID NO: 95994 - DNA, 247 bp, Homo sapiens; identical to SEQ ID NO: 30645
  misc_feature 1..247: note = chr6:94126366-94126613
  misc_feature 1..247: note = hyper
  source 1..247: mol_type = genomic DNA

SEQ ID NO: 95995 - DNA, 424 bp, Homo sapiens; identical to SEQ ID NO: 30646
  misc_feature 1..424: note = chr6:94126642-94127066
  misc_feature 1..424: note = hyper
  source 1..424: mol_type = genomic DNA

SEQ ID NO: 95996 - DNA, 46 bp, Homo sapiens; identical to SEQ ID NO: 30647
  misc_feature 1..46: note = chr6:94127085-94127131
  misc_feature 1..46: note = hyper
  source 1..46: mol_type = genomic DNA

SEQ ID NO: 95997 - DNA, 580 bp, Homo sapiens
  misc_feature 1..580: note = chr6:94127417-94127997
  misc_feature 1..580: note = hyper
  source 1..580: mol_type = genomic DNA
gtttctgatcgctaacgtcaggggagtagaaatgtggttttggaggggatgagcgtgcgtttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggttggggatgggattgtgacactgctcaaaagcaagagacttccattgacagggtttatttttccccagctccaactacaggcaccgaaaggtattttac

SEQ ID NO: 95998 - DNA, 477 bp, Homo sapiens
  misc_feature 1..477: note = chr6:94128430-94128907
  misc_feature 1..477: note = hyper
  source 1..477: mol_type = genomic DNA
acttcattagtaacccgagctttccgagctcatcgaagtctcggtccctctgggaaggctccgggctcccgccactcgccggcgggctggcggagacggtaggggctgcatttcccagtctccaacccaactctggccgcagctcccacagaaggcgaataaggagacaaggaagaccgagctagagagagatgtgacccgcctgaggtactaagaaataagctcgccggcagttcctccaaccccaccccacccccgttgctgctcacgccctccagactgcccgcgccagaaatcccgcacccgtcggatggacggctccgggcacagggctgtaggcggctcggaacagccctggttcgcgctcgctggtccgccaggagcggcctcagcggtgagggggcggggagccggcgggggagggtcgcccggcgccggaggcgcggccggcagcgccgcggacgagctggcttgtgc

SEQ ID NO: 95999 - DNA, 460 bp, Homo sapiens
  misc_feature 1..460: note = chr6:94129167-94129627
  misc_feature 1..460: note = hyper
  source 1..460: mol_type = genomic DNA
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggccaaggggcgggtcccggcgaaatggccgccccggccacgggggcggggtccgaggcaggagccaatcggtgccgagcggagtcaggttgctggtccaggattccctccaggttctgagctcgcgctggatgttcagaggagaacgaggatggtagccgaggtgtgtgctgctttggacgctctgcttttagcaaccgcagctttcgcgtagcagaataaatcc

SEQ ID NO: 96000 - DNA, 256 bp, Homo sapiens
  misc_feature 1..256: note = chr6:94129628-94129884
  misc_feature 1..256: note = hyper
  source 1..256: mol_type = genomic DNA
agaataacgctcccaacttacactcttttctatagctgtactccgcgcgatcttttagaaaccagaggcgaagcaagccttctctcagctaccaagcacggagcccggacagtgaaatgagctgtgcctttaagtaaagtgtgttttacttttttgttgttagaacctccgcgggctgggtaactttgttttttgcctttttgaaaagtttctacttctctttttctgttactccaagagccgtcagttttaggta

SEQ ID NO: 96001 - DNA, 691 bp, Homo sapiens
  misc_feature 1..691: note = chr6:96463169-96463860
  misc_feature 1..691: note = hyper
  source 1..691: mol_type = genomic DNA
gctggtcaaccccggcggtaaacaaccaaggccacccctgcccaggcaacagctccaaggggcaggcgatggttgccggcattgagctccctgctggcgccttctggcgggacagccagtgccaaagagcgcccagggaaacaaacaccaatgggggactatacagatgtcatggatgcacatgtaggatcataatctgcccagaaagaggagagaaggagggcgacaggctgcggatcctggtccaggagccgccgcaatggagcgggcggcagtgtgcgcgcacaggtgccacaggccggtggcggggagagctgtagaggctgcctcccggactcagcactcgcaccagcgcgctgaagccgcggctgctgccaagcttgggtaacccccagcctgagccacgagaggaagagcccaaggaaagggcgcgaagggggaaggagggtagggtagaaggagggcgggggagagacccatcgcctcatcttacatttcccctcccaagctcatttagtgggaacctctgctgggctcctgcgcgcctccctccccaccccctcaactctgggcgaccatctccccctcttcccttgctcaccccccacccttcctgctcttccgtccctccctaccgcgtgcctcctcccctccccctcgcctccctcccctccagcggcagtagctgtag

SEQ ID NO: 96002 - DNA, 122 bp, Homo sapiens; identical to SEQ ID NO: 30653
  misc_feature 1..122: note = chr6:96464082-96464204
  misc_feature 1..122: note = hyper
  source 1..122: mol_type = genomic DNA

SEQ ID NO: 96003 - DNA, 38 bp, Homo sapiens
  misc_feature 1..38: note = chr6:96464457-96464495
  misc_feature 1..38: note = hyper
  source 1..38: mol_type = genomic DNA
ctgccacccttcacccgatctcgcgctgacaaagcctt

SEQ ID NO: 96004 - DNA, 38 bp, Homo sapiens
  misc_feature 1..38: note = chr6:97285806-97285844
  misc_feature 1..38: note = hyper
  source 1..38: mol_type = genomic DNA
agggtcctggtttcccgctcccacgggcccccagagtg

SEQ ID NO: 96005 - DNA, 24 bp, Homo sapiens
  misc_feature 1..24: note = chr6:97299307-97299331
  misc_feature 1..24: note = hypo
  source 1..24: mol_type = genomic DNA
gtgagactccgtctcaaaaaaaaa

SEQ ID NO: 96006 - DNA, 30 bp, Homo sapiens
  misc_feature 1..30: note = chr6:99164434-99164464
  misc_feature 1..30: note = hyper
  source 1..30: mol_type = genomic DNA
tgagtgcatcaaggccgtgtcaaccccttg

SEQ ID NO: 96007 - DNA, 1176 bp, Homo sapiens
  misc_feature 1..1176: note = chr6:99271691-99272867
  misc_feature 1..1176: note = hyper
  source 1..1176: mol_type = genomic DNA
ggaaaccatccaagacgcggtttaagaaaacaggaagaataaacacccacggtgcaaacttctgatcaatcattttaccaaacttcaaccacgactagagaatatgtaagaagtgtgtcctggggcttataataatgccactagccacagtatgttttcaggagcgcccaagaacattattcattgtaaatttctatgtaaattatccaggggcaggggcattgctttggtccgcccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaagtcagagcgtgcgttccgcagtgcgcggtggctgcgcggcgctggctcttgctgtggggcagacagcagaggaccaggggcgagtcggcagcgggaggagccgcctggccaggagcctcggacagtgtctccccgtcccgaaccccttcccgccacctcctccaccccccgccccgcattccccccggggcgaccctccctccac

SEQ ID NO: 96008 - DNA, 30 bp, Homo sapiens
  misc_feature 1..30: note = chr6:99273084-99273114
  misc_feature 1..30: note = hyper
  source 1..30: mol_type = genomic DNA
tgacttagaatctcccgctttgaggtttta

SEQ ID NO: 96009 - DNA, 280 bp, Homo sapiens
  misc_feature 1..280: note = chr6:99273322-99273602
  misc_feature 1..280: note = hyper
  source 1..280: mol_type = genomic DNA
tttagcagctttcttcggagcccgggtaccccaagtggcaacttaggaactgggagaaggaacgtgccaccaccgaccacctatcctggtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctgtgg

SEQ ID NO: 96010 - DNA, 53 bp, Homo sapiens; identical to SEQ ID NO: 30658
  misc_feature 1..53: note = chr6:99273848-99273901
  misc_feature 1..53: note = hyper
  source 1..53: mol_type = genomic DNA

SEQ ID NO: 96011 - DNA, 93 bp, Homo sapiens
  misc_feature 1..93: note = chr6:99275537-99275630
  misc_feature 1..93: note = hyper
  source 1..93: mol_type = genomic DNA
tgcttggccattccccgcggggccggccccccttcccttgctcagtgcccaggtcctccgggcccttctcctcgagcccgcagtcggctctca

SEQ ID NO: 96012 - DNA, 167 bp, Homo sapiens
  misc_feature 1..167: note = chr6:99275841-99276008
  misc_feature 1..167: note = hyper
  source 1..167: mol_type = genomic DNA
caggacctgcctaggcgctcttcgaccacggaacatccctccccgccacccccacctccatcctttccatagcagtctctccccgggtcagtccagggcgctgggaagccttagctctcgctttctacccccactgatccccccacgcgggccgaggctaggacaca

SEQ ID NO: 96013 - DNA, 50 bp, Homo sapiens
  misc_feature 1..50: note = chr6:99276380-99276430
  misc_feature 1..50: note = hyper
  source 1..50: mol_type = genomic DNA
tttaatgctgggacccggctgccctagattaccatcgaaaactctcagaa

SEQ ID NO: 96014 - DNA, 77 bp, Homo sapiens
  misc_feature 1..77: note = chr6:99276704-99276781
  misc_feature 1..77: note = hyper
  source 1..77: mol_type = genomic DNA
acctgctcccctccccgcccacccccccatccccccccaaccgccgtcctcccggacactaacgacacaattgttaa

SEQ ID NO: 96015 - DNA, 21 bp, Homo sapiens
  misc_feature 1..21: note = chr6:99277180-99277201
  misc_feature 1..21: note = hyper
  source 1..21: mol_type = genomic DNA
tagggggagaaaatgcgagcg

SEQ ID NO: 96016 - DNA, 141 bp, Homo sapiens; identical to SEQ ID NO: 30662
  misc_feature 1..141: note = chr6:99277261-99277402
  misc_feature 1..141: note = hyper
  source 1..141: mol_type = genomic DNA

SEQ ID NO: 96017 - DNA, 201 bp, Homo sapiens; identical to SEQ ID NO: 30663
  misc_feature 1..201: note = chr6:99278897-99279098
  misc_feature 1..201: note = hyper
  source 1..201: mol_type = genomic DNA

SEQ ID NO: 96018 - DNA, 445 bp, Homo sapiens; identical to SEQ ID NO: 30664
  misc_feature 1..445: note = chr6:99279350-99279795
  misc_feature 1..445: note = hyper
  source 1..445: mol_type = genomic DNA

SEQ ID NO: 96019 - DNA, 1241 bp, Homo sapiens
  misc_feature 1..1241: note = chr6:99279796-99281037
  misc_feature 1..1241: note = hyper
  source 1..1241: mol_type = genomic DNA
gggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttcgaagatgtgtttgaaaacttcattcttctttcgagtgtatcatcctatgggctgcagaaggccttgtgcctcgagaaatgtgaaattaaatccagagaaaagcagacacctgccccagaaaggtgggggagaagtatgagctgcttagcacttggacgcggcccttccccagggctggattcttctgtccgtgggagctctgagctccaggtccgcgaaaagaaaggcacgacatgtcaggagaagatgcggctggcgggctgtctgtgcgctccccaaggcccagggaaagtcacgcgcctagcacaggggacgcagggccgaagccgggagaaggcggttctgcccgccacccagccccttggctcgcggttgcggagccgcgggcaccagtcgctgagtctgcgcgctgaggctcggacttgttcattttttcctagctagacaaagttatgggattcctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctg

SEQ ID NO: 96020 - DNA, 425 bp, Homo sapiens
  misc_feature 1..425: note = chr6:99281067-99281492
  misc_feature 1..425: note = hyper
  source 1..425: mol_type = genomic DNA
cgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgcc

SEQ ID NO: 96021 - DNA, 207 bp, Homo sapiens
  misc_feature 1..207: note = chr6:99281846-99282053
  misc_feature 1..207: note = hyper
  source 1..207: mol_type = genomic DNA
cactgaaattctaaccgtgggatgcaaggagagttgaacaggggaacaggtctggctcttggctctaggtttaagagatacacactgtgtgtgtgtccctaggtgaataaaaatccgactcccgctggctcggtgcgacccagcttttcccttaccccctccgtttccccatcttaaagccctattgggaaacgaaagtggacacca

SEQ ID NO: 96022 - DNA, 41 bp, Homo sapiens
  misc_feature 1..41: note = chr6:99282531-99282572
  misc_feature 1..41: note = hyper
  source 1..41: mol_type = genomic DNA
gaaagagagcgagggcgggcgggaggcggcggcggcggcag

SEQ ID NO: 96023 - DNA, 302 bp, Homo sapiens
  misc_feature 1..302: note = chr6:99282778-99283080
  misc_feature 1..302: note = hyper
  source 1..302: mol_type = genomic DNA
cctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagc

SEQ ID NO: 96024 - DNA, 702 bp, Homo sapiens
  misc_feature 1..702: note = chr6:99283339-99284041
  misc_feature 1..702: note = hyper
  source 1..702: mol_type = genomic DNA
gaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtaggga

SEQ ID NO: 96025 - DNA, 30 bp, Homo sapiens; identical to SEQ ID NO: 30673
  misc_feature 1..30: note = chr6:99284652-99284682
  misc_feature 1..30: note = hyper
  source 1..30: mol_type = genomic DNA

SEQ ID NO: 96026 - DNA, 193 bp, Homo sapiens
  misc_feature 1..193: note = chr6:99290280-99290473
  misc_feature 1..193: note = hyper
  source 1..193: mol_type = genomic DNA
gggcgagtgtgctgccggccaacatctgctccttgcccagtcgcaaaagaggtaccttggccttgccgcgcaccccccacctcggggaccctggccgctgtcgcgaaggcccagacagcctagctcggccgcgcggggaggagagagacagggaaaggagcggggcactccctgcactcccagccccggcctt

SEQ ID NO: 96027 - DNA, 57 bp, Homo sapiens
  misc_feature 1..57: note = chr6:99291285-99291342
  misc_feature 1..57: note = hyper
  source 1..57: mol_type = genomic DNA
accctctgggcaccccggcatctcaagccagagctgagggcccggaaagtgaggggc

SEQ ID NO: 96028 - DNA, 111 bp, Homo sapiens
  misc_feature 1..111: note = chr6:99291586-99291697
  misc_feature 1..111: note = hyper
  source 1..111: mol_type = genomic DNA
cgcagaggcgggaagctggccggagaggagtgggaaggcgaccaagggcagcagcaggggctcctgcggggcgcaggtctgtgctggcgccgggcctggcctctgcaggct

SEQ ID NO: 96029 - DNA, 206 bp, Homo sapiens
  misc_feature 1..206: note = chr6:99291729-99291935
  misc_feature 1..206: note = hyper
  source 1..206: mol_type = genomic DNA
cgcccgcggccactcacccggccccgcggccagcccgggcggggtcgcacgcaaacaaggatgcttctatttactcgcctctgcctgtagatttctaagacattcagcaggcacaatcattaaactaatttgtgtttgattgtttgggcggacggagggtagttttattgcgctaagcattcaagcaggcacgcatcgctgattac

SEQ ID NO: 96030 - DNA, 318 bp, Homo sapiens
  misc_feature 1..318: note = chr6:99292203-99292521
  misc_feature 1..318: note = hyper
  source 1..318: mol_type = genomic DNA
tcggcttggaagaggcgtctgttatttattatttccctcccaccagcgtagcctggtctcccagcgccgtgcccgccgcccccgccccatcctgcgccccagatgcgcgccccgcttggaccagtccgagcagaggggggttccgaaatctgctcggacgcagcatcgctggccgcctgccccgctagttccccgagtgcgattactttttaaaggctcctttaagcatatttccgtgaatctgtttcttgtgctttaatgttactattaattgataagatcagctcatcaaacatactatttcgatagggaattgta

SEQ ID NO: 96031 - DNA, 30 bp, Homo sapiens
  misc_feature 1..30: note = chr6:99293257-99293287
  misc_feature 1..30: note = hyper
  source 1..30: mol_type = genomic DNA
cggctgaggagtcctcgggggctgcagatg

SEQ ID NO: 96032 - DNA, 215 bp, Homo sapiens
  misc_feature 1..215: note = chr6:99295649-99295864
  misc_feature 1..215: note = hyper
  source 1..215: mol_type = genomic DNA
tccacacacgcctcccgtctagagagccccagtggcccagggccacctccagtccctggacttggaaatcaggacgctgtggatcccacaggcgccccgcgacatcctggagtcgccgggagtggcgctgcggtgaaagccggtgcctagagtgggcttaggggtcccattccactcggaaagtcctctcacctccccaagggccattctgccgg

SEQ ID NO: 96033 - DNA, 304 bp, Homo sapiens; identical to SEQ ID NO: 575
  misc_feature 1..304: note = chr6:99296061-99296365
  misc_feature 1..304: note = hyper
  source 1..304: mol_type = genomic DNA

SEQ ID NO: 96034 - DNA, 117 bp, Homo sapiens
  misc_feature 1..117: note = chr6:99296407-99296524
  misc_feature 1..117: note = hyper
  source 1..117: mol_type = genomic DNA
cgcctggagggccctgacccttccggtgttccaccgcaatggggtcggggggagaggggggctgtggctgcctgagacctccagggcagcgcacattacgggcgggaaagggaagtc

SEQ ID NO: 96035 - DNA, 149 bp, Homo sapiens; identical to SEQ ID NO: 40863
  misc_feature 1..149: note = chr6:99396329-99396478
  misc_feature 1..149: note = hypo
  source 1..149: mol_type = genomic DNA

SEQ ID NO: 96036 - DNA, 29 bp, Homo sapiens
  misc_feature 1..29: note = chr6:99396718-99396747
  misc_feature 1..29: note = hypo
  source 1..29: mol_type = genomic DNA
tgagccaccgcgcccgcccttggcacttt

SEQ ID NO: 96037 - DNA, 30 bp, Homo sapiens
  misc_feature 1..30: note = chr6:99797154-99797184
  misc_feature 1..30: note = hyper
  source 1..30: mol_type = genomic DNA
acccggcccaccagccgaagaaggagatgc

SEQ ID NO: 96038 - DNA, 30 bp, Homo sapiens
  misc_feature 1..30: note = chr6:99961087-99961117
  misc_feature 1..30: note = hypo
  source 1..30: mol_type = genomic DNA
ccattttctccatgtcgggagaaagtctct

SEQ ID NO: 96039 - DNA, 30 bp, Homo sapiens
  misc_feature 1..30: note = chr7:100035094-100035124
  misc_feature 1..30: note = hypo
  source 1..30: mol_type = genomic DNA
gcatgggcaacataccgagactccacacca

SEQ ID NO: 96040 - DNA, 19 bp, Homo sapiens
  misc_feature 1..19: note = chr7:100047876-100047895
  misc_feature 1..19: note = hypo
  source 1..19: mol_type = genomic DNA
ctcccgaaatgtcaggatt

SEQ ID NO: 96041 - DNA, 191 bp, Homo sapiens
  misc_feature 1..191: note = chr7:100088128-100088319
  misc_feature 1..191: note = hypo
  source 1..191: mol_type = genomic DNA
catcccagcagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccct

SEQ ID NO: 96042 - DNA, 54 bp, Homo sapiens; identical to SEQ ID NO: 31426
  misc_feature 1..54: note = chr7:100091127-100091181
  misc_feature 1..54: note = hyper
  source 1..54: mol_type = genomic DNA

SEQ ID NO: 96043 - DNA, 95 bp, Homo sapiens
  misc_feature 1..95: note = chr7:100104078-100104173
  misc_feature 1..95: note = hypo
  source 1..95: mol_type = genomic DNA
ggattataggtttgagcactcgtgtccagccagtgttacaacttttattgaagcttcagtgcacagccgcagcaaaggtacggctccttgcagag

SEQ ID NO: 96044 - DNA, 30 bp, Homo sapiens; identical to SEQ ID NO: 41394
  misc_feature 1..30: note = chr7:100118785-100118815
  misc_feature 1..30: note = hypo
  source 1..30: mol_type = genomic DNA

SEQ ID NO: 96045 - DNA, 242 bp, Homo sapiens
  misc_feature 1..242: note = chr7:100167379-100167621
  misc_feature 1..242: note = hyper
  source 1..242: mol_type = genomic DNA
actccagttcctgggcgacgtgaggattagtctcgtggggtgggggttccggagcggtcggcggagggagggaggtagtggggagcccaggccaggggcaacagtcaccgggacactcgctgtgcgcagagtccttgccccaaacttccagtcgggagcccgggagagacgctgggcatcaagacgggtggcagcctgcccggccgctgctcccggcccgccgagttcgccacctcaccccc

SEQ ID NO: 96046 - DNA, 194 bp, Homo sapiens
  misc_feature 1..194: note = chr7:100167860-100168054
  misc_feature 1..194: note = hyper
  source 1..194: mol_type = genomic DNA
aagtttcgcgcgtgccgagcgcggctccagcgcagcctgagcctggcgggtgcgtgcaccaccagcaagtgcgcagatgcgcgccagcaccacctgatcgtcctctacacccgcgacagcagcctgcgcgtggcggcggcaggcgaggcggagcagcaggcgtgatacaacaccctgctcgaggagcgcggtga

SEQ ID NO: 96047 - DNA, 39 bp, Homo sapiens
  misc_feature 1..39: note = chr7:100170295-100170334
  misc_feature 1..39: note = hypo
  source 1..39: mol_type = genomic DNA
aggtacaggggaacacgctgcccccggggcagcagaggg

SEQ ID NO: 96048 - DNA, 30 bp, Homo sapiens
  misc_feature 1..30: note = chr7:100173832-100173862
  misc_feature 1..30: note = hypo
  source 1..30: mol_type = genomic DNA
tgcccacgcagctcccgcctctgctcacct

SEQ ID NO: 96049 - DNA, 266 bp, Homo sapiens
  misc_feature 1..266: note = chr7:100179674-100179940
  misc_feature 1..266: note = hypo
  source 1..266: mol_type = genomic DNA
ggcttcccagggtgccgatgtcagggggcagggctcccagcttgttgttgctgacgatgaggaccctcaggggcagctggcagatgtagggtggcagcagcgacagctggtttcggctgtggaagggagaaaggcagcggactggctccccaggcatggcatcccagcactgccatcctctcggggtcactgggtgggtcactcagtagtacttgagactgagaagcacacgctcccacgtggccctggctcggcctccctacctg

SEQ ID NO: 96050 - DNA, 39 bp, Homo sapiens
  misc_feature 1..39: note = chr7:100207977-100208016
  misc_feature 1..39: note = hypo
  source 1..39: mol_type = genomic DNA
atacagggcagggagcggtggctcacgcctgtaatccca

SEQ ID NO: 96051 - DNA, 132 bp, Homo sapiens
  misc_feature 1..132: note = chr7:100253710-100253842
  misc_feature 1..132: note = hyper
  source 1..132: mol_type = genomic DNA
agggcaccctcccgacgggaaaggaaggggcccggggccaggtggaggtgggttgcaaggtagggccctgtgcgcgcggggcgtctggggaggaccgagcgcaggggtggcgggagacccgagcctgagact

SEQ ID NO: 96052 - DNA, 135 bp, Homo sapiens
  misc_feature 1..135: note = chr7:100253997-100254132
  misc_feature 1..135: note = hyper
  source 1..135: mol_type = genomic DNA
cggcccgtgggcggtggcgggatcagcaccgaggcggccggacagctcccgggatccctggcggggcgggactctcagcggccaattgggaggccggatcccccgctccaacggcgccgccgattggctgccagg

SEQ ID NO: 96053 - DNA, 91 bp, Homo sapiens
  misc_feature 1..91: note = chr7:100254614-100254705
  misc_feature 1..91: note = hypo
  source 1..91: mol_type = genomic DNA
cttactttttaaagcaggattggggagagaggtccagttcccagaagggttatctatcttcaggctgctctgagcccggttctgccacacc

SEQ ID NO: 96054 - DNA, 23 bp, Homo sapiens
  misc_feature 1..23: note = chr7:100269563-100269586
  misc_feature 1..23: note = hypo
  source 1..23: mol_type = genomic DNA
ccccatctcgttctttcttatgg

SEQ ID NO: 96055 - DNA, 119 bp, Homo sapiens
  misc_feature 1..119: note = chr7:100279900-100280019
  misc_feature 1..119: note = hypo
  source 1..119: mol_type = genomic DNA
tggagacccaggtcccgcccacctcctgggagccgctcgcccaccgtccaggctgcccgtggcgctcagcgtgtgcagcatctgctcgcaccactgggtgaagccgtcctggggcctgg

SEQ ID NO: 96056 - DNA, 120 bp, Homo sapiens
  misc_feature 1..120: note = chr7:100296125-100296245
  misc_feature 1..120: note = hypo
  source 1..120: mol_type = genomic DNA
atgagccaccacgcccgccccgcccccacttttttttttttaatggcagattcctcttcagtgttttcctttgatgaaatgtaaggagagggctggatgcggtggctcacgcctgtaatc

SEQ ID NO: 96057 - DNA, 20 bp, Homo sapiens
  misc_feature 1..20: note = chr7:100318091-100318111
  misc_feature 1..20: note = hyper
  source 1..20: mol_type = genomic DNA
ctttcccagatagcacgctc

SEQ ID NO: 96058 - DNA, 269 bp, Homo sapiens; identical to SEQ ID NO: 31430
  misc_feature 1..269: note = chr7:100318466-100318735
  misc_feature 1..269: note = hyper
  source 1..269: mol_type = genomic DNA

SEQ ID NO: 96059 - DNA, 39 bp, Homo sapiens; identical to SEQ ID NO: 41397
  misc_feature 1..39: note = chr7:100391505-100391544
  misc_feature 1..39: note = hypo
  source 1..39: mol_type = genomic DNA

SEQ ID NO: 96060 - DNA, 51 bp, Homo sapiens
  misc_feature 1..51: note = chr7:100425811-100425862
  misc_feature 1..51: note = hyper
  source 1..51: mol_type = genomic DNA
gcgcgcactaagctgcgctagggagtagagaaaaatcgaggaaacaacggt

SEQ ID NO: 96061 - DNA, 112 bp, Homo sapiens
  misc_feature 1..112: note = chr7:100459369-100459481
  misc_feature 1..112: note = hypo
  source 1..112: mol_type = genomic DNA
tctgcttcggctggacgtccggaaggatcacgtgaagttctggcggccccagctgctgctcctggtggggaacccccggggcgccctgcctctgctgcggttggccaaccag

SEQ ID NO: 96062 - DNA, 30 bp, Homo sapiens
  misc_feature 1..30: note = chr7:100485916-100485946
  misc_feature 1..30: note = hypo
  source 1..30: mol_type = genomic DNA
catacccccatgccccgtatggtgctggtc

SEQ ID NO: 96063 - DNA, 456 bp, Homo sapiens
  misc_feature 1..456: note = chr7:100489889-100490345
  misc_feature 1..456: note = hypo
  source 1..456: mol_type = genomic DNA
ctttgtgtgtcctcccgcccccgactcctgtcctccccagccttctctccctctgcactgctgaccctgtgcgggcaaagttggcccagtatcgcatcagtcgctgggcgaagattttctcctctgccgtgtagtttcgagaggggtccagggggatcccaaagatgaactcgatctcgtagccgtggggcacccccatccacaggggccaggagagcgtggaagcacggtgttcaaagacgtaggcgtagacccgggcaccctgggcagccagtcgcccagccagctgggccacggggcacacgacattgtggtcgcccaccacatcgctcagggcctccctcaggcgtgccgggtcctcgggatgcagccagtctgtgtaatgcaggaccacagcctcggctgccaggtcacttacctggggaaccccgacccgcaccccggccaggaactcgg

SEQ ID NO: 96064 - DNA, 353 bp, Homo sapiens
  misc_feature 1..353: note = chr7:100494408-100494761
  misc_feature 1..353: note = hyper
  source 1..353: mol_type = genomic DNA
ccgaggggcctgacccgcgcagattgccccccgccccgccctccaggagttcacccgtgtggacagggctgctgcagcggggtccccacgaccgaggtgcatgcggcaataccgcgcggcgcctgcttcctggaggcggccggctcaggagcccccgagaccccgcgtgggagagcggccggcgcaggccagcgtcgggcgtgcgtgcgcgcgcgcggcggtgcggggcgcggcgtggggtgggcgcgtgcgcacacgctcgctctaaccgccgcgcgccccgcagcgccccgcagcgcctcgggcacgcgggcgccgccgccagggaccgcgggcaccgggttgcggggcct

SEQ ID NO: 96065 - DNA, 37 bp, Homo sapiens
  misc_feature 1..37: note = chr7:100495406-100495443
  misc_feature 1..37: note = hypo
  source 1..37: mol_type = genomic DNA
aatgatggaaacaaactgtgaacgagtgctctgaggc

SEQ ID NO: 96066 - DNA, 19 bp, Homo sapiens
  misc_feature 1..19: note = chr7:100606618-100606637
  misc_feature 1..19: note = hypo
  source 1..19: mol_type = genomic DNA
gccacggcacccggccggg

SEQ ID NO: 96067 - DNA, 72 bp, Homo sapiens
  misc_feature 1..72: note = chr7:100608819-100608891
  misc_feature 1..72: note = hyper
  source 1..72: mol_type = genomic DNA
gtcgggcgtggacaacgccatcgactgtcaccagggccagtgcgttctagagacgagcggtcccgcgtgtcg

SEQ ID NO: 96068 - DNA, 59 bp, Homo sapiens
  misc_feature 1..59: note = chr7:100660623-100660682
  misc_feature 1..59: note = hyper
  source 1..59: mol_type = genomic DNA
ggggggcttctgctccgctccctcctgttccggggtccagcgggcggctccccaggcag

SEQ ID NO: 96069 - DNA, 30 bp, Homo sapiens
  misc_feature 1..30: note = chr7:1006918-1006948
  misc_feature 1..30: note = hypo
  source 1..30: mol_type = genomic DNA
ctggccaggtgagggcgatcactccgtttc

SEQ ID NO: 96070 - DNA, 77 bp, Homo sapiens
  misc_feature 1..77: note = chr7:100715916-100715993
  misc_feature 1..77: note = hypo
  source 1..77: mol_type = genomic DNA
aaaggggctcaccaccgtaagcccagagctttccgtggccaaggcaggagaatcgttcaagcacaggagtttgagac

SEQ ID NO: 96071 - DNA, 17 bp, Homo sapiens
  misc_feature 1..17: note = chr7:100723832-100723849
  misc_feature 1..17: note = hypo
  source 1..17: mol_type = genomic DNA
gtttgttttttgagacg

SEQ ID NO: 96072 - DNA, 124 bp, Homo sapiens
  misc_feature 1..124: note = chr7:100770176-100770300
  misc_feature 1..124: note = hyper
  source 1..124: mol_type = genomic DNA
gaatgctcttacacacgtacacacacagagcagcacacacacacacacacacatgcctcagcaagtcccagagagggaggtgtcgagggggacccgctggctgttcagacggactcccagagcc

SEQ ID NO: 96073 - DNA, 145 bp, Homo sapiens; identical to SEQ ID NO: 41401
  misc_feature 1..145: note = chr7:100799106-100799251
  misc_feature 1..145: note = hypo
  source 1..145: mol_type = genomic DNA

SEQ ID NO: 96074 - DNA, 30 bp, Homo sapiens
  misc_feature 1..30: note = chr7:100806035-100806065
  misc_feature 1..30: note = hyper
  source 1..30: mol_type = genomic DNA
ctcgcacaaaccacccgccctcctgggctg

SEQ ID NO: 96075 - DNA, 665 bp, Homo sapiens
  misc_feature 1..665: note = chr7:100807394-100808059
  misc_feature 1..665: note = hyper
  source 1..665: mol_type = genomic DNA
tttcgggaaggggcccgctgtcgggcatacgcgcctggaattgagagggggccgggggcggcaggggcgcgcgctccgggacacgcgcctggaactctccccaggaagcgcgccatacgcgctctggccccgggctctccagattcactcgggtcagcgtgtgcgtgcgggtttccgtctctgctgccgccgtctcctgctggcgcttggcgctacttggactgaaatctcgcagttcctggagcagggacgctagcgcctcgagctcctcggagggatcgctcgcctcgggcccattctccggagtctgagggcgaggcggagccgcgggctccgggctctccggcgccgggaggctgtgggtctggctgcgcacggtctcggtcagcagagcttcagctgcttcttcctccggcccctgctgggagccgcttggtgccgggggtgaggcgggacggtcgagtgcctgcagcagcaccgcggccagcgcccggggatccacgccctggaaaagctctccctcgtcctgcggctcggaattccgagcgcctcggacctctggggcgctgccatcctttggcccgggcactgcgtccccggctaccggctctttatgctcagagctgagaggaggaggctgcgcctcagggcgaccagggggtgct

SEQ ID NO: 96076 - DNA, 113 bp, Homo sapiens
  misc_feature 1..113: note = chr7:100808389-100808502
  misc_feature 1..113: note = hyper
  source 1..113: mol_type = genomic DNA
ccatctcactgccatcgcccacgtactaagcagcagcaatatgggggaaaaaaaaatctctgctccctccccgtaggactccccggatggtgcgtgggcgacttcagcagcaa

SEQ ID NO: 96077 - DNA, 218 bp, Homo sapiens
  misc_feature 1..218: note = chr7:100809337-100809555
  misc_feature 1..218: note = hyper
  source 1..218: mol_type = genomic DNA
taaagattcaagagccgaccagggggccgggttccccaccccgagaccacgcgcccaaggacggcgtgaacctgagtgcagagggacagatctgcacgcctgcgggcgctgtccgcgaatcggcagtgcgggtggcagccccctgacaggggcagatgggtggatcttgcggttttggtaatcccatcgggaagggtccgagtcggaagagaaaaggg

SEQ ID NO: 96078 - DNA, 30 bp, Homo sapiens
  misc_feature 1..30: note = chr7:100809815-100809845
  misc_feature 1..30: note = hyper
  source 1..30: mol_type = genomic DNA
tccagctctctccaccgcttaaagggaagg

SEQ ID NO: 96079 - DNA, 48 bp, Homo sapiens
  misc_feature 1..48: note = chr7:100813879-100813927
  misc_feature 1..48: note = hyper
  source 1..48: mol_type = genomic DNA
gcaaaaccagagctgcggaaagtggcgaagcggcggctgcccctaccc

SEQ ID NO: 96080 - DNA, 30 bp, Homo sapiens
  misc_feature 1..30: note = chr7:100814949-100814979
  misc_feature 1..30: note = hyper
  source 1..30: mol_type = genomic DNA
gagttcttccacccacgagggggcagaagg

SEQ ID NO: 96081 - DNA, 278 bp, Homo sapiens
  misc_feature 1..278: note = chr7:100815652-100815930
  misc_feature 1..278: note = hyper
  source 1..278: mol_type = genomic DNA
gcgcgcggctgtccacgcgccactccaggcccttggccgccagcaggcgcaggttgctttcgctaggccggtagggctgccagtcctggatgatggtcccgcctggaagcacgtcgcgctgcacggagggtgacagcaggaggcgtgccacgtcgccgcctgcctcggacacggcctcggtgggcagcggcgagaaggtgccagaggtccgcagcgccgccagccgcgcgcccagcccggccagcagcgcggacgcgttgaatcggaccaaaaggatg

SEQ ID NO: 96082 - DNA, 44 bp, Homo sapiens
  misc_feature 1..44: note = chr7:100816611-100816655
  misc_feature 1..44: note = hyper
  source 1..44: mol_type = genomic DNA
gggggcccagctggtcgtcccgggtgagccgtgccaccttgacc

SEQ ID NO: 96083 - DNA, 87 bp, Homo sapiens
  misc_feature 1..87: note = chr7:100817650-100817737
  misc_feature 1..87: note = hyper
  source 1..87: mol_type = genomic DNA
agcaggctctatttccgcagcctccagaggaaggctggggagaagctctcatcctcctcttcctaagatccacgcacccgcaggtgg

SEQ ID NO: 96084 - DNA, 69 bp, Homo sapiens
  misc_feature 1..69: note = chr7:100822573-100822642
  misc_feature 1..69: note = hyper
  source 1..69: mol_type = genomic DNA
gacaggcagggaagccggaggaggcttcgacaccgaatcacagacatgacacctcgtgactctgggccc

SEQ ID NO: 96085 - DNA, 301 bp, Homo sapiens
  misc_feature 1..301: note = chr7:100823050-100823351
  misc_feature 1..301: note = hyper
  source 1..301: mol_type = genomic DNA
gagcgatctgcttggcgggggttcccctgggcgccggaccctggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggc

SEQ ID NO: 96086 - DNA, 390 bp, Homo sapiens
  misc_feature 1..390: note = chr7:100823380-100823770
  misc_feature 1..390: note = hyper
  source 1..390: mol_type = genomic DNA
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgcgccctgggcagctgggtggcctcaagccctactggcgagactccgccctgtgtcccggctggggagtggg

SEQ ID NO: 96087 - DNA, 134 bp, Homo sapiens
  misc_feature 1..134: note = chr7:100845293-100845427
  misc_feature 1..134: note = hyper
  source 1..134: mol_type = genomic DNA
ctccttggggataggcgggaacagagttcagggctggcgcggtggccaaaggccagtctgggtggccccaacccgggacggggagggagcgggccctgggccaggatcgcggggcggaggccggggctcaccta

SEQ ID NO: 96088 - DNA, 122 bp, Homo sapiens
  misc_feature 1..122: note = chr7:100845444-100845566
  misc_feature 1..122: note = hyper
  source 1..122: mol_type = genomic DNA
cggaagggcagcgggaggccccggcggcccaggaacagctgcagggccacgcttagcagcggacgcagagcctcctgcgtcctctgcacccacgagctctgcgggttcgggaactgctggaa

SEQ ID NO: 96089 - DNA, 30 bp, Homo sapiens; identical to SEQ ID NO: 41402
  misc_feature 1..30: note = chr7:100858230-100858260
  misc_feature 1..30: note = hypo
  source 1..30: mol_type = genomic DNA

SEQ ID NO: 96090 - DNA, 39 bp, Homo sapiens; identical to SEQ ID NO: 41403
  misc_feature 1..39: note = chr7:100894771-100894810
  misc_feature 1..39: note = hypo
  source 1..39: mol_type = genomic DNA

SEQ ID NO: 96091 - DNA, 34 bp, Homo sapiens; identical to SEQ ID NO: 41404
  misc_feature 1..34: note = chr7:100897086-100897120
  misc_feature 1..34: note = hypo
  source 1..34: mol_type = genomic DNA

SEQ ID NO: 96092 - DNA, 161 bp, Homo sapiens
  misc_feature 1..161: note = chr7:100912996-100913157
  misc_feature 1..161: note = hypo
  source 1..161: mol_type = genomic DNA
agttttgtatttttatttttatttattgttttatgggggctacagcggcaggtggcaaggcgccacgcctgagtggggatggcgagattgttctccaatcgccaacctcaatggtgcaacgggagacggacatgggaaggctatgacgtcacgggccctgt

SEQ ID NO: 96093 - DNA, 358 bp, Homo sapiens
  misc_feature 1..358: note = chr7:100943169-100943527
  misc_feature 1..358: note = hyper
  source 1..358: mol_type = genomic DNA
ccgcagtcccgctaccgacttccacagccccccgaccctcgcgggcctccagaatgggcagcggccgagagattccccagcggcgttgcaggagcccacgtggagcccacgggcttccctgccctgagcagctgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccgccggcagcctggggcc

SEQ ID NO: 96094 - DNA, 122 bp, Homo sapiens
  misc_feature 1..122: note = chr7:100946544-100946666
  misc_feature 1..122: note = hyper
  source 1..122: mol_type = genomic DNA
gactaataaccccaccgccaccgcgggactcagacgcgaaccaaccgcttgcctgctctaccccgcctgagctttcctggggaccagcccttccctgtccgtcctagccagcgaccgaaccc

SEQ ID NO: 96095 - DNA, 160 bp, Homo sapiens
  misc_feature 1..160: note = chr7:100951829-100951989
  misc_feature 1..160: note = hyper
  source 1..160: mol_type = genomic DNA
gtgagtgagagaccccggggctatgcagttcccccagggacttccacagccccccgaccctcgcggacctccagaatagggggcagcgggcgagagattccccagcggcgttgcaggagcccacgtggagcccacgtggagcccacgggcttccttgccc

SEQ ID NO: 96096 - DNA, 30 bp, Homo sapiens; identical to SEQ ID NO: 41405
  misc_feature 1..30: note = chr7:100967105-100967135
  misc_feature 1..30: note = hypo
  source 1..30: mol_type = genomic DNA

SEQ ID NO: 96097 - DNA, 647 bp, Homo sapiens
  misc_feature 1..647: note = chr7:101005996-101006643
  misc_feature 1..647: note = hyper
  source 1..647: mol_type = genomic DNA
tccagggacctcctgcggagctcgcaccctagctctgccgccactgccgcctcctcggccccggaccgccgagggttaacaaaaaagccccacgccccctttgacggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggtgagtagctcggggccgaggggccggggggtggggggagggagcggacagcgggggccctggccactgggtggctggagcgaggcttgggggctggagagcggggcgatccgggacttgggggcgcagggcagcggggactgggggctgcagacaccgggcagctggaacg

SEQ ID NO: 96098 - DNA, 18 bp, Homo sapiens
  misc_feature 1..18: note = chr7:101056505-101056523
  misc_feature 1..18: note = hypo
  source 1..18: mol_type = genomic DNA
aaagagacttgtggccgg

SEQ ID NO: 96099 - DNA, 24 bp, Homo sapiens
  misc_feature 1..24: note = chr7:101090772-101090796
  misc_feature 1..24: note = hypo
  source 1..24: mol_type = genomic DNA
aacttcctccgttatgatttttgc

SEQ ID NO: 96100 - DNA, 41 bp, Homo sapiens
  misc_feature 1..41: note = chr7:101116625-101116666
  misc_feature 1..41: note = hypo
  source 1..41: mol_type = genomic DNA
ggattacaggcgtgagccactgcgcccggcctgggttgcat

SEQ ID NO: 96101 - DNA, 87 bp, Homo sapiens; identical to SEQ ID NO: 41407
  misc_feature 1..87: note = chr7:101131936-101132023
  misc_feature 1..87: note = hypo
  source 1..87: mol_type = genomic DNA

SEQ ID NO: 96102 - DNA, 38 bp, Homo sapiens
  misc_feature 1..38: note = chr7:101137675-101137713
  misc_feature 1..38: note = hypo
  source 1..38: mol_type = genomic DNA
gggattacagatgtgagccactgcgcctggctgtctat

SEQ ID NO: 96103 - DNA, 30 bp, Homo sapiens
  misc_feature 1..30: note = chr7:101151473-101151503
  misc_feature 1..30: note = hypo
  source 1..30: mol_type = genomic DNA
acagaatcccagctccgtcatgtaactgtt

SEQ ID NO: 96104 - DNA, 30 bp, Homo sapiens
  misc_feature 1..30: note = chr7:101178233-101178263
  misc_feature 1..30: note = hypo
  source 1..30: mol_type = genomic DNA
tagtgctgtcacccacgccagccacgtcac

SEQ ID NO: 96105 - DNA, 230 bp, Homo sapiens
  misc_feature 1..230: note = chr7:101191125-101191355
  misc_feature 1..230: note = hypo
  source 1..230: mol_type = genomic DNA
attcatttctctgtgcgtctcacaaacattcattgaacatctgccactacatgtgccagacagtgatctaggttcccggaactcctgaataatcaaaacaaacatcatcgagaaactctcattctggtggaggacaggaatatcatcataaattgtgacttcgacaggatctgagggagctacaagggagaagctggggcgtggcggggaggcgccgtcaaaacgtgaca

SEQ ID NO: 96106 - DNA, 30 bp, Homo sapiens
  misc_feature 1..30: note = chr7:101206277-101206307
  misc_feature 1..30: note = hypo
  source 1..30: mol_type = genomic DNA
cacacaggcggttggcggtgaagctgagtt

SEQ ID NO: 96107 - DNA, 30 bp, Homo sapiens
  misc_feature 1..30: note = chr7:101207916-101207946
  misc_feature 1..30: note = hypo
  source 1..30: mol_type = genomic DNA
gggcaactgtcctaccggaatggcagaaac

SEQ ID NO: 96108 - DNA, 333 bp, Homo sapiens
  misc_feature 1..333: note = chr7:101241831-101242164
  misc_feature 1..333: note = hypo
  source 1..333: mol_type = genomic DNA
tatgatctcacctctcggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtgaaactgcacaggcggacgggcagagcgtccaccctggagaagagacccaggcccaaccaggccccagagcctgcacgagcacctggagtggcagggacagcccagccccctcctgccccacttcctgggaagcagcagcttgtgtgttctggtcggtcggctttggcaaagc

SEQ ID NO: 96109 - DNA, 30 bp, Homo sapiens
  misc_feature 1..30: note = chr7:101262039-101262069
  misc_feature 1..30: note = hypo
  source 1..30: mol_type = genomic DNA
catgacaggctcagccggagccccagtccc

SEQ ID NO: 96110 - DNA, 30 bp, Homo sapiens
  misc_feature 1..30: note = chr7:101392564-101392594
  misc_feature 1..30: note = hypo
  source 1..30: mol_type = genomic DNA
accgagacagcagttcgatttgaaacttga

SEQ ID NO: 96111 - DNA, 68 bp, Homo sapiens
  misc_feature 1..68: note = chr7:101475790-101475858
  misc_feature 1..68: note = hypo
  source 1..68: mol_type = genomic DNA
caaacacaagtggggcgacaggacccacacttcggcgttggacgtgactcacgcggggagttggcttg

SEQ ID NO: 96112 - DNA, 30 bp, Homo sapiens
  misc_feature 1..30: note = chr7:101480043-101480073
  misc_feature 1..30: note = hypo
  source 1..30: mol_type = genomic DNA
gaaaccgggagtgcccgttgtctgcctgga

SEQ ID NO: 96113 - DNA, 38 bp, Homo sapiens
  misc_feature 1..38: note = chr7:101521914-101521952
  misc_feature 1..38: note = hypo
  source 1..38: mol_type = genomic DNA
aagagaaaaaaaagacgcaccagcggcttacaagatct

SEQ ID NO: 96114 - DNA, 149 bp, Homo sapiens
  misc_feature 1..149: note = chr7:101586167-101586316
  misc_feature 1..149: note = hypo
  source 1..149: mol_type = genomic DNA
agatcttggttccatcggctgctgggagatcagttcccttctctgcacctccattcagcttggacgggaatctgtccttcctagaacagctgtgattaataactgagaccacacccatgttcgttgtggcttagcgccatgcacacagg

SEQ ID NO: 96115 - DNA, 30 bp, Homo sapiens
  misc_feature 1..30: note = chr7:101596278-101596308
  misc_feature 1..30: note = hypo
  source 1..30: mol_type = genomic DNA
gcagagggaccccttcggagcatctcagag

SEQ ID NO: 96116 - DNA, 39 bp, Homo sapiens
  misc_feature 1..39: note = chr7:101603269-101603308
  misc_feature 1..39: note = hypo
  source 1..39: mol_type = genomic DNA
acattggcacggttgcgtaagaatcgcacggtcccatga

SEQ ID NO: 96117 - DNA, 89 bp, Homo sapiens
  misc_feature 1..89: note = chr7:101627757-101627846
  misc_feature 1..89: note = hypo
  source 1..89: mol_type = genomic DNA
gctcagattgttctccggcaaaaaaaaaaaaaaaaaaaagtgcttgcagtgagaacctgccctgcactctcaggcgagctgttgggtgc

SEQ ID NO: 96118 - DNA, 30 bp, Homo sapiens
  misc_feature 1..30: note = chr7:101628185-101628215
  misc_feature 1..30: note = hypo
  source 1..30: mol_type = genomic DNA
ttcgttgttttaaaacgtctgagaattata

SEQ ID NO: 96119 - DNA, 120 bp, Homo sapiens
  misc_feature 1..120: note = chr7:101630456-101630576
  misc_feature 1..120: note = hypo
  source 1..120: mol_type = genomic DNA
ttcactcccgcatcccgacacagtgcccagcacatcatcgatgaatgagtgtggggcaaatgcttgcacagaagtccgtgcgtgagccacgacggtaaacagaggcgctcctcttgtcct

SEQ ID NO: 96120 - DNA, 115 bp, Homo sapiens; identical to SEQ ID NO: 41412
  misc_feature 1..115: note = chr7:101652590-101652705
  misc_feature 1..115: note = hypo
  source 1..115: mol_type = genomic DNA

SEQ ID NO: 96121 - DNA, 78 bp, Homo sapiens; identical to SEQ ID NO: 15018
  misc_feature 1..78: note = chr7:101656381-101656459
  misc_feature 1..78: note = hypo
  source 1..78: mol_type = genomic DNA

SEQ ID NO: 96122 - DNA, 30 bp, Homo sapiens; identical to SEQ ID NO: 41414
  misc_feature 1..30: note = chr7:101707051-101707081
  misc_feature 1..30: note = hypo
  source 1..30: mol_type = genomic DNA

SEQ ID NO: 96123 - DNA, 102 bp, Homo sapiens
  misc_feature 1..102: note = chr7:101707433-101707535
  misc_feature 1..102: note = hypo
  source 1..102: mol_type = genomic DNA
aggccagtgtctaaccgtctctagatccgtcctggtttagcttcttccaaatagttttgtgtctgtgtgagagtgtgtgtgaaacggagttttgctgtgttg

SEQ ID NO: 96124 - DNA, 101 bp, Homo sapiens
  misc_feature 1..101: note = chr7:101707595-101707696
  misc_feature 1..101: note = hypo
  source 1..101: mol_type = genomic DNA
ctgggattacaggcatgagcaacggtgccggctctaaatggttttaagggcacggtacctacctcaagctaacgtgcaggcaggcacgaggtagctggaat

SEQ ID NO: 96125 - DNA, 30 bp, Homo sapiens
  misc_feature 1..30: note = chr7:1019055-1019085
  misc_feature 1..30: note = hypo
  source 1..30: mol_type = genomic DNA
gacaagggctaggatcgttgaccttatctt

SEQ ID NO: 96126 - DNA, 30 bp, Homo sapiens
  misc_feature 1..30: note = chr7:102091922-102091952
  misc_feature 1..30: note = hypo
  source 1..30: mol_type = genomic DNA
agcccttacctgcctcgtgctgatgatcta

SEQ ID NO: 96127 - DNA, 97 bp, Homo sapiens; identical to SEQ ID NO: 41417
  misc_feature 1..97: note = chr7:102097002-102097099
  misc_feature 1..97: note = hypo
  source 1..97: mol_type = genomic DNA

SEQ ID NO: 96128 - DNA, 29 bp, Homo sapiens
  misc_feature 1..29: note = chr7:102133076-102133105
  misc_feature 1..29: note = hypo
  source 1..29: mol_type = genomic DNA
acaacctggtaaggtcggatcaacttcct

SEQ ID NO: 96129 - DNA, 212 bp, Homo sapiens
  misc_feature 1..212: note = chr7:1022042-1022254
  misc_feature 1..212: note = hypo
  source 1..212: mol_type = genomic DNA
tgtgcaaagcaggcccggccgcttctgctgccagcagccctcccacccctcacagcggtttaggagacagatggacagggctcgtaaaccccgccacctgccacccggcagcccttccatgttcctgtcctagctcagagggttgcatcccctgcccgggcggcagccctcgaaaaggagcaggctgctacctggggcgagaacaccctcag

SEQ ID NO: 96130 - DNA, 29 bp, Homo sapiens
  misc_feature 1..29: note = chr7:102232246-102232275
  misc_feature 1..29: note = hypo
  source 1..29: mol_type = genomic DNA
acaacctggtaaggtcggatcaacttcct

SEQ ID NO: 96131 - DNA, 79 bp, Homo sapiens
  misc_feature 1..79: note = chr7:1022888-1022967
  misc_feature 1..79: note = hypo
  source 1..79: mol_type = genomic DNA
ctgggggctgctctgcgcctgcgcccaagacccctccccagctgcccggtggcccccggggcctcgcccgctgccgctc

SEQ ID NO: 96132 - DNA, 52 bp, Homo sapiens
  misc_feature 1..52: note = chr7:1023349-1023401
  misc_feature 1..52: note = hypo
  source 1..52: mol_type = genomic DNA
agggcctgggcctgtcggctgcctgctcagcccccctcggccctcaggtgtt

SEQ ID NO: 96133 - DNA, 624 bp, Homo sapiens
  misc_feature 1..624: note = chr7:1026795-1027419
  misc_feature 1..624: note = hypo
  source 1..624: mol_type = genomic DNA
ggacatggtcatggccgggacggagacgacctcggccacgctgcagtgggccgcacttctgatgggccggcacccggacgtgcagggtgagaccccggcgcctggcgagacggctccttctgcccccgggggacccccagggacgagggatggcgctgccacccaagcggcccaccctttgccccaggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaaggtggggctgggcctcccttgccccttccatctcctctggggtaggcctcggcgggggtccaggggcactgggacggctgagcgtctggtgggtgcctgatggcccagcgctccccgaccggaggcaataaagggcgtccagccaggagcaggagggaggcagccctctcaccccacagcccagcacttggcctggccagcagacctggcgcctccctgcatgtcctggggtcccctccgtgtgtcctgtggg

SEQ ID NO: 96134 - DNA, 41 bp, Homo sapiens
  misc_feature 1..41: note = chr7:102782018-102782059
  misc_feature 1..41: note = hypo
  source 1..41: mol_type = genomic DNA
aggctgtgatacatgcggcgatcaatcttcttagattcacg

SEQ ID NO: 96135 - DNA, 40 bp, Homo sapiens
  misc_feature 1..40: note = chr7:102782119-102782159
  misc_feature 1..40: note = hypo
  source 1..40: mol_type = genomic DNA
cattcgggcattggctgtacccttccgcttacctatgccc

SEQ ID NO: 96136 - DNA, 145 bp, Homo sapiens
  misc_feature 1..145: note = chr7:102921382-102921527
  misc_feature 1..145: note = hyper
  source 1..145: mol_type = genomic DNA
ccgccggtggtgctccgggcattaggaacgtctctgctctcctacgatcgctgaggtatcggacagtcagtgcccgttgccaacacggagggaacgggccgagactgcgggcaacacgtggcagagccggcgtgagtctggtggg

SEQ ID NO: 96137 - DNA, 328 bp, Homo sapiens
  misc_feature 1..328: note = chr7:1030000-1030328
  misc_feature 1..328: note = hypo
  source 1..328: mol_type = genomic DNA
gacagtggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaaggccaggacgtggtggccgggacacacgggtgcacggcaggcctcacactcccaggtggggccgcagggtccctaagtcatgggtggggctgctgctacggaggctgctgcaaggacgagaaggggacggagggatggaggctcggctgcgtccgctc

SEQ ID NO: 96138 - DNA, 903 bp, Homo sapiens
  misc_feature 1..903: note = chr7:103085831-103086734
  misc_feature 1..903: note = hyper
  source 1..903: mol_type = genomic DNA
cactgccgcgagcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggattagcaccgaagggattcgaggaggcaaacgggaagtaaaaatgctgtgtggagctgcagagggcaaggggacaggggttgcaaaggaaagagcttcgtgagactttctccttcccggcgtagggaccagcagagtgcgggcaggtcagccctgtcaccggttcgtttagggaaaaagcgcgacatggggcctgggagacaggggcagaggcggtgacagcgagggcccctgctcgggtgggcccgcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 96139 - DNA, 182 bp, Homo sapiens
  misc_feature 1..182: note = chr7:1031815-1031997
  misc_feature 1..182: note = hypo
  source 1..182: mol_type = genomic DNA
gcccctgtacccccccgcctctaggtctccagggaaggaccctcctggggtgggcaggctgctcttggccccagatctgcttctgggtctgaggctggccctcagccgtgctgcacgtgcctcccattaccatcctaagtcaaggcaaaacaaaaccacacagtccccgagccatctgcaaa

SEQ ID NO: 96140 - DNA, 86 bp, Homo sapiens
  misc_feature 1..86: note = chr7:103395555-103395641
  misc_feature 1..86: note = hypo
  source 1..86: mol_type = genomic DNA
tatggagatgaggaccgaagggatttttttgttgtttgttttgtttcttaagatattatgatagtggccgggcccggtggctcatg

SEQ ID NO: 96141 - DNA, 736 bp, Homo sapiens; identical to SEQ ID NO: 31445
  misc_feature 1..736: note = chr7:103629059-103629795
  misc_feature 1..736: note = hyper
  source 1..736: mol_type = genomic DNA

SEQ ID NO: 96142 - DNA, 30 bp, Homo sapiens; identical to SEQ ID NO: 31446
  misc_feature 1..30: note = chr7:103630053-103630083
  misc_feature 1..30: note = hyper
  source 1..30: mol_type = genomic DNA

SEQ ID NO: 96143 - DNA, 186 bp, Homo sapiens
  misc_feature 1..186: note = chr7:103630363-103630549
  misc_feature 1..186: note = hyper
  source 1..186: mol_type = genomic DNA
cgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagcc

SEQ ID NO: 96144 - DNA, 468 bp, Homo sapiens
  misc_feature 1..468: note = chr7:103630550-103631018
  misc_feature 1..468: note = hyper
  source 1..468: mol_type = genomic DNA
gctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 96145 - DNA, 85 bp, Homo sapiens
  misc_feature 1..85: note = chr7:1037221-1037306
  misc_feature 1..85: note = hypo
  source 1..85: mol_type = genomic DNA
ccctgcactgggcagcggccccgccccgcgctgaacccactaggagagcagctgcagcacctgtcggatgcgctgggccctcccc

SEQ ID NO: 96146 - DNA, 149 bp, Homo sapiens
  misc_feature 1..149: note = chr7:103968582-103968731
  misc_feature 1..149: note = hyper
  source 1..149: mol_type = genomic DNA
caaagatgcagaggtcgaagcacgtttctgtgcggtgatgaaatgctcgctgaatcagcctctcgagcccggcctctcacacccaccaggatcctggggttgtctctaggatccctgtgggtgctcctgccaccttcttagactaccct

SEQ ID NO: 96147 - DNA, 251 bp, Homo sapiens; identical to SEQ ID NO: 3084
  misc_feature 1..251: note = chr7:103968915-103969166
  misc_feature 1..251: note = hyper
  source 1..251: mol_type = genomic DNA

SEQ ID NO: 96148 - DNA, 355 bp, Homo sapiens; identical to SEQ ID NO: 3085
  misc_feature 1..355: note = chr7:103969167-103969522
  misc_feature 1..355: note = hyper
  source 1..355: mol_type = genomic DNA

SEQ ID NO: 96149 - DNA, 117 bp, Homo sapiens
  misc_feature 1..117: note = chr7:103969562-103969679
  misc_feature 1..117: note = hyper
  source 1..117: mol_type = genomic DNA
cggcctctccatgatgctcatcattgcctgcatcatttgctttaccctcttcttcttctgcaacacggccactgtgtacaagatatgtgcctggatgcagctcacctccggtgagtg

SEQ ID NO: 96150 - DNA, 434 bp, Homo sapiens
  misc_feature 1..434: note = chr7:103969693-103970127
  misc_feature 1..434: note = hyper
  source 1..434: mol_type = genomic DNA
cggaggcggaggaccccggggcgcccgagccggggaggggccagagtgggagggacgggggctgtgcgcgccgctgcgagccaagccgcctaatccgctcaggcgtcgaggtgtggggggcgggagcccagcgaggccggaacccccggggttccccagccccggcgctggcgcctcgtcccggggctttcgtgagcctcccaagtgtgggggacgcccactcagagggacgccccggaggcagggcggttgtggggccgagtccgctcagaactaaggatggtgggtggagaagtggccgcttagagagatggggccggggttccgtgctgagggactaaggagggactgacagggcgaagtgaaaagcggatttggagaggtcatagtggaaggagcagccagcctgccctgcccctcgctgctgggactat

SEQ ID NO: 96151 - DNA, 42 bp, Homo sapiens
  misc_feature 1..42: note = chr7:104628051-104628093
  misc_feature 1..42: note = hypo
  source 1..42: mol_type = genomic DNA
acaggcatgagccaccacgcctggccacggcctttattttaa

SEQ ID NO: 96152 - DNA, 30 bp, Homo sapiens
  misc_feature 1..30: note = chr7:105086390-105086420
  misc_feature 1..30: note = hypo
  source 1..30: mol_type = genomic DNA
gtgagccaccgcgcccggcccaaagataaa

SEQ ID NO: 96153 - DNA, 79 bp, Homo sapiens
  misc_feature 1..79: note = chr7:105171453-105171532
  misc_feature 1..79: note = hypo
  source 1..79: mol_type = genomic DNA
aacgccattgcaccccagcctgagcaaaaaaaaaacaaacacacatgtacactataaatatatacgattatgttcccat

SEQ ID NO: 96154 - DNA, 30 bp, Homo sapiens
  misc_feature 1..30: note = chr7:105220974-105221004
  misc_feature 1..30: note = hypo
  source 1..30: mol_type = genomic DNA
gcagtggcgccatctcgtgcccggcctttt

SEQ ID NO: 96155 - DNA, 296 bp, Homo sapiens
  misc_feature 1..296: note = chr7:105279375-105279671
  misc_feature 1..296: note = hypo
  source 1..296: mol_type = genomic DNA
gtgggaggctcgattcggcccagacaaacagagccaccaagcagagagggccatcgccttgatcccaagaagcactagcagttcagcatgaaatacagggctttgggcgacccaatggcggccgccttgggtcagctgttcccctggccaccccggtgtggctggatcaggggcgcggcatatcatcctcccctccagggctgcctttcagggcgctgccgccgccgccgccgccgctgccgctgctcctgcatacattaaaacgtagcaggctttagaaccgcctgtgagtgcct

SEQ ID NO: 96156 - DNA, 30 bp, Homo sapiens; identical to SEQ ID NO: 41420
  misc_feature 1..30: note = chr7:105280417-105280447
  misc_feature 1..30: note = hypo
  source 1..30: mol_type = genomic DNA

SEQ ID NO: 96157 - DNA, 66 bp, Homo sapiens
  misc_feature 1..66: note = chr7:105288157-105288223
  misc_feature 1..66: note = hypo
  source 1..66: mol_type = genomic DNA
ctcctctaaagtcaacgtcaggctctgaatgtgctccttaaggcagccccacgagcacaggtgcac

SEQ ID NO: 96158 - DNA, 30 bp, Homo sapiens
  misc_feature 1..30: note = chr7:105331896-105331926
  misc_feature 1..30: note = hyper
  source 1..30: mol_type = genomic DNA
actcttatgcatccccgtttcttcaaaaaa

SEQ ID NO: 96159 - DNA, 30 bp, Homo sapiens
  misc_feature 1..30: note = chr7:105432522-105432552
  misc_feature 1..30: note = hypo
  source 1..30: mol_type = genomic DNA
ctgcagagcccatcccgtctcccccacccc

SEQ ID NO: 96160 - DNA, 252 bp, Homo sapiens; identical to SEQ ID NO: 41054
  misc_feature 1..252: note = chr7:1054444-1054696
  misc_feature 1..252: note = hypo
  source 1..252: mol_type = genomic DNA

SEQ ID NO: 96161 - DNA, 115 bp, Homo sapiens
  misc_feature 1..115: note = chr7:105649670-105649785
  misc_feature 1..115: note = hypo
  source 1..115: mol_type = genomic DNA
cagccaccctatgaacgccaagatgtgaggaagggcaacgaaagggacccctcctctgcagttccaggggcggaggtcttcagcctaaagcccagcctcgcgtcccaaggctgca

SEQ ID NO: 96162 - DNA, 30 bp, Homo sapiens
  misc_feature 1..30: note = chr7:105753818-105753848
  misc_feature 1..30: note = hypo
  source 1..30: mol_type = genomic DNA
cgtccttgtagtaagcgaaccctttctctt

SEQ ID NO: 96163 - DNA, 35 bp, Homo sapiens
  misc_feature 1..35: note = chr7:106123211-106123246
  misc_feature 1..35: note = hypo
  source 1..35: mol_type = genomic DNA
gtctgctggagctgccgtagtaaaatgctacaggc

SEQ ID NO: 96164 - DNA, 95 bp, Homo sapiens
  misc_feature 1..95: note = chr7:106123306-106123401
  misc_feature 1..95: note = hypo
  source 1..95: mol_type = genomic DNA
tcaaggtgctggtgaggcaggttttattctgagttctcttctcttagccagtaggcagctgcgacctcaccgtgtgctcacgtgaccttttcttt

SEQ ID NO: 96165 - DNA, 126 bp, Homo sapiens
  misc_feature 1..126: note = chr7:106507970-106508096
  misc_feature 1..126: note = hypo
  source 1..126: mol_type = genomic DNA
atccctgtgtccctccgctcccaggtcgcatagggcatggagctggagaactataaacagcccgtggtgctgagagaggacaactgccgaaggcgccggaggatgaagccgcgcagtgctgcggcc

SEQ ID NO: 96166 - DNA, 290 bp, Homo sapiens; identical to SEQ ID NO: 41424
  misc_feature 1..290: note = chr7:106508656-106508946
  misc_feature 1..290: note = hypo
  source 1..290: mol_type = genomic DNA

SEQ ID NO: 96167 - DNA, 405 bp, Homo sapiens
  misc_feature 1..405: note = chr7:1065987-1066392
  misc_feature 1..405: note = hypo
  source 1..405: mol_type = genomic DNA
cgggaggcaagggttcgcacggcagtgcttctgtgtcgacagaggctgtgctgcagctccctgccaggcccgtgtccttcctagctgtgagaacactaacctgcctgggcttcacctgtggaagccaccgctaactagcagtcggaggcggcgttgtttctaagacaggcaggcagctccggcaggagcagccgctaagcacaaggacggccaaccacacaaagcctgcttctcaaccactcgcaggaaatcggctcacagttgctccccattcttcaatgctgatcctgccactttactgaaaatcacattattaacgtttaaaaaacgtatgggaaccatgcaaagacatccacgcccctcagttgctgccgctccagcacctggctccgaagtctgtgcaga

SEQ ID NO: 96168 - DNA, 39 bp, Homo sapiens
  misc_feature 1..39: note = chr7:106609350-106609389
  misc_feature 1..39: note = hypo
  source 1..39: mol_type = genomic DNA
agttgaattgagggtcgggtgcatggctcacgcctgtaa

SEQ ID NO: 96169 - DNA, 22 bp, Homo sapiens
  misc_feature 1..22: note = chr7:106636238-106636260
  misc_feature 1..22: note = hypo
  source 1..22: mol_type = genomic DNA
aaaaacccgtgtattttacttt

SEQ ID NO: 96170 - DNA, 30 bp, Homo sapiens
  misc_feature 1..30: note = chr7:106637063-106637093
  misc_feature 1..30: note = hypo
  source 1..30: mol_type = genomic DNA
tgagggttagtacaacgctagtttgaatta

SEQ ID NO: 96171 - DNA, 30 bp, Homo sapiens
  misc_feature 1..30: note = chr7:106644946-106644976
  misc_feature 1..30: note = hypo
  source 1..30: mol_type = genomic DNA
acagtagaaagaacacggattttgatatta

SEQ ID NO: 96172 - DNA, 79 bp, Homo sapiens
  misc_feature 1..79: note = chr7:106651422-106651501
  misc_feature 1..79: note = hypo
  source 1..79: mol_type = genomic DNA
atagtggatcagttgcggtacacagacttcattatgaggtctaccatgagaaactttatattctgacttaaaaatgtcc

SEQ ID NO: 96173 - DNA, 18 bp, Homo sapiens
  misc_feature 1..18: note = chr7:106653764-106653782
  misc_feature 1..18: note = hypo
  source 1..18: mol_type = genomic DNA
aaaggctggtcatggcgg

SEQ ID NO: 96174 - DNA, 88 bp, Homo sapiens
  misc_feature 1..88: note = chr7:106684832-106684920
  misc_feature 1..88: note = hyper
  source 1..88: mol_type = genomic DNA
atgacgcctgggaagcggggcgagtggccagcccgctcctggacgcgcggacaggtggacacgaaggcggcctcgctgggcctccctc

SEQ ID NO: 96175 - DNA, 749 bp, Homo sapiens
  misc_feature 1..749: note = chr7:106685171-106685920
  misc_feature 1..749: note = hyper
  source 1..749: mol_type = genomic DNA
ggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttacc

SEQ ID NO: 96176 - DNA, 103 bp, Homo sapiens
  misc_feature 1..103: note = chr7:106712145-106712248
  misc_feature 1..103: note = hypo
  source 1..103: mol_type = genomic DNA
atttctacctcaaaccgtatgacatgtgacatttatttctgggcacgttccattagtatttgttgtacattatacgtatcattggctgggcgaggtggctcac

SEQ ID NO: 96177 - DNA, 16 bp, Homo sapiens
  misc_feature 1..16: note = chr7:106748394-106748410
  misc_feature 1..16: note = hypo
  source 1..16: mol_type = genomic DNA
ccggccaagagatgtt

SEQ ID NO: 96178 - DNA, 20 bp, Homo sapiens
  misc_feature 1..20: note = chr7:106796956-106796976
  misc_feature 1..20: note = hypo
  source 1..20: mol_type = genomic DNA
ctcttcatttagggccgggc

SEQ ID NO: 96179 - DNA, 20 bp, Homo sapiens
  misc_feature 1..20: note = chr7:106797276-106797296
  misc_feature 1..20: note = hypo
  source 1..20: mol_type = genomic DNA
gaaaccgagacagcttgttc

SEQ ID NO: 96180 - DNA, 105 bp, Homo sapiens
  misc_feature 1..105: note = chr7:106797653-106797758
  misc_feature 1..105: note = hypo
  source 1..105: mol_type = genomic DNA
tggtgcagtagaaatcgctcgatgctcgcggggacagtactttggagagcttgccctggtaactaacaaacctcgagcagcttctgcccacgccattgggactgt

SEQ ID NO: 96181 - DNA, 90 bp, Homo sapiens
  misc_feature 1..90: note = chr7:106802877-106802967
  misc_feature 1..90: note = hypo
  source 1..90: mol_type = genomic DNA
acagagcgagactccgtccataaaacaaacaagcttaaaaattcttcaagtgaaacggcatgaagcaagagacttcggattttattgaaa

SEQ ID NO: 96182 - DNA, 178 bp, Homo sapiens
  misc_feature 1..178: note = chr7:106837489-106837667
  misc_feature 1..178: note = hypo
  source 1..178: mol_type = genomic DNA
ccagagttgtcaaaacggtgaacttaagagctgtcctcagtagaagctggaaataaaaatcaactcaagtccttcctactctgttgcctgtacccttactcatctccgagtcctctactgctgaatccctctcaaaccagtcaagttctccatatattaataacgctgtcttcttcca

SEQ ID NO: 96183 - DNA, 30 bp, Homo sapiens
  misc_feature 1..30: note = chr7:107060805-107060835
  misc_feature 1..30: note = hypo
  source 1..30: mol_type = genomic DNA
tattattcttttgatcgggatagggagaag

SEQ ID NO: 96184 - DNA, 100 bp, Homo sapiens
  misc_feature 1..100: note = chr7:107148303-107148403
  misc_feature 1..100: note = hypo
  source 1..100: mol_type = genomic DNA
ataatgcttctatgacgtatttggttttaagaatattctctcatggggtgggtggagctaagatggctgaacaggaacagctcccagcgtgagcgacgca

SEQ ID NO: 96185 - DNA, 30 bp, Homo sapiens
  misc_feature 1..30: note = chr7:1071811-1071841
  misc_feature 1..30: note = hypo
  source 1..30: mol_type = genomic DNA
ccagagaactgctcccggcccacggggctg

SEQ ID NO: 96186 - DNA, 1363 bp, Homo sapiens
  misc_feature 1..1363: note = chr7:107300982-107302345
  misc_feature 1..1363: note = hyper
  source 1..1363: mol_type = genomic DNA
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggactgggtggaactcgggaagcccccagagcaggggcttactcgcttcaagtttggggaaccccgggcagcgggtgcaggccacgagacccgaaggttctcaggtgcccccctgcaggctggccgtgcgcgccgtggggcgcttgtcgcgagcgccgagggctgcaggacgcggaccagactcgcggtgcaggggggcctggctgcagctaacaggtgatcccgttctttctgttcctcgctcttcccctccgatcgtcctcgcttaccgcgtgtcctccctcctcgctgtcctctggctcgcaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcaggtagcggccgcgcgggcctgcgtagagagaagcggagcggggcgtccacgccttggggagggaagggcgtccccagcgggcgagagtggggtgcg

SEQ ID NO: 96187 - DNA, 149 bp, Homo sapiens
  misc_feature 1..149: note = chr7:10730732-10730881
  misc_feature 1..149: note = hypo
  source 1..149: mol_type = genomic DNA
tgaactgaaactctacgatgaaacattgtatttccatttaagtaagagcgttctgaagatctcatgatttcaatggaaagaaatggcttctgtgatgattacttcaaatatacataatacgattgtgtgcaaaacatttgggaggccgg

SEQ ID NO: 96188 - DNA, 224 bp, Homo sapiens
  misc_feature 1..224: note = chr7:107483694-107483918
  misc_feature 1..224: note = hypo
  source 1..224: mol_type = genomic DNA
atttcagcagagacccgcaggtacaaggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcactgacctccaatcaactgtcacatgaaaataccaaaagcggcagtgttccttt

SEQ ID NO: 96189 - DNA, 89 bp, Homo sapiens
  misc_feature 1..89: note = chr7:107642639-107642728
  misc_feature 1..89: note = hyper
  source 1..89: mol_type = genomic DNA
tgtgagcttgggaagcgagagtgcgtgtgcgtgcacgcgcgagggtcaccggcgcttcgctggggacgaggcgccggggctcgcggtgg

SEQ ID NO: 96190 - DNA, 113 bp, Homo sapiens
  misc_feature 1..113: note = chr7:107643070-107643183
  misc_feature 1..113: note = hyper
  source 1..113: mol_type = genomic DNA
cttgggcgcagagcccgggggatgagggtccgcggcgctccgcgtgcgctgtctccagccaccaccgaagcaagggcggtggcgtttaatcccaggggcgtcatttccatcca

SEQ ID NO: 96191 - DNA, 273 bp, Homo sapiens
  misc_feature 1..273: note = chr7:107643722-107643995
  misc_feature 1..273: note = hyper
  source 1..273: mol_type = genomic DNA
cccggtcccaccccccggggcgcctcttttgtttgaaagccgaatctgcgatcgctgcggggctggggcgcttccaggtcccagggcgggtccgccccggggtgcgcgtcccagaacggcgcgcggcggggccgtccagcgaggggggcggatgcgtgggggcgtctccgaggtgggttttcaggttgcccagccagggggccggcgggacctaccgcggactcgcgcatttacgttcgcaagaagtgaatcaccaaacgtgcccacggctaa

SEQ ID NO: 96192 - DNA, 306 bp, Homo sapiens
  misc_feature 1..306: note = chr7:108095272-108095578
  misc_feature 1..306: note = hyper
  source 1..306: mol_type = genomic DNA
acccgcacttctgagcgttaaccatctgggactcggaaaggaaaagaaagctttcttctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 96193 - DNA, 1931 bp, Homo sapiens
  misc_feature 1..1931: note = chr7:108095780-108097711
  misc_feature 1..1931: note = hyper
  source 1..1931: mol_type = genomic DNA
cgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgcgccggcgcgcgcccccgccgctcccgccctctccgctccccctccccgcgccgtgcttttgcccctcccggctctccttagcgtcctcccgtccccctcccccgcactccctgcgggcgtcctccgcctcctcccctcctggccaaccccctcttgccctgctgctgcgacggcagcgaatgggctccagccgccggcgcctcgagggactgggtggcccctcacctgagcggccgccccaccgccaacctccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggtcttctggtcccaaggaatagggttagttcggatttgcttatttacaaatgggggagtattatggagattttttttttttttttttggcaatgtaaatcgagaattaagattttccaactgtatagtatttgagtaaacacactgcttgctgcatagttcaggctccgaagcgcacgtctccactctatcgtggatggtgttca

SEQ ID NO: 96194 - DNA, 42 bp, Homo sapiens
  misc_feature 1..42: note = chr7:108164980-108165022
  misc_feature 1..42: note = hypo
  source 1..42: mol_type = genomic DNA
atgactggccaggtgcggtggctcaggcctgaaatcccagca

SEQ ID NO: 96195 - DNA, 41 bp, Homo sapiens
  misc_feature 1..41: note = chr7:108165202-108165243
  misc_feature 1..41: note = hypo
  source 1..41: mol_type = genomic DNA
atcgcaccaaggcactccagcctgggcgacagagagagact

SEQ ID NO: 96196 - DNA, 30 bp, Homo sapiens
  misc_feature 1..30: note = chr7:108168666-108168696
  misc_feature 1..30: note = hypo
  source 1..30: mol_type = genomic DNA
tcttctgtgcaaccacggtaatcttttgaa

SEQ ID NO: 96197 - DNA, 37 bp, Homo sapiens; identical to SEQ ID NO: 41202
  misc_feature 1..37: note = chr7:10819400-10819437
  misc_feature 1..37: note = hypo
  source 1..37: mol_type = genomic DNA

SEQ ID NO: 96198 - DNA, 187 bp, Homo sapiens
  misc_feature 1..187: note = chr7:108503958-108504145
  misc_feature 1..187: note = hypo
  source 1..187: mol_type = genomic DNA
gaatccttatgttcccgtcatctggacactggagttcactgtgtcagtggcttgcgacatgccttgtccagctgcaagccctgcatggagcctgttcttgtgctggcgcatggaatggacagccagacctggcactcacttgctcacacacccactcccactgggggctgagcgtgcagttgcagtg

SEQ ID NO: 96199 - DNA, 150 bp, Homo sapiens; identical to SEQ ID NO: 41434
  misc_feature 1..150: note = chr7:108515007-108515157
  misc_feature 1..150: note = hypo
  source 1..150: mol_type = genomic DNA

SEQ ID NO: 96200 - DNA, 120 bp, Homo sapiens
  misc_feature 1..120: note = chr7:1086199-1086319
  misc_feature 1..120: note = hypo
  source 1..120: mol_type = genomic DNA
tggagagtagaataacgtttcgctccaatttgagatcccaaaatgagatgctgcccgggaccagaagtcagtttcttaggagcgtgctgtctacccaggagcctccgtgtgcaaacaaaa

SEQ ID NO: 96201 - DNA, 30 bp, Homo sapiens; identical to SEQ ID NO: 41203
  misc_feature 1..30: note = chr7:10929379-10929409
  misc_feature 1..30: note = hypo
  source 1..30: mol_type = genomic DNA

SEQ ID NO: 96202 - DNA, 279 bp, Homo sapiens
  misc_feature 1..279: note = chr7:1105515-1105794
  misc_feature 1..279: note = hyper
  source 1..279: mol_type = genomic DNA
agctccagggccagccgcggtttccggcctcaagggcaggctcggttctggagctccctccagtggccgtcggggtgccgtcactttcagggccccaccaggagagcaggggccccgccgaggaccagagcgcctggaccagagggagccctgcgcggccggcacggatgcctctcaataggcggcatggggccgacacgactcggtgagttcccgccacggctttcgccggcagccggcggctggaggacaaggagaatgcgccggttctgttcctgg

SEQ ID NO: 96203 - DNA, 39 bp, Homo sapiens
  misc_feature 1..39: note = chr7:111560077-111560116
  misc_feature 1..39: note = hypo
  source 1..39: mol_type = genomic DNA
actataaaggaaagacgtagcaaatatttacacattcct

SEQ ID NO: 96204 - DNA, 98 bp, Homo sapiens
  misc_feature 1..98: note = chr7:111560176-111560274
  misc_feature 1..98: note = hypo
  source 1..98: mol_type = genomic DNA
gggtgggggatatgggggttagggagagtaaaccgggagattttggtcacaggagacgaagtttcagttggacaagatgaagacgttctagagagcta

SEQ ID NO: 96205 - DNA, 30 bp, Homo sapiens; identical to SEQ ID NO: 41057
  misc_feature 1..30: note = chr7:1115722-1115752
  misc_feature 1..30: note = hypo
  source 1..30: mol_type = genomic DNA

SEQ ID NO: 96206 - DNA, 30 bp, Homo sapiens; identical to SEQ ID NO: 41435
  misc_feature 1..30: note = chr7:111662581-111662611
  misc_feature 1..30: note = hypo
  source 1..30: mol_type = genomic DNA

SEQ ID NO: 96207 - DNA, 80 bp, Homo sapiens
  misc_feature 1..80: note = chr7:111844185-111844265
  misc_feature 1..80: note = hyper
  source 1..80: mol_type = genomic DNA
ttgactgataatatccggtttgccattccaggaaatcccagagtggtttttaagcctctgcccaccgcttgtaaagaaag

SEQ ID NO: 96208 - DNA, 30 bp, Homo sapiens
  misc_feature 1..30: note = chr7:112220127-112220157
  misc_feature 1..30: note = hypo
  source 1..30: mol_type = genomic DNA
ccctgacccaccccacgacgggtgaataaa

SEQ ID NO: 96209 - DNA, 30 bp, Homo sapiens
  misc_feature 1..30: note = chr7:112429052-112429082
  misc_feature 1..30: note = hypo
  source 1..30: mol_type = genomic DNA
ccttataaggcactccgtgttgggcctgaa

SEQ ID NO: 96210 - DNA, 156 bp, Homo sapiens
  misc_feature 1..156: note = chr7:112431236-112431392
  misc_feature 1..156: note = hypo
  source 1..156: mol_type = genomic DNA
gctctctggggaacacgagtgccacatttccaactacctgctagatgtttctactcaaatatattgtcatcacttccaactcaacttgcctttaatggacatttatatacatttattatgccccccatttgaatccccttccgtatttggagaatt

SEQ ID NO: 96211 - DNA, 331 bp, Homo sapiens
  misc_feature 1..331: note = chr7:1126502-1126833
  misc_feature 1..331: note = hyper
  source 1..331: mol_type = genomic DNA
attacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcag

SEQ ID NO: 96212 - DNA, 56 bp, Homo sapiens
  misc_feature 1..56: note = chr7:112726558-112726614
  misc_feature 1..56: note = hyper
  source 1..56: mol_type = genomic DNA
tccttgagctccagccgcgtcctcccctgtcgcagcggcaccgtctcccccagtaa

SEQ ID NO: 96213 - DNA, 141 bp, Homo sapiens
  misc_feature 1..141: note = chr7:112726853-112726994
  misc_feature 1..141: note = hyper
  source 1..141: mol_type = genomic DNA
tcttcccaaaggcagcgcacgaggaagtcacagtgcccgtgacgcccgccccctccctcagcttcccggaaccctaaccttccccagacactttcttcccttttcttttagggtggtccaaaccaccggaggcttctttta

SEQ ID NO: 96214 - DNA, 588 bp, Homo sapiens; identical to SEQ ID NO: 31462
  misc_feature 1..588: note = chr7:113722696-113723284
  misc_feature 1..588: note = hyper
  source 1..588: mol_type = genomic DNA

SEQ ID NO: 96215 - DNA, 445 bp, Homo sapiens
  misc_feature 1..445: note = chr7:113723338-113723783
  misc_feature 1..445: note = hyper
  source 1..445: mol_type = genomic DNA
cgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacaggacctgttttcccaactccctggacagcttccctgcgggatgggttggtggcccggggcatggcagcaggcgaggaggagataatgggggcgaagttgagcgggggcacttgggagctgcgggctcagtttcactgagaaaaaggccccggaagggtacgcgtccactctataaatatatactcctccgactgagatgtcct

SEQ ID NO: 96216 - DNA, 726 bp, Homo sapiens
  misc_feature 1..726: note = chr7:113724746-113725472
  misc_feature 1..726: note = hyper
  source 1..726: mol_type = genomic DNA
aggcacaagttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 96217 - DNA, 157 bp, Homo sapiens
  misc_feature 1..157: note = chr7:113725701-113725858
  misc_feature 1..157: note = hyper
  source 1..157: mol_type = genomic DNA
atttgccagcagctccgtctgctgagaggacgtactttggggactgccaagaagcagcagacacaactcggctttgccaatacagcatacggttttgttctcgcctccctccccacccccttccctgactcgccgtctggggcgagctggagaaggc

SEQ ID NO: 96218 - DNA, 800 bp, Homo sapiens
  misc_feature 1..800: note = chr7:113726087-113726887
  misc_feature 1..800: note = hyper
  source 1..800: mol_type = genomic DNA
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcggtaagtttcttggccctcactctggcgcgctacacctccgcaccccaccctgtcccagccacctccacgctgggccgagctgcgactttactctgctccgcgctcctcccgcggtggcgacaaagtttcgccccaaaggcagcgccctgcttgccggggcgagtgtgacatgtgtcaaatttgggctcggcgttggggtcgcattccggacccagcatcac

SEQ ID NO: 96219 - DNA, 257 bp, Homo sapiens
  misc_feature 1..257: note = chr7:113727369-113727626
  misc_feature 1..257: note = hyper
  source 1..257: mol_type = genomic DNA
gactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 96220 - DNA, 54 bp, Homo sapiens; identical to SEQ ID NO: 9172
  misc_feature 1..54: note = chr7:113727754-113727808
  misc_feature 1..54: note = hyper
  source 1..54: mol_type = genomic DNA

SEQ ID NO: 96221 - DNA, 30 bp, Homo sapiens
  misc_feature 1..30: note = chr7:1139445-1139475
  misc_feature 1..30: note = hypo
  source 1..30: mol_type = genomic DNA
acacgtctcactaggcggtttgctcagaac

SEQ ID NO: 96222 - DNA, 155 bp, Homo sapiens
  misc_feature 1..155: note = chr7:1140555-1140710
  misc_feature 1..155: note = hypo
  source 1..155: mol_type = genomic DNA
gcaggcacagagccccgtgcacccctgctcctggcctaggcggggtctgcaaaggcccttccaccgcaggcacagcccgtcagggaggctcacgctccactcagaaggacacagcccgtttcagggaacacaggcccaggcggccctgccacagg

SEQ ID NO: 96223 - DNA, 122 bp, Homo sapiens
  misc_feature 1..122: note = chr7:114562155-114562277
  misc_feature 1..122: note = hyper
  source 1..122: mol_type = genomic DNA
cccctttcccagccccgggagggcgcagcgcccgggtggggagcccgagccagcccaggccggctctggcctcctgacccagacagcgcagggcgcgagggatcgcgcggccgagcccgggt

SEQ ID NO: 96224 - DNA, 1188 bp, Homo sapiens
  misc_feature 1..1188: note = chr7:114562326-114563514
  misc_feature 1..1188: note = hyper
  source 1..1188: mol_type = genomic DNA
cgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctagg

SEQ ID NO: 96225 - DNA, 475 bp, Homo sapiens
  misc_feature 1..475: note = chr7:115117435-115117910
  misc_feature 1..475: note = hyper
  source 1..475: mol_type = genomic DNA
ttattccaagtgccccgtcccaggcttgcactccccaaaaaggagccgagacgggagggttgaggcgtctcggctgcctccgtggagatcccgagaaaagctcctgcgctccaagttaacttctctctgggccgcgcggcgcagtggagtctcggtgcagcccgcgtccctggaggcgcgcagcgaagcccagcgggcgtggacagggaaggggcgggaaggcaggggacaaggcggggtcctaagggttggtggggttgagctgggggggggggggcggaaaaagagatctgcggagaagccttcggagaggctaaggagggctagcctggggctgacgaaggcaatgctctttagaagggcactgggggcaaagagggtcccccaaagcagctcatctgggcgcccttgactaacagtgctctgagctttttgccttgagactctaaagatcaaaattcgatgtcctcggaat

SEQ ID NO: 96226 - DNA, 43 bp, Homo sapiens
  misc_feature 1..43: note = chr7:115738426-115738469
  misc_feature 1..43: note = hypo
  source 1..43: mol_type = genomic DNA
ggtctcggcgtgaaccactgcgcccagccgcaaccaagaataa

SEQ ID NO: 96227 - DNA, 264 bp, Homo sapiens
  misc_feature 1..264: note = chr7:116139864-116140128
  misc_feature 1..264: note = hyper
  source 1..264: mol_type = genomic DNA
acagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccaccc

SEQ ID NO: 96228 - DNA, 62 bp, Homo sapiens
  misc_feature 1..62: note = chr7:116140129-116140191
  misc_feature 1..62: note = hyper
  source 1..62: mol_type = genomic DNA
tcaccaggccgcccgcgtagccaggaattcttagccaggttcctgtgcgcccaccgtgaccc

SEQ ID NO: 96229 - DNA, 30 bp, Homo sapiens
  misc_feature 1..30: note = chr7:116166712-116166742
  misc_feature 1..30: note = hyper
  source 1..30: mol_type = genomic DNA
ccctaaacacctcaacgatgacgtggtcaa

SEQ ID NO: 96230 - DNA, 92 bp, Homo sapiens
  misc_feature 1..92: note = chr7:116339527-116339619
  misc_feature 1..92: note = hypo
  source 1..92: mol_type = genomic DNA
cattagctgtggcagcgtcaacagagggacctgccagcgacatgtctttccccacaatcatactgctgacatacagtcggaggttcactgca

SEQ ID NO: 96231 - DNA, 44 bp, Homo sapiens
  misc_feature 1..44: note = chr7:116492603-116492647
  misc_feature 1..44: note = hypo
  source 1..44: mol_type = genomic DNA
ctctccgagtagctggaactacaggcgcccgcaaccactccttg

SEQ ID NO: 96232 - DNA, 30 bp, Homo sapiens
  misc_feature 1..30: note = chr7:116620287-116620317
  misc_feature 1..30: note = hypo
  source 1..30: mol_type = genomic DNA
agccatgagccaccacgcccagcattcata

SEQ ID NO: 96233 - DNA, 30 bp, Homo sapiens
  misc_feature 1..30: note = chr7:116921667-116921697
  misc_feature 1..30: note = hypo
  source 1..30: mol_type = genomic DNA
ctgaaaactaggtcgcgaaggtaagtctgg

SEQ ID NO: 96234 - DNA, 745 bp, Homo sapiens
  misc_feature 1..745: note = chr7:116962402-116963147
  misc_feature 1..745: note = hyper
  source 1..745: mol_type = genomic DNA
agcaaaatgttcttccgccccactggggtgaacctggaatgtggaaggacgggaaataatacaaagtcacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 96235 - DNA, 1391 bp, Homo sapiens
  misc_feature 1..1391: note = chr7:116963330-116964721
  misc_feature 1..1391: note = hyper
  source 1..1391: mol_type = genomic DNA
cgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagtccctgagcgtgcaatgtgaggaaacgaggaagggggccaggggataaggagattactatgcatgggatacaagaatccagagatgattctcaactcattgcttcgcttctctccctgaagctgggatgaagagctagcacttgtaaatttggagctgccgcgtctatgcagggcaaggttagggaggggccaggcctctgcgaaatgacctgttggctttgattccttggtgctgggcttaaatacagagcccatagggaggggaacttggagggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaagaccaggaactcgtggcggccgtgaactgttccattgctcttttcctggggcggagggactcactgcccgcccgaggagcgtgctctggggaatagagtatgcgcctgtgtgtatgtgtgggaggcgaattgttcgcagggcgtgggggagggggtgccgcccagatcggaaggacgggctctccctctctccagcccaccctcgggcctggactggccagagcgtcagccctcgccggcagcgagcgcggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggaggggagggaaacaagcaccgcgccacccacgactcgggaagagcagggctcctcgccagggccgctccgtatcgctgggccgcgacccagggaagttctgcttggtctgcgtcggt

SEQ ID NO: 96236 - DNA, 876 bp, Homo sapiens
  misc_feature 1..876: note = chr7:117119448-117120324
  misc_feature 1..876: note = hyper
  source 1..876: mol_type = genomic DNA
ctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattg

SEQ ID NO: 96237 - DNA, 30 bp, Homo sapiens
  misc_feature 1..30: note = chr7:117433609-117433639
  misc_feature 1..30: note = hypo
  source 1..30: mol_type = genomic DNA
gcagtaagccatgtgcgcatggcacaagag

SEQ ID NO: 96238 - DNA, 104 bp, Homo sapiens
  misc_feature 1..104: note = chr7:117512306-117512410
  misc_feature 1..104: note = hyper
  source 1..104: mol_type = genomic DNA
ggcccccgctgtttacgcccggccctgccctctcctgcactgattctgctcaggtcttgataggaagaggggggcgtccacgccccgctcgctccatcccaccc

SEQ ID NO: 96239 - DNA, 391 bp, Homo sapiens
  misc_feature 1..391: note = chr7:117512787-117513178
  misc_feature 1..391: note = hyper
  source 1..391: mol_type = genomic DNA
tgctaggacctaaagcgctggcctcagcggcagcagcgcccacatctggacacggccctctcccagtgggcctcccgaaggcacaggaccagatgcacacaatgggcatccccacacctgctgggcgatggcccacctcccccaagctgctctcccgggtccgctgagcggtaccaggcacccccgagacacgcgctggcaaccacgcgcgcagcgagaggtgaacaatggggggtcaaattcgccaggaaacacgtcccagccttctcccccggccagaagcgaccgcagcggagggagtgggcataggggtcgcactggacgcagacagggagctgggagaaccgggcgacccggggccgcttcccgtggggcgcggaagggacaggag

SEQ ID NO: 96240 - DNA, 35 bp, Homo sapiens; identical to SEQ ID NO: 31483
  misc_feature 1..35: note = chr7:117513436-117513471
  misc_feature 1..35: note = hyper
  source 1..35: mol_type = genomic DNA

SEQ ID NO: 96241 - DNA, 30 bp, Homo sapiens
  misc_feature 1..30: note = chr7:117805645-117805675
  misc_feature 1..30: note = hypo
  source 1..30: mol_type = genomic DNA
acaggagtgagccaccgcacccagctgtat

SEQ ID NO: 96242 - DNA, 465 bp, Homo sapiens; identical to SEQ ID NO: 31055
  misc_feature 1..465: note = chr7:11871392-11871857
  misc_feature 1..465: note = hyper
  source 1..465: mol_type = genomic DNA

SEQ ID NO: 96243 - DNA, 417 bp, Homo sapiens
  misc_feature 1..417: note = chr7:119912968-119913385
  misc_feature 1..417: note = hyper
  source 1..417: mol_type = genomic DNA
ccttgaaccgggactcgagaggcagaagcaaggcacgggtcccctttctcctctcctccaccaaaccaccgcagcccagcacgtgaagcttccctttgttcatccgaggctcgcttttctccccagcagatccacctggatgctctccctcggtgacattttgcgccggggttggtgggtggctggggtggagcgagaggagcccgagggggcgggggcggagaaaggtcaagccgagggaaaggcaggagacgcctttcctaacctgcgtggcggggcgtgcgcgcggttatttatttattttctccttatttattgatcgcactagcagagcagcgcggggagcccggggagatgcaggaccacccactggcggggaagcagctagcagccctcccgcgcccccgcgctgccgag

SEQ ID NO: 96244 - DNA, 330 bp, Homo sapiens
  misc_feature 1..330: note = chr7:119913416-119913746
  misc_feature 1..330: note = hyper
  source 1..330: mol_type = genomic DNA
cgtgccggccccggccccggccccaccgcgccaacgccgcccgcccggccgccccgcagccccgccgccccgcagccccgcaccgcgctggccaggctcccgcgacagtggccccgcagtaagttggcaggagcgagtcccctccgttctcgcctcccccgcaccttttgaacttgttgctgctgctctgctcgcctgcgcctggcttttggaaggtgaaaaggaggagggaggcacggagggatgggggaagggaaagaagagctcgcttgagctttatttatgctctctcggcgcatcggattcggctgctcgcgagctgctttctct

SEQ ID NO: 96245 - DNA, 106 bp, Homo sapiens
  misc_feature 1..106: note = chr7:119913981-119914087
  misc_feature 1..106: note = hyper
  source 1..106: mol_type = genomic DNA
gagggtgtttgtagacgtgggggaggagaatctctattaacgccccccaccgtaaccactgcacatcacctccatctctgcaaatacagcccgaggagtagaggca

SEQ ID NO: 96246 - DNA, 33 bp, Homo sapiens
  misc_feature 1..33: note = chr7:120368239-120368272
  misc_feature 1..33: note = hypo
  source 1..33: mol_type = genomic DNA
aagtttcctttcaattaacgatgttcaagttgc

SEQ ID NO: 96247 - DNA, 93 bp, Homo sapiens
  misc_feature 1..93: note = chr7:120969260-120969353
  misc_feature 1..93: note = hyper
  source 1..93: mol_type = genomic DNA
tggacaactgacctgcggcccgaagggcctctggggagggggtgcaaaagaggagcggctgggctgggggactccatgcgggggcgatggaca

SEQ ID NO: 96248 - DNA, 1077 bp, Homo sapiens
  misc_feature 1..1077: note = chr7:120969626-120970703
  misc_feature 1..1077: note = hyper
  source 1..1077: mol_type = genomic DNA
gggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggtgagtcctgggtccttaggggttggtgggggacggaaggcgacaactcctccaccggttcctgcaaataaagtaaatagtgctacgtggtcctgtagctctctaagttccagaagaagccctttagtgcacggggattgagagctacaaaggccagacctggggagcaggtgcgagcctggagggaggtgactccccagttccagagcggagctctaggggctggagctcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgagccg

SEQ ID NO: 96249 - DNA, 30 bp, Homo sapiens
  misc_feature 1..30: note = chr7:121074-121104
  misc_feature 1..30: note = hypo
  source 1..30: mol_type = genomic DNA
ttaaagtttcctgttcggtctgggactcct

SEQ ID NO: 96250 - DNA, 33 bp, Homo sapiens
  misc_feature 1..33: note = chr7:1212360-1212393
  misc_feature 1..33: note = hypo
  source 1..33: mol_type = genomic DNA
acaaagcccaggtaccgacggcctttccgtcct

SEQ ID NO: 96251 - DNA, 347 bp, Homo sapiens
  misc_feature 1..347: note = chr7:12151126-12151473
  misc_feature 1..347: note = hyper
  source 1..347: mol_type = genomic DNA
gacaagacttacaagcgacgatgctgacggtggactcttgcccagggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgc

SEQ ID NO: 96252 - DNA, 149 bp, Homo sapiens
  misc_feature 1..149: note = chr7:121512756-121512905
  misc_feature 1..149: note = hyper
  source 1..149: mol_type = genomic DNA
aacaatgtacccaggcgcccccaccgcattctgattggacccacttaagcatctgcagaaaacaataaaatgaaaaaaactcttagaggtgaaactcaaaggtcaacctctggctgtgcgggacaatgggtgtccggccttcccttccc

SEQ ID NO: 96253 - DNA, 405 bp, Homo sapiens
  misc_feature 1..405: note = chr7:121513553-121513958
  misc_feature 1..405: note = hyper
  source 1..405: mol_type = genomic DNA
atgcgaatcctaaagcgtttcctcgcttgcattcagctcctctgtgtttgccgcctgggtgagtgagaagagctcggtggggtttcagctccgggatcggtgggatgagggtgggagcatttcagcgtgtccgcgacttgccgccgccgccgccatctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctcttttgcaaagtgtagaaatcgccttttagatata

SEQ ID NO: 96254 - DNA, 216 bp, Homo sapiens
  misc_feature 1..216: note = chr7:12151523-12151739
  misc_feature 1..216: note = hyper
  source 1..216: mol_type = genomic DNA
cgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacagagggcagtagccaccctcggaatccataccct

SEQ ID NO: 96255 - DNA, 774 bp, Homo sapiens
  misc_feature 1..774: note = chr7:121783508-121784282
  misc_feature 1..774: note = hyper
  source 1..774: mol_type = genomic DNA
taaactgcttctccccgcgccccgtcccgcgcgagcgctcacaatgggctgcatagtcccgcaggggctgaagagttcaggaaacccagacttgcaaggcgcccaacttccacccatctccgatccttgctggagaatgggtctgtgtctcggagagtgggcagcccaagatggacaaggagagaagtttgtgatcagtttggctaagctgggcgtggggagggaagggggaaagaaccaccccgaaatctccatccaccgccccctcagccagccgtcccctctaagcacgccgtccacaaattaacaagccgttgtttcctcagcttcatcagttctttattccccagccacagcaccaccactgtccgccaaaaaagaaagaaaagaaatccgaattgcaatccctcgcctttctacttagaaatgctggagctgcgctgaccgctctccctcccttcctcgcagtgaaactctctgcgtttccgctctccctccattcctcgcagggaggcccgaatgctcgccgccttctccctctctcggcccggccggggtcgcctcgcggcgccgggacccgaaggccaggctcgcgggcccctcccagcgacagcccgagcccggcccgctatctccaccgcatctcacaggctgagcccacccgcgcgtctgctcagctctccgcggggacctctcctctcctcacctcgtccgctctggggcgccgacttgtcccccgccgcctcgaatcttccgagtcgctgcaggggaggc

SEQ ID NO: 96256 - DNA, 138 bp, Homo sapiens
  misc_feature 1..138: note = chr7:121784548-121784686
  misc_feature 1..138: note = hyper
  source 1..138: mol_type = genomic DNA
aggtttgtaactgtccgtggcagaaggcgggcggggacggaaagcaacgaaaatagtctgggcattacgctctaaatagaggtgcacatctcctggggaaaagttgcgagcgccggtacctcacgtttgtttagctat

SEQ ID NO: 96257 - DNA, 568 bp, Homo sapiens; identical to SEQ ID NO: 31492
  misc_feature 1..568: note = chr7:121939677-121940245
  misc_feature 1..568: note = hyper
  source 1..568: mol_type = genomic DNA

SEQ ID NO: 96258 - DNA, 657 bp, Homo sapiens
  misc_feature 1..657: note = chr7:121940433-121941090
  misc_feature 1..657: note = hyper
  source 1..657: mol_type = genomic DNA
cggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatgtggccccgctgcagtagcactacggtgctgggctgtttgtctggcagcttctactgagcagctaatagtataacaacccggctttgataaatctgaactaattacccctcttaattaaagtctttagcagttgtttcattgttttggcaagaaaacaggagagacgtgcagttagaaacaccagagcccgagctcacagcggagccgctgattaacacttgaagcatttcaaggacctggcacccgccacagtttggttttcatccatgtttcctccttgaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 96259 - DNA, 510 bp, Homo sapiens
  misc_feature 1..510: note = chr7:121941881-121942391
  misc_feature 1..510: note = hyper
  source 1..510: mol_type = genomic DNA
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgcgggccagccccaggctgctgtcgtgcagcttgcggacatgcttcttgaggtcaaagttcctgcagaaacccttgccgcacgtggggcaggtgaaaggcttcttgtcgttgtgggtgtgcatgtggaaggtgaggttgtaaacctggtggaaagccttgttgcagatattgcacttgaactgcttctccccgctgtgggtcaact

SEQ ID NO: 96260 - DNA, 333 bp, Homo sapiens
  misc_feature 1..333: note = chr7:121943656-121943989
  misc_feature 1..333: note = hyper
  source 1..333: mol_type = genomic DNA
gaaggaaaggatctccgttttgcattgtacttgcctttccacacacttcgcaagtgaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggc

SEQ ID NO: 96261 - DNA, 216 bp, Homo sapiens
  misc_feature 1..216: note = chr7:121944176-121944392
  misc_feature 1..216: note = hyper
  source 1..216: mol_type = genomic DNA
cgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttgggtaaggctccctgcaggaagtgggggactggcagggccttgggctctggggtgcgcgccatgattcgttc

SEQ ID NO: 96262 - DNA, 30 bp, Homo sapiens; identical to SEQ ID NO: 31498
  misc_feature 1..30: note = chr7:121944621-121944651
  misc_feature 1..30: note = hyper
  source 1..30: mol_type = genomic DNA

SEQ ID NO: 96263 - DNA, 535 bp, Homo sapiens
  misc_feature 1..535: note = chr7:121945611-121946146
  misc_feature 1..535: note = hyper
  source 1..535: mol_type = genomic DNA
caggatacacacagacgcgcgcgcgcgcacgcttccgagtttccattgagagtctggaaagagcatttctttcttaagtacctgcgctcagctagagctctcccggagcattttaaatactgaatgccgagcggagaagggaaacagagtgtattaatccccactccggttgccggtgtctgcaagcctcctctaagcagcgcaggcggcagcctggatgtctgtgcgcatcaaggagacttgccggcgccagagttgtgtccacaggtgcacttgtgcctcccaaagagcgcgcgtagagaccatttcccctgcaacgccccccagccgaacacccgccgggtgtggcacctcggccgaaactcctggggcggcgcggtggagcgtgtggaggtttccgggaagacgcctacggctgcggctccgactgtgcgggctcccgccgcccaggcaagagcgtccaggagcgcgctggaagctgcggcgcgcaccttccccggcgcagtctcttgccagccggcgatcacgcagagct

SEQ ID NO: 96264 - DNA, 611 bp, Homo sapiens
  misc_feature 1..611: note = chr7:121946372-121946983
  misc_feature 1..611: note = hyper
  source 1..611: mol_type = genomic DNA
caagtgtagtgggggcgtccttctgctagagctctgaaaagggttggccccggaaggctggataacggcggactagaaaccctggcattattaagtccctgagcaatttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 96265 - DNA, 352 bp, Homo sapiens
  misc_feature 1..352: note = chr7:121947097-121947449
  misc_feature 1..352: note = hyper
  source 1..352: mol_type = genomic DNA
cgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagcagcccggctctggaaggct

SEQ ID NO: 96266 - DNA, 227 bp, Homo sapiens
  misc_feature 1..227: note = chr7:121950038-121950265
  misc_feature 1..227: note = hyper
  source 1..227: mol_type = genomic DNA
ccttgacactacccacgaagtttaaagcattttttatgttattttcaaactttcttaagtgatcccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 96267 - DNA, 125 bp, Homo sapiens; identical to SEQ ID NO: 710
  misc_feature 1..125: note = chr7:121950428-121950553
  misc_feature 1..125: note = hyper
  source 1..125: mol_type = genomic DNA

SEQ ID NO: 96268 - DNA, 148 bp, Homo sapiens; identical to SEQ ID NO: 711
  misc_feature 1..148: note = chr7:121951863-121952011
  misc_feature 1..148: note = hyper
  source 1..148: mol_type = genomic DNA

SEQ ID NO: 96269 - DNA, 126 bp, Homo sapiens
  misc_feature 1..126: note = chr7:121952043-121952169
  misc_feature 1..126: note = hyper
  source 1..126: mol_type = genomic DNA
cgagggtgggaagggaagttgaggtctggggtaaaaagccggaaaaagaaaggaacaaggctgagaatcattcaaagattaaatggggtcggctcccgttgcttgcgaagacggatgaggagggag

SEQ ID NO: 96270 - DNA, 45 bp, Homo sapiens
  misc_feature 1..45: note = chr7:121955270-121955315
  misc_feature 1..45: note = hyper
  source 1..45: mol_type = genomic DNA
gcagtccagcaactccgggcaggagtcggtgctggcagtcgccct

SEQ ID NO: 96271 - DNA, 465 bp, Homo sapiens
  misc_feature 1..465: note = chr7:121955375-121955840
  misc_feature 1..465: note = hyper
  source 1..465: mol_type = genomic DNA
gcttggtttccgcagctggggccaccttgaagggtgtggacccctctgcctttctctctctgttccgcttgcagtttgcaagtgtatccttctgttgcatccctgaattgggacgcaggacatcgttctaggctcccataagccttggaaaatattaatgaacaccatttgcacctgaaattcccttgaactcaacgcactgaccacaacagccgaggcctgagattcctcgcttgtgatctggcacctcctggatcatccccgtcccatttcagagcccttgaccaacataatctgcaagtggactcaataacacatctccagctacctcccttcccaaccgcagccacaggggctgctgttagcgatgctggccctttctgagaccagagttcccttgcccctccccgtctcctcctctcctcccatcgggctggccatatatataaccggagaactggacaa

SEQ ID NO: 96272 - DNA, 78 bp, Homo sapiens
  misc_feature 1..78: note = chr7:121956177-121956255
  misc_feature 1..78: note = hyper
  source 1..78: mol_type = genomic DNA
aagcttggggctctgcggttgtccaagctgctgtcaggtacacccaaatctgggtagtaaaatcggaggtcttcttca

SEQ ID NO: 96273 - DNA, 124 bp, Homo sapiens; identical to SEQ ID NO: 713
  misc_feature 1..124: note = chr7:121956458-121956582
  misc_feature 1..124: note = hyper
  source 1..124: mol_type = genomic DNA

SEQ ID NO: 96274 - DNA, 123 bp, Homo sapiens; identical to SEQ ID NO: 714
  misc_feature 1..123: note = chr7:121956954-121957077
  misc_feature 1..123: note = hyper
  source 1..123: mol_type = genomic DNA

SEQ ID NO: 96275 - skipped

SEQ ID NO: 96276 - DNA, 76 bp, Homo sapiens
  misc_feature 1..76: note = chr7:121957255-121957331
  misc_feature 1..76: note = hyper
  source 1..76: mol_type = genomic DNA
gctgagtgacctctttccctctcaagcacaccttcaaggagccggtggaccctctcaccgccggtagctgcaggct

SEQ ID NO: 96277 - DNA, 30 bp, Homo sapiens
  misc_feature 1..30: note = chr7:1220695-1220725
  misc_feature 1..30: note = hypo
  source 1..30: mol_type = genomic DNA
agaatttgctaataccggacttagagattt

SEQ ID NO: 96278 - DNA, 93 bp, Homo sapiens
  misc_feature 1..93: note = chr7:1225133-1225226
  misc_feature 1..93: note = hypo
  source 1..93: mol_type = genomic DNA
gatggcgcctctcagcgtggcgacgcggaccgagctgtctccatggtcatgctgtggccccgacacccacggcccctccgtggactttccctg

SEQ ID NO: 96279 - DNA, 314 bp, Homo sapiens
  misc_feature 1..314: note = chr7:123172930-123173244
  misc_feature 1..314: note = hyper
  source 1..314: mol_type = genomic DNA
ggcccccaagcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 96280 - DNA, 16 bp, Homo sapiens
  misc_feature 1..16: note = chr7:123175665-123175681
  misc_feature 1..16: note = hypo
  source 1..16: mol_type = genomic DNA
agagtcttgctctgtc

SEQ ID NO: 96281 - DNA, 30 bp, Homo sapiens
  misc_feature 1..30: note = chr7:123259499-123259529
  misc_feature 1..30: note = hypo
  source 1..30: mol_type = genomic DNA
gcaggtgttctgccccgatacagtttgctc

SEQ ID NO: 96282 - DNA, 1007 bp, Homo sapiens
  misc_feature 1..1007: note = chr7:123672016-123673023
  misc_feature 1..1007: note = hyper
  source 1..1007: mol_type = genomic DNA
gcccataaaattgagcgggtagtgagaatagtcccaggaacaagccccgcacgtgcggagtcccagaccccaggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaagcgcaggaagcgcttcaggaacacttggcagtggtagagcgccagcacgtactgcagcgccaggtccagcgcccctggcgccaccgcgacccccgccccgccgcccaggctgagtagtagcgcctggcccgctagggtctgcagccccacgtgggccgaggggtagaggaggaaattgaagacgaaggcgttgggacagcgccgctgctgcaggtacaccttctccagggcgaaatgggtgagcgagtgcagcaggcagcggtagggcgaggagaagcctagcatccgcaggtccgggctgcgggcgaagcgccgggccgaggacaccagcacgtccagggtgatcccgtgcatcccgtagaagtagaggcgcatccaggcgggcagcgtggcgctctcagccggcgcttcagcagtggacagcggctccgggcagccggctgccgcctcgcttcctggcccgccaggggcccccggacgccgcgccgcgccgcccctccgtg

SEQ ID NO: 96283 - DNA, 157 bp, Homo sapiens; identical to SEQ ID NO: 31517
  misc_feature 1..157: note = chr7:123673226-123673383
  misc_feature 1..157: note = hyper
  source 1..157: mol_type = genomic DNA

SEQ ID NO: 96284 - DNA, 137 bp, Homo sapiens; identical to SEQ ID NO: 31518
  misc_feature 1..137: note = chr7:124404361-124404498
  misc_feature 1..137: note = hyper
  source 1..137: mol_type = genomic DNA

SEQ ID NO: 96285 - DNA, 674 bp, Homo sapiens
  misc_feature 1..674: note = chr7:124404543-124405217
  misc_feature 1..674: note = hyper
  source 1..674: mol_type = genomic DNA
cggaaatgccagcgcctctgggacccttctcttcctcctctgagatctgaaggaagagctggagggccgtggggttccctctccccaaagtttcagaaggctcctgaccccgagcacctttccacctccaggggccaggtggcctggttggaggtcccgggggtccggctgccgacgcctccgcccctctgcctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagaggcagacaccttgagcagtagcagaagcagtagccgcgacatgcgggcgagaagcgcgcccggggctcgcatggcttggtgagggcacacccggcagccgcagctcctgcttagttaggatcgacacctgctgccgaagttgctgctgagagttaggcacatgtcacatactcacccccgcccgggtagcggggaaccggagattagggtgatagcggaagatcggtcttgggggtcacacacacgccccctataatcc

SEQ ID NO: 96286 - DNA, 671 bp, Homo sapiens; identical to SEQ ID NO: 31521
  misc_feature 1..671: note = chr7:124405556-124406227
  misc_feature 1..671: note = hyper
  source 1..671: mol_type = genomic DNA

SEQ ID NO: 96287 - DNA, 30 bp, Homo sapiens
  misc_feature 1..30: note = chr7:12442920-12442950
  misc_feature 1..30: note = hyper
  source 1..30: mol_type = genomic DNA
attcaggtccacttgcggctagcatacctt

SEQ ID NO: 96288 - DNA, 424 bp, Homo sapiens; identical to SEQ ID NO: 31058
  misc_feature 1..424: note = chr7:12443294-12443718
  misc_feature 1..424: note = hyper
  source 1..424: mol_type = genomic DNA

SEQ ID NO: 96289 - DNA, 30 bp, Homo sapiens
  misc_feature 1..30: note = chr7:1252449-1252479
  misc_feature 1..30: note = hypo
  source 1..30: mol_type = genomic DNA
tgcgtttggagatcacgcttgctctttctc

SEQ ID NO: 96290 - DNA, 30 bp, Homo sapiens; identical to SEQ ID NO: 31059
  misc_feature 1..30: note = chr7:12610212-12610242
  misc_feature 1..30: note = hyper
  source 1..30: mol_type = genomic DNA

SEQ ID NO: 96291 - DNA, 29 bp, Homo sapiens
  misc_feature 1..29: note = chr7:12610636-12610665
  misc_feature 1..29: note = hyper
  source 1..29: mol_type = genomic DNA
ccgacgcaccaaggccggcgaggggaggg

SEQ ID NO: 96292 - DNA, 35 bp, Homo sapiens
  misc_feature 1..35: note = chr7:126325948-126325983
  misc_feature 1..35: note = hypo
  source 1..35: mol_type = genomic DNA
accagaaggtgaactcgtagcgcttttccctgggc

SEQ ID NO: 96293 - DNA, 615 bp, Homo sapiens
  misc_feature 1..615: note = chr7:1263658-1264273
  misc_feature 1..615: note = hyper
  source 1..615: mol_type = genomic DNA
cgctgcgtggccttctccgggaggtggggggaatccgaagaggtcccaccccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 96294 - DNA, 490 bp, Homo sapiens
  misc_feature 1..490: note = chr7:1265078-1265568
  misc_feature 1..490: note = hyper
  source 1..490: mol_type = genomic DNA
atgaatccccctgcccgtaaataacaagagctgcgtcctggcggctgaccgtagccaccccgtgtctccctgcgggatgacctgagagcgtttcctggaagccgcgcagcccctctcccggcctccaccatcggggccgctcaccctctggggactctggccccgggaccccgggatccaggcccggtgcgcgcggctccggccccgagcgcgctgtccaggctggatccccaccaggcggcgctgcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttggaaactgttaatgtatttttagaatggcagctcagatccttcacttttcccccctaacttcaaacatgtaactacggccctccgaacgtggataaat

SEQ ID NO: 96295 - DNA, 2032 bp, Homo sapiens
  misc_feature 1..2032: note = chr7:126891206-126893238
  misc_feature 1..2032: note = hyper
  source 1..2032: mol_type = genomic DNA
gtctgttttcacccccgctatcttgggtgcgcagacactctctgacaccaggcttcacagtttgggccacgggggaagtaattccccagggaaccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggccatctacttgtgctcaggaaaaacaaatcactagagtgatatgagaaggaatggtgcacctggctgtccgctgaaaggttttagagaagaaaacggaaaggggaataaaacggggggattctccttttccaacaagcagggcgttttggggaagtttgggggccaggggctttttgtcccgtggttcggcacttgctttcctcggagccgctttctgctgccgggcggcgagtcttaccctgctccccgcagagggcgcggtgaggaagcccgccgggggcccgcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccggcgcggcgcggggagccgcggccaggatcgcgcccgggatcgccaatcgcttcgcgccaaccagtcacctcgggaagcgggaggaggaacccccgaggggcgggagcctctggatttcggtgtcacccagcg

SEQ ID NO: 96296 - DNA, 47 bp, Homo sapiens
  misc_feature 1..47: note = chr7:126893442-126893489
  misc_feature 1..47: note = hyper
  source 1..47: mol_type = genomic DNA
tgtggaggagcccagcggctccggctgcctggcgagcccgggaccgg

SEQ ID NO: 96297 - DNA, 267 bp, Homo sapiens; identical to SEQ ID NO: 30973
  misc_feature 1..267: note = chr7:1269197-1269464
  misc_feature 1..267: note = hyper
  source 1..267: mol_type = genomic DNA

SEQ ID NO: 96298 - DNA, 256 bp, Homo sapiens
  misc_feature 1..256: note = chr7:1269552-1269808
  misc_feature 1..256: note = hyper
  source 1..256: mol_type = genomic DNA
cgggctggaccgggccggggcgcgtccggcagcgctgagaccccccaccccgaatcaaagtagcggcggctgcgggggcggcgggtgggtgggggggagccgaggaacacggcgaggcgagcggcgtcctgaatgcgagtcgtgtgcgtcttattatcaagttaattaaagctagcatctgacaatgtcactcggctgtagaaaaagggatttaaatgcagcgtctcccaggaccgcgtgtcgagggctgcttccc

SEQ ID NO: 96299 - DNA, 101 bp, Homo sapiens
  misc_feature 1..101: note = chr7:126987739-126987840
  misc_feature 1..101: note = hyper
  source 1..101: mol_type = genomic DNA
ggctcaaaccagggacggcgagggcaaggggtgaaaggggtttgaggcgaggcagaggactcaggggtctgcggacggctggtcggcccgtggagacggcc

SEQ ID NO: 96300 - DNA, 49 bp, Homo sapiens
  misc_feature 1..49: note = chr7:126988157-126988206
  misc_feature 1..49: note = hyper
  source 1..49: mol_type = genomic DNA
aaaccaaggaaagagcgccgacgcctctcagccccgcaagagctgcaga

SEQ ID NO: 96301 - DNA, 674 bp, Homo sapiens
  misc_feature 1..674: note = chr7:1270100-1270774
  misc_feature 1..674: note = hyper
  source 1..674: mol_type = genomic DNA
gagccgggcgggggtcgtcccggccgcccccaccgtcattaaaggcccctctcaaacactcgaggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgcgaacccaacagaagaccaggcgcttgtggctgctggcgaaatcgagtcggatggacggagtttacatttagtatttatagagacagaaattaaattatggcgaaaagtagtgctcttggcctctgacctcggaatgaatactcgcagcgttttccta

SEQ ID NO: 96302 - DNA, 206 bp, Homo sapiens
  misc_feature 1..206: note = chr7:127061193-127061399
  misc_feature 1..206: note = hypo
  source 1..206: mol_type = genomic DNA
tgtggtgtgaagtatcgcaaatgaaaaatgaaactaggtttccggagaaattgcctcctctaagctgcattcacgtctcagtggtcctcaaaatgtagttcccaggccagcagcatcagttatcagtcaggtggaaacttagaaacacaaaggttcaagctcctctcctgggcatattgaatgagaaactccgcaatctgtgcttt

SEQ ID NO: 96303 - DNA, 123 bp, Homo sapiens
  misc_feature 1..123: note = chr7:1271038-1271161
  misc_feature 1..123: note = hyper
  source 1..123: mol_type = genomic DNA
cctcctgagcgtttccggcaccccccaccctccccggcccaggcacgggcacctgacccggagggacgcagagatgcgcacggtcccggcctgcccttccctctcacgcgggctagggcttgg

SEQ ID NO: 96304 - DNA, 214 bp, Homo sapiens
  misc_feature 1..214: note = chr7:1272298-1272512
  misc_feature 1..214: note = hyper
  source 1..214: mol_type = genomic DNA
ccctccggctccccccgcccccagcccgtcttgttgtgacagttcctgatactgtttattgaggtgcatgtcaggtataattagcaatcgatatggaaaacgtttccctgcacccagcacgcctctgacgtcagagccgattagcgcttcttattggtcccaaattccccgggccgcggctaattatcgggagcttgatgttgataagtaaagc

SEQ ID NO: 96305 - DNA, 875 bp, Homo sapiens
  misc_feature 1..875: note = chr7:1272513-1273388
  misc_feature 1..875: note = hyper
  source 1..875: mol_type = genomic DNA
ccggagtgcgggcgaagcatgtgtggggctccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtccggccgaggcgctggggggcccggggctggcgaaggagagccggctcctaggcggccgtctctgcgcccccccccccggatccaggcggccagcgggtagcgggagggaggggtgggggtcgggcctgggccggtggctgagccgcgctgcgtcctgtgactgcccgcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtaaagacccggcgtcgctcccggatctgccatccggaccccaggctctgggcgcgc

SEQ ID NO: 96306 - DNA, 100 bp, Homo sapiens
  misc_feature 1..100: note = chr7:127253534-127253634
  misc_feature 1..100: note = hypo
  source 1..100: mol_type = genomic DNA
gtagccagctttccacgggccactgaatcaggatactgcccacgctggaactctgcggagatcgagtctcacaaagtaagggcaccgggagaggagcaag

SEQ ID NO: 96307 - DNA, 181 bp, Homo sapiens
  misc_feature 1..181: note = chr7:127260532-127260713
  misc_feature 1..181: note = hyper
  source 1..181: mol_type = genomic DNA
ctcagctttccagagcgcacgcgccacctgtccaaaaccgttctctggcggcctgtgcctcccactttaaagtcaaagtgatttccttgctacaaaaacacggaggctattcgagttccctgaaaattctgaacttgagaccctcacgccaaagttgcgctacccccgcaaagctttatgc

SEQ ID NO: 96308 - DNA, 366 bp, Homo sapiens; identical to SEQ ID NO: 30980
  misc_feature 1..366: note = chr7:1273589-1273955
  misc_feature 1..366: note = hyper
  source 1..366: mol_type = genomic DNA

SEQ ID NO: 96309 - DNA, 30 bp, Homo sapiens; identical to SEQ ID NO: 41439
  misc_feature 1..30: note = chr7:127371129-127371159
  misc_feature 1..30: note = hypo
  source 1..30: mol_type = genomic DNA

SEQ ID NO: 96310 - DNA, 493 bp, Homo sapiens
  misc_feature 1..493: note = chr7:1274432-1274925
  misc_feature 1..493: note = hyper
  source 1..493: mol_type = genomic DNA
cgttgggggagggctcggcttcatgctggagacctccccatggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 96311 - DNA, 147 bp, Homo sapiens
  misc_feature 1..147: note = chr7:1275045-1275192
  misc_feature 1..147: note = hyper
  source 1..147: mol_type = genomic DNA
cggcaggatggtcagcgccaggccgggcgggctgcttagaacacgagccgtgagcggccaggaagggtgaacaggggccttgctctctagcctccggaccaggaacccgacgctctccgtccggggccagaccggccccccaagtaa

SEQ ID NO: 96312 - DNA, 44 bp, Homo sapiens
  misc_feature 1..44: note = chr7:12750788-12750832
  misc_feature 1..44: note = hypo
  source 1..44: mol_type = genomic DNA
cagtgctgggattacagacgtcagtcacccggcccggccgacac

SEQ ID NO: 96313 - DNA, 30 bp, Homo sapiens
  misc_feature 1..30: note = chr7:12751560-12751590
  misc_feature 1..30: note = hypo
  source 1..30: mol_type = genomic DNA
gtgagccaccgcacccggcctgttcattct

SEQ ID NO: 96314 - DNA, 139 bp, Homo sapiens
  misc_feature 1..139: note = chr7:1275543-1275682
  misc_feature 1..139: note = hyper
  source 1..139: mol_type = genomic DNA
actcgcacccgaccacgtgcagcggcgagcccatggacccggaggagatcgcgcgcaaggagctggagaagatggagaagaagaagcgcaagcacgagaagaagctgctgaagagccagggccgccacttgcactcgcc

SEQ ID NO: 96315 - DNA, 184 bp, Homo sapiens
  misc_feature 1..184: note = chr7:1275733-1275917
  misc_feature 1..184: note = hyper
  source 1..184: mol_type = genomic DNA
cggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggt

SEQ ID NO: 96316 - DNA, 30 bp, Homo sapiens
  misc_feature 1..30: note = chr7:127615921-127615951
  misc_feature 1..30: note = hypo
  source 1..30: mol_type = genomic DNA
gttagtaggcaggtccggctccattcagca

SEQ ID NO: 96317 - DNA, 131 bp, Homo sapiens
  misc_feature 1..131: note = chr7:1276436-1276567
  misc_feature 1..131: note = hyper
  source 1..131: mol_type = genomic DNA
ggggactgcgcggacgcggggaccgccggccccgcgcccccgccgcccgcgccgtcgcccaggcccggccctcggcctcccagccccgccgaggagccggccacctgcggggttcccgagcctggcgcggc

SEQ ID NO: 96318 - DNA, 567 bp, Homo sapiens
  misc_feature 1..567: note = chr7:1276989-1277556
  misc_feature 1..567: note = hyper
  source 1..567: mol_type = genomic DNA
ccaagcgcccagccccgccgcccttcccacctttccacgcctctctccgcgggtggggcccggagggggccccgcacttcccgggggtctgcgcttaatgcgtccttttgtgtgcgtgtgtgtctgtgttttctgattcaacacatttatgcatctgcggctcccggtccccgcccgccccggcgctccccctcctaccccgcgccgcacacgcacgctcacatccgccgcgcgcccccgcgcgcactggcacacgccggggcgcgcggcgcggggtgacggagccgggggctgcgagggccgggccgctgggctcctgcagagttttgatatgaaagtaattattttccggtggctgctgcggggactgggtttcttgcccaaagggttattatacattaccgatttctagtgatatggaatcacataaacttcctacaataatagaattagcatgaaaggctggggtgtcaaattgaaattggagaataatagcgccggcagctgggggagtgcgtgcgcatattggagcggagatggggaatcgtggggcggaattttcatgag

SEQ ID NO: 96319 - DNA, 153 bp, Homo sapiens; identical to SEQ ID NO: 715
  misc_feature 1..153: note = chr7:127744057-127744210
  misc_feature 1..153: note = hyper
  source 1..153: mol_type = genomic DNA

SEQ ID NO: 96320 - DNA, 499 bp, Homo sapiens
  misc_feature 1..499: note = chr7:127744211-127744710
  misc_feature 1..499: note = hyper
  source 1..499: mol_type = genomic DNA
cagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctccttgttcctctaccagtccctccctccgcaggtctctgggg

SEQ ID NO: 96321 - DNA, 23 bp, Homo sapiens
  misc_feature 1..23: note = chr7:12776931-12776954
  misc_feature 1..23: note = hypo
  source 1..23: mol_type = genomic DNA
agtcactgcgcctggccagtgtt

SEQ ID NO: 96322 - DNA, 141 bp, Homo sapiens
  misc_feature 1..141: note = chr7:127776269-127776410
  misc_feature 1..141: note = hyper
  source 1..141: mol_type = genomic DNA
gaggaagcgggtccccgcgccctgggttccgattctggcccgaggctcagctaggatggccccagatcccagagaacgtcctacctagtgcccgtttctacacctccccctcccgccccagagttacgggttaaggagaaa

SEQ ID NO: 96323 - DNA, 151 bp, Homo sapiens
  misc_feature 1..151: note = chr7:1277825-1277976
  misc_feature 1..151: note = hyper
  source 1..151: mol_type = genomic DNA
ccagccccgcgcccccgcccctgcccgcagccgccccatcccaaagtgaaccgccacccgtcctccatctccccccacccccccaaaaaccccaacccactggcctcaattttcctgggccctgggtcctcgttgccgcaaaagccaccaa

SEQ ID NO: 96324 - DNA, 897 bp, Homo sapiens
  misc_feature 1..897: note = chr7:127806266-127807163
  misc_feature 1..897: note = hyper
  source 1..897: mol_type = genomic DNA
ccacgaaggtcagtgcgtggttgcctgctcatcatctctgtggtcagcaaggaacaaaggccaataggagaatacctggggtcagggggctgggggaacggcgtgctgtgcaagacatcagtaggctctgtgcatgcacagagaccttgggggacgtttccctaaatctcaggcacactcttacaccctctaaccccccgccaccccccgccagaaaaaatctcaccctgggcgagacaagcccagggtgaaatgaaccaacagggacctctctgcgcccttcacccggttcctctgggaggaaggggaacgccaatgcccgggagcggcctttgggaggaaggggaaggctaatgccctctcaaatgctcttccctgcttcccgcatctactcaggtgtgtgagggagcccgcggaacccgctctgcccagccggcgcgccctcgaccgccctcggagttccgcggctccgcgcgccgcctccccgcctccgccgacattccgaggctccgcgtttgccatttcgatctggaggcgcattctcctcaccctcggagagagactgggtcaagggcccaggctgggaagaagggacagctagtaaaggaactctgcccgcctggccggcggagagccgcagagagaggacgctcacaaaagtcggtcgctacccggcccaaacgattgtggagccggcgagagcaactggtcccccagtcctcctccctggaggaggtgcgggggcgcggcaggcgggcttggcccaccccagccgaggagcttgtgggggacggcgggcggccggctggacccctgcagggcttcccccactttcgggagcccgagcggccgagggagaaagggcaggggctctccgccgtccgtctgggagagcag

SEQ ID NO: 96325 - DNA, 1247 bp, Homo sapiens
  misc_feature 1..1247: note = chr7:127807478-127808725
  misc_feature 1..1247: note = hyper
  source 1..1247: mol_type = genomic DNA
tctcaaaatagtaggcgagcgcggccggcgctgccctggcgaggggtgggggctccgcgctcgctcgcgcgagccgagttagctgcagggttacaaacagtatctccctgctcccccggcctgaattaatgtgttactatttcgggcgagccagtgtttccaggggaaacctaatgacgcaatgacgtcaatgcaggtcagcagcagactctccgggagggcgggcgggctcccggctttcgggctcggcgcagtctgcgggcgggagggcgccggcgaggtggcgagggcggctggcgcgggggcgcgggagccccggctaagcccggggacgggagggcgccccctcccagcgcccgaacccaggcaacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttcttagtgctcatcctgccttctcgccccaactcgttgtgcccttccc

SEQ ID NO: 96326 - DNA, 234 bp, Homo sapiens
  misc_feature 1..234: note = chr7:1278288-1278522
  misc_feature 1..234: note = hyper
  source 1..234: mol_type = genomic DNA
gagcaggggagggggcgggatccacgggaaggagacctctgcgctggttgcccaactctgggacaggccgcccccagtggaagccaggagttgtcggggaggggacgcggggttcccatggaggtcgcaggagctcggccgcagagcctggccctctgcccctacccctgcttcctggggtcctgcagcctgggcctccccacaggccggccagggccgcgtcccagcagcgcg

SEQ ID NO: 96327 - DNA, 71 bp, Homo sapiens
  misc_feature 1..71: note = chr7:127841202-127841273
  misc_feature 1..71: note = hyper
  source 1..71: mol_type = genomic DNA
tttacagttaaaaggcgttagcgctggcctttgagacagactcactgagccacccaaggtcacccgggcag

SEQ ID NO: 96328 - DNA, 159 bp, Homo sapiens; identical to SEQ ID NO: 3109
  misc_feature 1..159: note = chr7:127841338-127841497
  misc_feature 1..159: note = hyper
  source 1..159: mol_type = genomic DNA

SEQ ID NO: 96329 - DNA, 225 bp, Homo sapiens
  misc_feature 1..225: note = chr7:127841625-127841850
  misc_feature 1..225: note = hyper
  source 1..225: mol_type = genomic DNA
cgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtggctgcccttcgtcctcgtcgccgggacccctct

SEQ ID NO: 96330 - DNA, 30 bp, Homo sapiens
  misc_feature 1..30: note = chr7:1279210-1279240
  misc_feature 1..30: note = hyper
  source 1..30: mol_type = genomic DNA
tagaatattaagagccgagctgcagaaagg

SEQ ID NO: 96331 - DNA, 30 bp, Homo sapiens
  misc_feature 1..30: note = chr7:127982386-127982416
  misc_feature 1..30: note = hypo
  source 1..30: mol_type = genomic DNA
gagaatctttcaaaacgaatgccagatcac

SEQ ID NO: 96332 - DNA, 200 bp, Homo sapiens
  misc_feature 1..200: note = chr7:1279875-1280075
  misc_feature 1..200: note = hyper
  source 1..200: mol_type = genomic DNA
ggcggccttccactgcggctccctccgcgtccgatgccaggagagggtgggagtggaggacgcggccccctgcttcgctaggtaggggttcctggctgttctaggcggctgctcttctctgctaggtggtgcctctgggcggggagcaggggcctcctccacaacgcggccagggtctaggagtgcggggcaggaggtcc

SEQ ID NO: 96333 - DNA, 82 bp, Homo sapiens
  misc_feature 1..82: note = chr7:127991661-127991743
  misc_feature 1..82: note = hyper
  source 1..82: mol_type = genomic DNA
gcagcagcggagccgcgtggcccggggacaagcggaagagcttggcccagcagcgcggcggcacgcgaggactgcagagcgc

SEQ ID NO: 96334 - DNA, 136 bp, Homo sapiens; identical to SEQ ID NO: 31537
  misc_feature 1..136: note = chr7:127991787-127991923
  misc_feature 1..136: note = hyper
  source 1..136: mol_type = genomic DNA

SEQ ID NO: 96335 - DNA, 275 bp, Homo sapiens; identical to SEQ ID NO: 31538
  misc_feature 1..275: note = chr7:127992044-127992319
  misc_feature 1..275: note = hyper
  source 1..275: mol_type = genomic DNA

SEQ ID NO: 96336 - DNA, 180 bp, Homo sapiens
  misc_feature 1..180: note = chr7:127992371-127992551
  misc_feature 1..180: note = hyper
  source 1..180: mol_type = genomic DNA
cgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccaggccagcccccagcgagccctggcctct

SEQ ID NO: 96337 - DNA, 15 bp, Homo sapiens
  misc_feature 1..15: note = chr7:128001006-128001021
  misc_feature 1..15: note = hyper
  source 1..15: mol_type = genomic DNA
cgtcacatacccccc

SEQ ID NO: 96338 - DNA, 157 bp, Homo sapiens
  misc_feature 1..157: note = chr7:128002255-128002412
  misc_feature 1..157: note = hyper
  source 1..157: mol_type = genomic DNA
agcttggtagaaactcgaaccgtctccctgccggccctctccaccacctggtggttttcaacagttgcactgctacacagcagtgcctccaacacttcaccggtgaactgccaaatgccaatccctgtgtgacatgtcttttcgctaaaactgatct

SEQ ID NO: 96339 - DNA, 1250 bp, Homo sapiens
  misc_feature 1..1250: note = chr7:1280349-1281599
  misc_feature 1..1250: note = hyper
  source 1..1250: mol_type = genomic DNA
gatttatttttaacccgaggttgtacaagcccctgacagtttggataaattagccaggcctcgcagtctcctaatgagagggtattatttcggcacctcggaaggagcgtgaaaaatgagagagactccatccggaggtgtcggatcgattcaggatcagggtgtaaattatatacaactaaatatccagccgcccataccgctgcttaatacggagcttagaaatgcaacattaaacaaagattatgagagatcgacgcctctggaccgagcccaattcactgctcagccgggtcagcccctgccccgcgggccgaggatggggagggggcgcgcaaggagtgaaaacggcgagtttgggatgagagccagggccaggaggggagcctcgccctcgctactccttccctttcttctaaagccagggagctccccgcccagcattgcccgttccttcctccccgccagggcccagagaaatccgggctccagcaccgggcctcagtttcccggaagcggacttgggccccgatcccgggccctctccgcccttcccaggtctcaggcgtcgctgcgtggaggaggcgcgcgtggctcccggcgccgatgtcccggcccggaaccctgcccgccgctgcgactccggggcgggggtgggtcagcctcgggggcggccggggtgggcgtggaggtggacgcggggccgcatattgggcgcttggttctgtttatctcacttagcggtggagggactggagggaaggggcggcccgaagggaggccttggtggggcccagcggctccctggcgcaccccggacacggtggccacgaggagccggggctgtggccgagggctgcccgcaccccgagacccttcctcgtgggcccctctgcccggggcgccgcccagagggggcccggacggaaccccccgcgcggggaaccaccgggccgggcagagctggcgtgagtatggagggggcgcgtggggacagaaaccccgagctgggaggagcggggcgcggggctggccagtctgcggctctctgggccccgctgggcgtcctcccttcctcccggccgctctctccttgcctttccggggtctccccgcgcccggcgcccctcgcccagccgtgactccctttcctctcggccgcccgactccgcgcgcccctctcggcttttccgagctgggatcaccctccccgagagaggagcgggccattgccgcgtgtgggtgttgca

SEQ ID NO: 96340 - DNA, 102 bp, Homo sapiens; identical to SEQ ID NO: 41440
  misc_feature 1..102: note = chr7:128096987-128097089
  misc_feature 1..102: note = hypo
  source 1..102: mol_type = genomic DNA

SEQ ID NO: 96341 - DNA, 101 bp, Homo sapiens
  misc_feature 1..101: note = chr7:128097589-128097690
  misc_feature 1..101: note = hypo
  source 1..101: mol_type = genomic DNA
agacaagctgagcaccgttgtaaccagagaactattactaggccttgaagaacctgtctaactggatgctcattgcctgggcaaggcctgtttaggccggt

SEQ ID NO: 96342 - DNA, 23 bp, Homo sapiens
  misc_feature 1..23: note = chr7:128126053-128126076
  misc_feature 1..23: note = hypo
  source 1..23: mol_type = genomic DNA
aagaaaagcacaggccgggcgtg

SEQ ID NO: 96343 - DNA, 331 bp, Homo sapiens
  misc_feature 1..331: note = chr7:1281819-1282150
  misc_feature 1..331: note = hyper
  source 1..331: mol_type = genomic DNA
actttcaataactatcgataatctcatctgcacagaaccccccgcctctccgcgttatcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggcccccacaggctgcgcctgacgggaccggcgggaggcctttgttcgcagcccggaggccccaggctccaaaccacactcgggctgcggggagcgagcgcgggcgttgccgcta

SEQ ID NO: 96344 - DNA, 175 bp, Homo sapiens
  misc_feature 1..175: note = chr7:1282506-1282681
  misc_feature 1..175: note = hyper
  source 1..175: mol_type = genomic DNA
gtttctgcttgcaggcgttcctgcagtaggagggcgcgcagaggcccagagaggggaagggacttgcctaagatcacacagcgtcccagaggccttactgggcaggggagggggtggcccggccgggccctcgcgcgccggcttctgctgattctttctgcggcctgataataag

SEQ ID NO: 96345 - DNA, 103 bp, Homo sapiens; identical to SEQ ID NO: 41442
  misc_feature 1..103: note = chr7:128315917-128316020
  misc_feature 1..103: note = hypo
  source 1..103: mol_type = genomic DNA

SEQ ID NO: 96346 - DNA, 138 bp, Homo sapiens; identical to SEQ ID NO: 31541
  misc_feature 1..138: note = chr7:128337405-128337543
  misc_feature 1..138: note = hyper
  source 1..138: mol_type = genomic DNA

SEQ ID NO: 96347 - DNA, 134 bp, Homo sapiens; identical to SEQ ID NO: 719
  misc_feature 1..134: note = chr7:128337787-128337921
  misc_feature 1..134: note = hyper
  source 1..134: mol_type = genomic DNA

SEQ ID NO: 96348 - DNA, 315 bp, Homo sapiens
  misc_feature 1..315: note = chr7:1283626-1283941
  misc_feature 1..315: note = hyper
  source 1..315: mol_type = genomic DNA
gacacaggggctttccgggatcgaaaggtgtttcttccctttctaagtcacgtcaggccacctccgaccccagccgacacgctaccaggcctgcaccatagaagtgggctctgagagtgttcccaagccctgggggagggggactccccagagatcgtgtccccgacccctccttccgggcccactgctgccatcccaaacccagccccccagcgtaactcgcaccctcatcccctttcccgaggaatccaaactccggtttaatgagtcgtgaagtgtgagaacttccggagcccgcagcgcccctgatgccaa

SEQ ID NO: 96349 - DNA, 47 bp, Homo sapiens
  misc_feature 1..47: note = chr7:1284177-1284224
  misc_feature 1..47: note = hyper
  source 1..47: mol_type = genomic DNA
tcctcggagctatttcgggggaattcaattttcgctgaatggtgaga

SEQ ID NO: 96350 - DNA, 173 bp, Homo sapiens
  misc_feature 1..173: note = chr7:128430709-128430882
  misc_feature 1..173: note = hyper
  source 1..173: mol_type = genomic DNA
agagtgaacatcagtcgtgcccactctgagcgggctactgtgggggcgtggctcgcagcccaccgggtgtgggaccggaagggaagacagggcggaggagagggggtcttccggccctgaggcttgatggggccaccggagggctcctcctaagagggtccttggccctggct

SEQ ID NO: 96351 - DNA, 34 bp, Homo sapiens
  misc_feature 1..34: note = chr7:128430922-128430956
  misc_feature 1..34: note = hyper
  source 1..34: mol_type = genomic DNA
cgttcgcccatccgggcctcgacttccctcctcc

SEQ ID NO: 96352 - DNA, 624 bp, Homo sapiens
  misc_feature 1..624: note = chr7:128470433-128471057
  misc_feature 1..624: note = hyper
  source 1..624: mol_type = genomic DNA
ttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 96353 - DNA, 154 bp, Homo sapiens
  misc_feature 1..154: note = chr7:128471125-128471279
  misc_feature 1..154: note = hyper
  source 1..154: mol_type = genomic DNA
cggggagctgagagacagggcggagggcaccccccggtatagagagaagaccctggccccggccctcccacccatcgacaagggccatgggcactgcctgcacacccctctggggacagcgagcactccctgggtgccccggggagtccaggcc

SEQ ID NO: 96354 - DNA, 30 bp, Homo sapiens
  misc_feature 1..30: note = chr7:128481374-128481404
  misc_feature 1..30: note = hypo
  source 1..30: mol_type = genomic DNA
tgcccacatcctgcccgccccacctgactg

SEQ ID NO: 96355 - DNA, 30 bp, Homo sapiens
  misc_feature 1..30: note = chr7:128482220-128482250
  misc_feature 1..30: note = hyper
  source 1..30: mol_type = genomic DNA
gcggccagcagagggcgctctgcagaggcc

SEQ ID NO: 96356 - DNA, 106 bp, Homo sapiens
  misc_feature 1..106: note = chr7:128482943-128483049
  misc_feature 1..106: note = hypo
  source 1..106: mol_type = genomic DNA
tcaccgtcaagtacacgccaccaggggcgggccgctacaccatcatggtgctgtttgccaaccaggtacctaagctcctgggtactcacagcgacatgcacctgcc

SEQ ID NO: 96357 - DNA, 50 bp, Homo sapiens
  misc_feature 1..50: note = chr7:128484931-128484981
  misc_feature 1..50: note = hypo
  source 1..50: mol_type = genomic DNA
cccacatccctggctcgcccttcaaagccaccattcggcctgtgtttgac

SEQ ID NO: 96358 - DNA, 142 bp, Homo sapiens
  misc_feature 1..142: note = chr7:128486098-128486240
  misc_feature 1..142: note = hypo
  source 1..142: mol_type = genomic DNA
cacaggcggcaaccacgtgacggctcgtgtgctcaacccctcgggggccaagacagacacctatgtgacagacaatggggacggcacctaccgagtgcagtacaccgcctacgaggagggtgagggccggtgggccaggcta

SEQ ID NO: 96359 - DNA, 128 bp, Homo sapiens
  misc_feature 1..128: note = chr7:128493102-128493230
  misc_feature 1..128: note = hypo
  source 1..128: mol_type = genomic DNA
gagcccccattccagcgggtgcctcccacaggcacttgtcctcgtcctgcccagcacccccttggccgcactctctcctccctgaaacttcctgaccagtctgcgtcaggattcgcattctggggccc

SEQ ID NO: 96360 - DNA, 30 bp, Homo sapiens
  misc_feature 1..30: note = chr7:128494242-128494272
  misc_feature 1..30: note = hypo
  source 1..30: mol_type = genomic DNA
ttcggcagcatcacccggcagcaggagggt

SEQ ID NO: 96361 - DNA, 30 bp, Homo sapiens
  misc_feature 1..30: note = chr7:128507583-128507613
  misc_feature 1..30: note = hypo
  source 1..30: mol_type = genomic DNA
ctgaagatgcaaattcggaggtcattggaa

SEQ ID NO: 96362 - DNA, 120 bp, Homo sapiens
  misc_feature 1..120: note = chr7:128510078-128510198
  misc_feature 1..120: note = hyper
  source 1..120: mol_type = genomic DNA
cttcgggcgggtaagcgcagcccacgccccctcccgggcggcccccagctttgccaccgccggtgccgacctttgtggctcgcctttgatcatgctctgcgtcagcgtggtagtccttct

SEQ ID NO: 96363 - DNA, 40 bp, Homo sapiens
  misc_feature 1..40: note = chr7:128525170-128525210
  misc_feature 1..40: note = hypo
  source 1..40: mol_type = genomic DNA
tcatggggcccttggcggggctgggcgcaagagctgatgc

SEQ ID NO: 96364 - DNA, 389 bp, Homo sapiens
  misc_feature 1..389: note = chr7:128528743-128529132
  misc_feature 1..389: note = hypo
  source 1..389: mol_type = genomic DNA
atacaaacacacagccgtgcccgggacctctatcaaaggtgagggagtcggagagtgagagaaaagtatggtggagcggcaggcagtgggagggctgggaggaaagtggaatcggtgagaaaggcaccccgggagccccagcagggggaatggaagggcaggtgtggctctaccctggcaggtcgggcagcagtgcccagaggggatgagtgggtggctgcagcccggaggctcacagggccggcggccgcaggtcacgaagcctccaagacaggtacacaggttgcagggttctcgggggtctgggaactcctggttactcaggtaggactcccccaggtactcacagcctttcagagaagagacagagaggccgaggggagggacag

SEQ ID NO: 96365 - DNA, 156 bp, Homo sapiens
  misc_feature 1..156: note = chr7:128531803-128531959
  misc_feature 1..156: note = hypo
  source 1..156: mol_type = genomic DNA
tcctggcaggggtctcgggggtgggagaagctctcgccgtccacaaacacctcttcctccaggatgcagtctgggcagtggatggtgggggcaggtatgagggcaaagcctgacagtccctccagccctggagtccagagccgccacacaagtgcc

SEQ ID NO: 96366 - DNA, 41 bp, Homo sapiens
  misc_feature 1..41: note = chr7:128532991-128533032
  misc_feature 1..41: note = hypo
  source 1..41: mol_type = genomic DNA
cttgacagacgcaggcggtgcagggccgaccatcaggctcc

SEQ ID NO: 96367 - DNA, 30 bp, Homo sapiens; identical to SEQ ID NO: 41449
  misc_feature 1..30: note = chr7:128533290-128533320
  misc_feature 1..30: note = hypo
  source 1..30: mol_type = genomic DNA

SEQ ID NO: 96368 - DNA, 30 bp, Homo sapiens
  misc_feature 1..30: note = chr7:128555645-128555675
  misc_feature 1..30: note = hyper
  source 1..30: mol_type = genomic DNA
gcccaggaactattgcgccccatccttctc

SEQ ID NO: 96369 - DNA, 104 bp, Homo sapiens; identical to SEQ ID NO: 30994
  misc_feature 1..104: note = chr7:1286007-1286111
  misc_feature 1..104: note = hyper
  source 1..104: mol_type = genomic DNA

SEQ ID NO: 96370 - DNA, 84 bp, Homo sapiens
  misc_feature 1..84: note = chr7:1286670-1286754
  misc_feature 1..84: note = hyper
  source 1..84: mol_type = genomic DNA
acaaaagagtaactccggagaattagagaaaaaacccacgcaacaacaacacgagtcgggggcggggtgagcgctccggagagg

SEQ ID NO: 96371 - DNA, 485 bp, Homo sapiens
  misc_feature 1..485: note = chr7:1286886-1287371
  misc_feature 1..485: note = hyper
  source 1..485: mol_type = genomic DNA
cgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcaccagcctccccggagcccctgccggtccccagcctgggggctcaggggtcccgttgggcgtgtgtcccgcccgggccccggtgtggggggcgcgcagtcctcagggccgcctccctcccgcccccagcacagcgccccccagctctcagccggtccttgcggccgcgggatcccagccccagcagcgggaaactgaggcc

SEQ ID NO: 96372 - DNA, 18 bp, Homo sapiens
  misc_feature 1..18: note = chr7:128718421-128718439
  misc_feature 1..18: note = hypo
  source 1..18: mol_type = genomic DNA
acccggccaagaaacttt

SEQ ID NO: 96373 - DNA, 35 bp, Homo sapiens
  misc_feature 1..35: note = chr7:1287623-1287658
  misc_feature 1..35: note = hyper
  source 1..35: mol_type = genomic DNA
ggttgcttggcaacccgaggcggctcattaccgcg

SEQ ID NO: 96374 - DNA, 37 bp, Homo sapiens
  misc_feature 1..37: note = chr7:128767772-128767809
  misc_feature 1..37: note = hypo
  source 1..37: mol_type = genomic DNA
agtggccaggctccccgcgtcccgctggtgacctgcc

SEQ ID NO: 96375 - DNA, 196 bp, Homo sapiens
  misc_feature 1..196: note = chr7:1288109-1288305
  misc_feature 1..196: note = hyper
  source 1..196: mol_type = genomic DNA
ttcggtgctgaggtgcgtgtaggcagggcagtttgggtccccgcctttgtggaactggtgttctgtgcagaaggcgggcgggcagttgtcccctggaaaacaggaaaggagaggatagtgtttgggcctcggcgccagctgtgagcacagcgggtgggcattcctcacgcaggcagccttgcggagcagggaggtc

SEQ ID NO: 96376 - DNA, 536 bp, Homo sapiens
  misc_feature 1..536: note = chr7:128828104-128828640
  misc_feature 1..536: note = hyper
  source 1..536: mol_type = genomic DNA
ggcgggcctggagaacggggcagagatggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaacaaaggagccgggtcgccggcggggagagttcggggggctgcggcgcgctggggcgaaggtggctgctgggccgcgggctggcgcgggggcggagccggagctgcactcgcacccccggcccgcgtctggcctccctc

SEQ ID NO: 96377 - DNA, 475 bp, Homo sapiens; identical to SEQ ID NO: 31549
  misc_feature 1..475: note = chr7:128828904-128829379
  misc_feature 1..475: note = hyper
  source 1..475: mol_type = genomic DNA

SEQ ID NO: 96378 - DNA, 301 bp, Homo sapiens
  misc_feature 1..301: note = chr7:1288552-1288853
  misc_feature 1..301: note = hyper
  source 1..301: mol_type = genomic DNA
tctgagggagctttccgtgggatggctgggcctctgttgcagttgcgaccaatgctgcggtttaaattctccctgggtccaatcctgcttccctcccctaagcctctcgcacacacacctcggctcaggctattcaccgggaaagccacgcggaggcagggcaggcagcgccccgccagagacccccggatggtggagatggtgcggtggagtcgggactgctgggggcacctgctgatgaggtgggagggtaaagccacgggggatgcgggtttctggacttgttcgggtgggcggggcg

SEQ ID NO: 96379 - DNA, 242 bp, Homo sapiens
  misc_feature 1..242: note = chr7:1289320-1289562
  misc_feature 1..242: note = hyper
  source 1..242: mol_type = genomic DNA
ccctgcacccaggcacggagacactgcagaccctggcagggtccgggacaggcccagggctggagggaggggttcgagacaggccacccttcctggggcagcccccctccgcttcctcccacagctctatttagggcagacaggccaaagagagccacggaggcgtgttggacagcctagcagcggccatgaaccctggcacgtttatctgctggagcagtggagcccggcctcccagggag

SEQ ID NO: 96380 - DNA, 99 bp, Homo sapiens
  misc_feature 1..99: note = chr7:129142801-129142900
  misc_feature 1..99: note = hyper
  source 1..99: mol_type = genomic DNA
gggacaaggggtgcccggcggtccgcgcctgctgggggcgcagcagccgcggagtcaggccagccgtctttccaggttttaggtcgtggtcctgttgag

SEQ ID NO: 96381 - DNA, 27 bp, Homo sapiens
  misc_feature 1..27: note = chr7:129229604-129229631
  misc_feature 1..27: note = hypo
  source 1..27: mol_type = genomic DNA
agtcaccgcgcccggccagtcttttct

SEQ ID NO: 96382 - DNA, 30 bp, Homo sapiens; identical to SEQ ID NO: 41451
  misc_feature 1..30: note = chr7:129297274-129297304
  misc_feature 1..30: note = hypo
  source 1..30: mol_type = genomic DNA

SEQ ID NO: 96383 - DNA, 57 bp, Homo sapiens
  misc_feature 1..57: note = chr7:129330294-129330351
  misc_feature 1..57: note = hypo
  source 1..57: mol_type = genomic DNA
cagaacacgcccctgcgccacaggaggttaactcagaactgccgcctctcaccatcg

SEQ ID NO: 96384 - DNA, 258 bp, Homo sapiens; identical to SEQ ID NO: 41453
  misc_feature 1..258: note = chr7:129381062-129381320
  misc_feature 1..258: note = hypo
  source 1..258: mol_type = genomic DNA

SEQ ID NO: 96385 - DNA, 30 bp, Homo sapiens
  misc_feature 1..30: note = chr7:129407651-129407681
  misc_feature 1..30: note = hypo
  source 1..30: mol_type = genomic DNA
cctggctgtgtggcacggggcctgcagcct

SEQ ID NO: 96386 - DNA, 345 bp, Homo sapiens
  misc_feature 1..345: note = chr7:129418271-129418616
  misc_feature 1..345: note = hyper
  source 1..345: mol_type = genomic DNA
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcc

SEQ ID NO: 96387 - DNA, 65 bp, Homo sapiens
  misc_feature 1..65: note = chr7:129421284-129421349
  misc_feature 1..65: note = hyper
  source 1..65: mol_type = genomic DNA
acccccagctcctgccgagccgggaggggccaagggtgacggcaaggatacgaacccttcaatat

SEQ ID NO: 96388 - DNA, 79 bp, Homo sapiens; identical to SEQ ID NO: 31552
  misc_feature 1..79: note = chr7:129421630-129421709
  misc_feature 1..79: note = hyper
  source 1..79: mol_type = genomic DNA

SEQ ID NO: 96389 - DNA, 854 bp, Homo sapiens; identical to SEQ ID NO: 721
  misc_feature 1..854: note = chr7:129422115-129422969
  misc_feature 1..854: note = hyper
  source 1..854: mol_type = genomic DNA

SEQ ID NO: 96390 - DNA, 357 bp, Homo sapiens
  misc_feature 1..357: note = chr7:129423125-129423482
  misc_feature 1..357: note = hyper
  source 1..357: mol_type = genomic DNA
cgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcag

SEQ ID NO: 96391 - DNA, 1399 bp, Homo sapiens
  misc_feature 1..1399: note = chr7:129424547-129425946
  misc_feature 1..1399: note = hyper
  source 1..1399: mol_type = genomic DNA
ctgctttttaccaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 96392 - DNA, 30 bp, Homo sapiens
  misc_feature 1..30: note = chr7:129426289-129426319
  misc_feature 1..30: note = hyper
  source 1..30: mol_type = genomic DNA
gagaaagaccacaggcggtttgggttgttg

SEQ ID NO: 96393 - DNA, 30 bp, Homo sapiens; identical to SEQ ID NO: 41454
  misc_feature 1..30: note = chr7:129782524-129782554
  misc_feature 1..30: note = hypo
  source 1..30: mol_type = genomic DNA

SEQ ID NO: 96394 - DNA, 348 bp, Homo sapiens
  misc_feature 1..348: note = chr7:129794391-129794739
  misc_feature 1..348: note = hypo
  source 1..348: mol_type = genomic DNA
ctcctcgggaggccccgcaggagccctggcacctttccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcccatctgacacctcagcgcctgcccattccccgggaccaggccatctggcctcgctgctgcctctgctctgtgcaacccccatgccgcagcccgtcgcctcctgctccagcctccgccaggactgtcctgtgcgcccatcagggtgt

SEQ ID NO: 96395 - DNA, 41 bp, Homo sapiens
  misc_feature 1..41: note = chr7:129800321-129800362
  misc_feature 1..41: note = hypo
  source 1..41: mol_type = genomic DNA
aacaccttctcaaaccgccaggtttgcggcctggcagctta

SEQ ID NO: 96396 - DNA, 19 bp, Homo sapiens
  misc_feature 1..19: note = chr7:129844190-129844209
  misc_feature 1..19: note = hypo
  source 1..19: mol_type = genomic DNA
ttatttgttttgagacgga

SEQ ID NO: 96397 - DNA, 30 bp, Homo sapiens; identical to SEQ ID NO: 41456
  misc_feature 1..30: note = chr7:129846079-129846109
  misc_feature 1..30: note = hypo
  source 1..30: mol_type = genomic DNA

SEQ ID NO: 96398 - DNA, 30 bp, Homo sapiens
  misc_feature 1..30: note = chr7:129913242-129913272
  misc_feature 1..30: note = hyper
  source 1..30: mol_type = genomic DNA
gtgaattaatgctcacgtcctgagagatga

SEQ ID NO: 96399 - DNA, 143 bp, Homo sapiens
  misc_feature 1..143: note = chr7:1303425-1303568
  misc_feature 1..143: note = hypo
  source 1..143: mol_type = genomic DNA
cctccgcaggcagcgcgtcccccgcacacccgctgcccgcccggctttcactccagaatggcgctgcccgtgcctgtacagacagctggcaaagcgtcagatggcattacaatatttttacttataatcgagaaagcaataaa

SEQ ID NO: 96400 - DNA, 248 bp, Homo sapiens
  misc_feature 1..248: note = chr7:1308287-1308535
  misc_feature 1..248: note = hypo
  source 1..248: mol_type = genomic DNA
gctcgcccctgtccccgaagccccaggacacccagtggccctctttgggctggacccaccctggccaccctggcccttccggctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 96401 - DNA, 185 bp, Homo sapiens
  misc_feature 1..185: note = chr7:1309947-1310132
  misc_feature 1..185: note = hypo
  source 1..185: mol_type = genomic DNA
ccctctcccccaacccgccagggcagtgccaaactgcgggactcagccccaagccccactactgccgccatggtgtccccactccaggacaaccagggccctgcctcactgccctctgaacagcctcatcctgcggggctagttctggtcccttcttttgctgaagtccccgccgcccactccag

SEQ ID NO: 96402 - DNA, 31 bp, Homo sapiens
  misc_feature 1..31: note = chr7:131011381-131011412
  misc_feature 1..31: note = hypo
  source 1..31: mol_type = genomic DNA
gtgtgagccaccgtgccgggcctggcctttc

SEQ ID NO: 96403 - DNA, 81 bp, Homo sapiens
  misc_feature 1..81: note = chr7:131041515-131041596
  misc_feature 1..81: note = hypo
  source 1..81: mol_type = genomic DNA
ggaatgtatccaaatcgtgtgcgccaaatatgttgccggtggcagatacccaagttaccccgattccgtatgggtctgcca

SEQ ID NO: 96404 - DNA, 167 bp, Homo sapiens; identical to SEQ ID NO: 41015
  misc_feature 1..167: note = chr7:131076-131243
  misc_feature 1..167: note = hypo
  source 1..167: mol_type = genomic DNA

SEQ ID NO: 96405 - DNA, 147 bp, Homo sapiens
  misc_feature 1..147: note = chr7:131231034-131231181
  misc_feature 1..147: note = hypo
  source 1..147: mol_type = genomic DNA
ggagtgtacagtgggcgtgtccaggagctgattacccaatcacaagcgccatttatccaggtagaaagagagccaagaggtggaagactgcatttaaccacgttatgggctaaccacctagggggctgccaggatcggggtgcaggt

SEQ ID NO: 96406 - DNA, 42 bp, Homo sapiens
  misc_feature 1..42: note = chr7:131240674-131240716
  misc_feature 1..42: note = hyper
  source 1..42: mol_type = genomic DNA
agagtcccgcagaagcgtggagcctcgcggtgcggtctccct

SEQ ID NO: 96407 - DNA, 379 bp, Homo sapiens
  misc_feature 1..379: note = chr7:131242722-131243101
  misc_feature 1..379: note = hyper
  source 1..379: mol_type = genomic DNA
gcacatcggcggagccgggaagcggagggggcgaggggtgattaaccttggaacccgggtacggcgtaaatttggctcacgtgactccggggttgctaatctggagtctatctgccagatggggctgggtggaggggttttctccaggatctagccgcgtcccgggcacaggggactccgtgagcccctcaagtcggctgcaagcaggcgatgcctgcagggcactgcgtccctggagccgcgaaggaagcgctggagccctggctggggttccgtggcagccggcctcaagcttgggaagggctgacggggttgttttcatcaggaagtttctgcaggatcgttctggccccgttttccacaccgcatatgggaaaga

SEQ ID NO: 96408 - DNA, 65 bp, Homo sapiens
  misc_feature 1..65: note = chr7:131377139-131377204
  misc_feature 1..65: note = hyper
  source 1..65: mol_type = genomic DNA
gcagagggcctgatgcggcagggccaccgtgggggccaggcctggaaacacgtgctgatttcctt

SEQ ID NO: 96409 - DNA, 30 bp, Homo sapiens; identical to SEQ ID NO: 41060
  misc_feature 1..30: note = chr7:1313980-1314010
  misc_feature 1..30: note = hypo
  source 1..30: mol_type = genomic DNA

SEQ ID NO: 96410 - DNA, 30 bp, Homo sapiens
  misc_feature 1..30: note = chr7:131422856-131422886
  misc_feature 1..30: note = hypo
  source 1..30: mol_type = genomic DNA
aattactgtgtcctccgcggcttgattaac

SEQ ID NO: 96411 - DNA, 271 bp, Homo sapiens
  misc_feature 1..271: note = chr7:131514720-131514991
  misc_feature 1..271: note = hyper
  source 1..271: mol_type = genomic DNA
aagcccccactttggcgctcctgggcttggatcccgctgtgaggccgggggcaggtgatcatggcaggcggtaggactcctctcactctctgccccagaccccgcctgggagcctctgccgccctctcctgctccagcaggcaaggccaggaagccgggagtgcttgctgtcaatatcacatgtggagctgcttgtggccggccaggactctcaaagcccagcctcccaggtcaggcgtgggctcctcctactcctcgtcactttctagct

SEQ ID NO: 96412 - DNA, 143 bp, Homo sapiens
  misc_feature 1..143: note = chr7:1315844-1315987
  misc_feature 1..143: note = hypo
  source 1..143: mol_type = genomic DNA
aacccttcctctgcccgctcccgcgcctcacctcgctggcaaaacagcccctggcatgatcatcgcaccggcctgcggggtcagcagccccactggctcgccggggcctgggcctgggcctggggggccgggactccaggtgg

SEQ ID NO: 96413 - DNA, 30 bp, Homo sapiens; identical to SEQ ID NO: 41062
  misc_feature 1..30: note = chr7:1318952-1318982
  misc_feature 1..30: note = hypo
  source 1..30: mol_type = genomic DNA

SEQ ID NO: 96414 - DNA, 30 bp, Homo sapiens
  misc_feature 1..30: note = chr7:132086857-132086887
  misc_feature 1..30: note = hypo
  source 1..30: mol_type = genomic DNA
gcctacataccaaagcgaatgcacttgact

SEQ ID NO: 96415 - DNA, 187 bp, Homo sapiens
  misc_feature 1..187: note = chr7:132099502-132099689
  misc_feature 1..187: note = hypo
  source 1..187: mol_type = genomic DNA
gacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaa

SEQ ID NO: 96416 - DNA, 37 bp, Homo sapiens
  misc_feature 1..37: note = chr7:132155928-132155965
  misc_feature 1..37: note = hypo
  source 1..37: mol_type = genomic DNA
tgacgtgcctgctctcgattcgccttctgccatgact

SEQ ID NO: 96417 - DNA, 37 bp, Homo sapiens
  misc_feature 1..37: note = chr7:132156085-132156122
  misc_feature 1..37: note = hypo
  source 1..37: mol_type = genomic DNA
gaacggtgtaatacaaatagaccgttgtgtgtgttgt

SEQ ID NO: 96418 - DNA, 998 bp, Homo sapiens
  misc_feature 1..998: note = chr7:132260210-132261208
  misc_feature 1..998: note = hyper
  source 1..998: mol_type = genomic DNA
gaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcag

SEQ ID NO: 96419 - DNA, 249 bp, Homo sapiens; identical to SEQ ID NO: 31561
  misc_feature 1..249: note = chr7:132261256-132261505
  misc_feature 1..249: note = hyper
  source 1..249: mol_type = genomic DNA

SEQ ID NO: 96420 - DNA, 908 bp, Homo sapiens
  misc_feature 1..908: note = chr7:132261534-132262442
  misc_feature 1..908: note = hyper
  source 1..908: mol_type = genomic DNA
cggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcat

SEQ ID NO: 96421 - DNA, 236 bp, Homo sapiens
  misc_feature 1..236: note = chr7:132299552-132299788
  misc_feature 1..236: note = hyper
  source 1..236: mol_type = genomic DNA
ggagacacctcccaccgcggaactgagccgcggagaaaagcaagctgcagagaaagaggaagcagatgtgcagagaggcggagatggaggagtggctgggaaggtcgcctgtgtcccgccggcttccaagttccagagccttccggagcctcttctgaaatcctgccccctggcttcccaagatgtcccttgcccttaaactgtaataaatctctctcccccgagccctcgccctc

SEQ ID NO: 96422 - DNA, 332 bp, Homo sapiens
  misc_feature 1..332: note = chr7:132340002-132340334
  misc_feature 1..332: note = hyper
  source 1..332: mol_type = genomic DNA
cttgcccagcaccctcggtgggctcctgacactcctagtgccgaaatggatggctactcaccctttggggctgaccctttctcctccatcccctcccactccattaccacagcgattcattgaaagagatcaataattatgaaaaacaattgattttctactcccctccacccccttctttctctgagtaagtctgtctgacatgcataacgggaatcaaaccagagaggaagtgctgcggcttccctggtgggacattgtgctctctctccctctcggagggcccctccctctgcactttcagcgatttcaagatccgcacattactcttt

SEQ ID NO: 96423 - DNA, 117 bp, Homo sapiens; identical to SEQ ID NO: 41462
  misc_feature 1..117: note = chr7:132418949-132419066
  misc_feature 1..117: note = hypo
  source 1..117: mol_type = genomic DNA

SEQ ID NO: 96424 - DNA, 34 bp, Homo sapiens
  misc_feature 1..34: note = chr7:1325238-1325272
  misc_feature 1..34: note = hypo
  source 1..34: mol_type = genomic DNA
ccgagggtgggggtacggccgggcgggtggacgc

SEQ ID NO: 96425 - DNA, 430 bp, Homo sapiens
  misc_feature 1..430: note = chr7:1325577-1326007
  misc_feature 1..430: note = hypo
  source 1..430: mol_type = genomic DNA
gccctgcccctccagcgctgggcacctctcactcctttccagggacccccaggccatggcacagtgtcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtggaacccgggcgcactgggaggcacgatccaggcggagggagcagccgtgccagggccctgaggtgggaggggccgggcggcctcaggctcagcgaggggctgaggggccaacgtggccggagtgga

SEQ ID NO: 96426 - DNA, 121 bp, Homo sapiens
  misc_feature 1..121: note = chr7:1328492-1328613
  misc_feature 1..121: note = hypo
  source 1..121: mol_type = genomic DNA
tggctcctggaaacccggagaaagcagacaactcgtccgcgttgtcctggagatgcagccgacatcggcctgcttgtcctgctgccagggccgctgggggccccatcgatgtccacccggc

SEQ ID NO: 96427 - DNA, 67 bp, Homo sapiens
  misc_feature 1..67: note = chr7:1331210-1331277
  misc_feature 1..67: note = hypo
  source 1..67: mol_type = genomic DNA
tccatctgtgagtggcggctggaagcttctcaggcctccagagcgggaacgccgagctccttctgag

SEQ ID NO: 96428 - DNA, 100 bp, Homo sapiens
  misc_feature 1..100: note = chr7:1333580-1333680
  misc_feature 1..100: note = hypo
  source 1..100: mol_type = genomic DNA
gggaaggatgctcctcgccgtcataaacccgcgtgcaccgcgtcactccccgggcgccgagttccgccggcctggcacgggctcacgggcacccttggcc

SEQ ID NO: 96429 - DNA, 30 bp, Homo sapiens
  misc_feature 1..30: note = chr7:1335995-1336025
  misc_feature 1..30: note = hypo
  source 1..30: mol_type = genomic DNA
ccagagctggaagcccggtctgccaggccc

SEQ ID NO: 96430 - DNA, 301 bp, Homo sapiens
  misc_feature 1..301: note = chr7:133812094-133812395
  misc_feature 1..301: note = hyper
  source 1..301: mol_type = genomic DNA
tctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcaga

SEQ ID NO: 96431 - DNA, 40 bp, Homo sapiens
  misc_feature 1..40: note = chr7:1339547-1339587
  misc_feature 1..40: note = hypo
  source 1..40: mol_type = genomic DNA
agagagagggccaggcgtggtggctcaagcctgtaatcct

SEQ ID NO: 96432 - DNA, 141 bp, Homo sapiens
  misc_feature 1..141: note = chr7:134116486-134116627
  misc_feature 1..141: note = hypo
  source 1..141: mol_type = genomic DNA
ctcaaaaaataaataaataagaaaagaactgctgcacaagagtgaatgtttgaagcaagcaggagggaggcgaattgcccaaagatcaggaagaaaagaaagaggctgggatggtcatagatctgccgaggagcacaagaa

SEQ ID NO: 96433 - DNA, 622 bp, Homo sapiens
  misc_feature 1..622: note = chr7:134142965-134143587
  misc_feature 1..622: note = hyper
  source 1..622: mol_type = genomic DNA
attgtcattctcatccggctaggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 96434 - DNA, 271 bp, Homo sapiens; identical to SEQ ID NO: 31568
  misc_feature 1..271: note = chr7:134143700-134143971
  misc_feature 1..271: note = hyper
  source 1..271: mol_type = genomic DNA

SEQ ID NO: 96435 - DNA, 83 bp, Homo sapiens; identical to SEQ ID NO: 3121
  misc_feature 1..83: note = chr7:134143972-134144055
  misc_feature 1..83: note = hyper
  source 1..83: mol_type = genomic DNA

SEQ ID NO: 96436 - DNA, 76 bp, Homo sapiens; identical to SEQ ID NO: 3122
  misc_feature 1..76: note = chr7:134144056-134144132
  misc_feature 1..76: note = hyper
  source 1..76: mol_type = genomic DNA

SEQ ID NO: 96437 - DNA, 45 bp, Homo sapiens
  misc_feature 1..45: note = chr7:1347390-1347435
  misc_feature 1..45: note = hypo
  source 1..45: mol_type = genomic DNA
gacaagaggcaaccacgttgctgggggtgccgaagccaggccagc

SEQ ID NO: 96438 - DNA, 36 bp, Homo sapiens
  misc_feature 1..36: note = chr7:134864251-134864287
  misc_feature 1..36: note = hypo
  source 1..36: mol_type = genomic DNA
tttaccgaactgccccgagcacggggttatcagtac

SEQ ID NO: 96439 - DNA, 30 bp, Homo sapiens; identical to SEQ ID NO: 41464
  misc_feature 1..30: note = chr7:134880911-134880941
  misc_feature 1..30: note = hypo
  source 1..30: mol_type = genomic DNA

SEQ ID NO: 96440 - DNA, 104 bp, Homo sapiens; identical to SEQ ID NO: 41465
  misc_feature 1..104: note = chr7:134885144-134885248
  misc_feature 1..104: note = hypo
  source 1..104: mol_type = genomic DNA

SEQ ID NO: 96441 - DNA, 257 bp, Homo sapiens
  misc_feature 1..257: note = chr7:134918404-134918661
  misc_feature 1..257: note = hypo
  source 1..257: mol_type = genomic DNA
tcctcccttttctgtcgccttcggacaacttgtaacactgtttcttccactgcccacacgcccattggcccgtcaccacgcatccccattggctgtggcggccagggacagggccgcgattggtccccacccctgtaacgaggtgccaggtctgttttctgacccagacaggaaccgcgatccccactccggcgcacgaagccgggtgactgctgtcccgggagtggggacgtcgcgtgcaccgttggcgagtaagt

SEQ ID NO: 96442 - DNA, 30 bp, Homo sapiens; identical to SEQ ID NO: 41467
  misc_feature 1..30: note = chr7:134953117-134953147
  misc_feature 1..30: note = hypo
  source 1..30: mol_type = genomic DNA

SEQ ID NO: 96443 - DNA, 37 bp, Homo sapiens; identical to SEQ ID NO: 41468
  misc_feature 1..37: note = chr7:135125375-135125412
  misc_feature 1..37: note = hypo
  source 1..37: mol_type = genomic DNA

SEQ ID NO: 96444 - DNA, 123 bp, Homo sapiens
  misc_feature 1..123: note = chr7:1351483-1351606
  misc_feature 1..123: note = hypo
  source 1..123: mol_type = genomic DNA
cagggggctggcaggcgccggccgcggctgtctcctccagggcctgctgttgtggcgtctggccgcggcccagcaccgccgtcatctgggctcagctctctctgtccgcggggctgtctccct

SEQ ID NO: 96445 - DNA, 32 bp, Homo sapiens
  misc_feature 1..32: note = chr7:135196033-135196065
  misc_feature 1..32: note = hypo
  source 1..32: mol_type = genomic DNA
gcagttttaaatttacgaacttaatttcataa

SEQ ID NO: 96446 - DNA, 32 bp, Homo sapiens
  misc_feature 1..32: note = chr7:135196365-135196397
  misc_feature 1..32: note = hypo
  source 1..32: mol_type = genomic DNA
acgtgagccagggcacccggcctcattctttt

SEQ ID NO: 96447 - DNA, 38 bp, Homo sapiens
  misc_feature 1..38: note = chr7:135234576-135234614
  misc_feature 1..38: note = hypo
  source 1..38: mol_type = genomic DNA
atcttctttctctgccgggcacggtggctcatacctgt

SEQ ID NO: 96448 - DNA, 69 bp, Homo sapiens
  misc_feature 1..69: note = chr7:135391578-135391647
  misc_feature 1..69: note = hypo
  source 1..69: mol_type = genomic DNA
gtcacagaagtgtcccgtgtcactgtgtgcacttttccagctgacatcttaaagcgtcaacacttggag

SEQ ID NO: 96449 - DNA, 30 bp, Homo sapiens
  misc_feature 1..30: note = chr7:135393097-135393127
  misc_feature 1..30: note = hypo
  source 1..30: mol_type = genomic DNA
aatcaaagaggctggcgaaggggaggcagg

SEQ ID NO: 96450 - DNA, 135 bp, Homo sapiens; identical to SEQ ID NO: 15032
  misc_feature 1..135: note = chr7:135401363-135401498
  misc_feature 1..135: note = hypo
  source 1..135: mol_type = genomic DNA

SEQ ID NO: 96451 - DNA, 30 bp, Homo sapiens
  misc_feature 1..30: note = chr7:135412147-135412177
  misc_feature 1..30: note = hypo
  source 1..30: mol_type = genomic DNA
tgctggggtggaggacgggcagaggcagca

SEQ ID NO: 96452 - DNA, 41 bp, Homo sapiens
  misc_feature 1..41: note = chr7:135854543-135854584
  misc_feature 1..41: note = hypo
  source 1..41: mol_type = genomic DNA
agtttttttttttttcgagacggagtctggctctatcgccc

SEQ ID NO: 96453 - DNA, 17 bp, Homo sapiens
  misc_feature 1..17: note = chr7:135863468-135863485
  misc_feature 1..17: note = hypo
  source 1..17: mol_type = genomic DNA
tccgtctcaaaaaaaga

SEQ ID NO: 96454 - DNA, 105 bp, Homo sapiens
  misc_feature 1..105: note = chr7:135898002-135898107
  misc_feature 1..105: note = hypo
  source 1..105: mol_type = genomic DNA
ggggctgggcagaggcgctcctaacttcccagacagtgcggtggccgaggggtgaggtttaaatatgaattttaaagggacacagacattcgaagcatagcaaga

SEQ ID NO: 96455 - DNA, 23 bp, Homo sapiens
  misc_feature 1..23: note = chr7:135965324-135965347
  misc_feature 1..23: note = hypo
  source 1..23: mol_type = genomic DNA
accatgcccggcatgactgctct

SEQ ID NO: 96456 - DNA, 30 bp, Homo sapiens
  misc_feature 1..30: note = chr7:1360286-1360316
  misc_feature 1..30: note = hypo
  source 1..30: mol_type = genomic DNA
aagtcctgggtgtggcgtgcccgcctgcgt

SEQ ID NO: 96457 - DNA, 136 bp, Homo sapiens
  misc_feature 1..136: note = chr7:136327342-136327478
  misc_feature 1..136: note = hypo
  source 1..136: mol_type = genomic DNA
aaagagggaaactccatctcaaaaaaaaaaagaaagaaaaacaatattttctttaatgcttcaagatacaggtttacattaattgagtgaaagaacatatatatttatgtatcgatgatatcgatacataaatata

SEQ ID NO: 96458 - DNA, 62 bp, Homo sapiens
  misc_feature 1..62: note = chr7:1363565-1363627
  misc_feature 1..62: note = hypo
  source 1..62: mol_type = genomic DNA
tgccctggaccccaacggcggcatcctggggcggcaggtaccccgtccggtagcgcgaagcc

SEQ ID NO: 96459 - DNA, 144 bp, Homo sapiens; identical to SEQ ID NO: 41068
  misc_feature 1..144: note = chr7:1365367-1365511
  misc_feature 1..144: note = hypo
  source 1..144: mol_type = genomic DNA

SEQ ID NO: 96460 - DNA, 90 bp, Homo sapiens
  misc_feature 1..90: note = chr7:136553405-136553495
  misc_feature 1..90: note = hyper
  source 1..90: mol_type = genomic DNA
ctaatcgaacacacacgcacgaatacagacacgctctcctgctgtactaaaggcgccagggcgcaaagacctagggagcgcgcgcgggca

SEQ ID NO: 96461 - DNA, 471 bp, Homo sapiens
  misc_feature 1..471: note = chr7:136553555-136554026
  misc_feature 1..471: note = hyper
  source 1..471: mol_type = genomic DNA
ttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaac

SEQ ID NO: 96462 - DNA, 478 bp, Homo sapiens
  misc_feature 1..478: note = chr7:136554103-136554581
  misc_feature 1..478: note = hyper
  source 1..478: mol_type = genomic DNA
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtacccctacgattccgacggtcactgagtccagccgaatgtggcgaaagcagcctgggagctgcgctgtcccggcgtcgctccctattccagccccccattccctctactgttgctgacccccctcccgccacccactccagatgcagccatggacaagacaaggagagctt

SEQ ID NO: 96463 - DNA, 376 bp, Homo sapiens
  misc_feature 1..376: note = chr7:136554625-136555001
  misc_feature 1..376: note = hyper
  source 1..376: mol_type = genomic DNA
cgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcc

SEQ ID NO: 96464 - DNA, 764 bp, Homo sapiens
  misc_feature 1..764: note = chr7:136555078-136555842
  misc_feature 1..764: note = hyper
  source 1..764: mol_type = genomic DNA
cggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcc

SEQ ID NO: 96465 - DNA, 213 bp, Homo sapiens
  misc_feature 1..213: note = chr7:136556012-136556225
  misc_feature 1..213: note = hyper
  source 1..213: mol_type = genomic DNA
cgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgaga

SEQ ID NO: 96466 - DNA, 30 bp, Homo sapiens
  misc_feature 1..30: note = chr7:136849171-136849201
  misc_feature 1..30: note = hypo
  source 1..30: mol_type = genomic DNA
tggcccctgatgccccgaaaggctgtggca

SEQ ID NO: 96467 - DNA, 81 bp, Homo sapiens; identical to SEQ ID NO: 41069
  misc_feature 1..81: note = chr7:1368971-1369052
  misc_feature 1..81: note = hypo
  source 1..81: mol_type = genomic DNA

SEQ ID NO: 96468 - DNA, 30 bp, Homo sapiens
  misc_feature 1..30: note = chr7:1369753-1369783
  misc_feature 1..30: note = hypo
  source 1..30: mol_type = genomic DNA
gatcgtgagcccctacgattgtttgcagat

SEQ ID NO: 96469 - DNA, 79 bp, Homo sapiens
  misc_feature 1..79: note = chr7:137028481-137028560
  misc_feature 1..79: note = hyper
  source 1..79: mol_type = genomic DNA
gagggatgagaggagcgggccaggaggacgaaggctgggcgagggagggagagcgctttgcactcgagagctgattggg

SEQ ID NO: 96470 - DNA, 36 bp, Homo sapiens; identical to SEQ ID NO: 41476
  misc_feature 1..36: note = chr7:137092635-137092671
  misc_feature 1..36: note = hypo
  source 1..36: mol_type = genomic DNA

SEQ ID NO: 96471 - DNA, 17 bp, Homo sapiens
  misc_feature 1..17: note = chr7:137273241-137273258
  misc_feature 1..17: note = hypo
  source 1..17: mol_type = genomic DNA
agatggagtctcaatcg

SEQ ID NO: 96472 - DNA, 38 bp, Homo sapiens
  misc_feature 1..38: note = chr7:137285723-137285761
  misc_feature 1..38: note = hypo
  source 1..38: mol_type = genomic DNA
aatgcaagaaggggccgggcacggtggctcatgcctgt

SEQ ID NO: 96473 - DNA, 627 bp, Homo sapiens; identical to SEQ ID NO: 724
  misc_feature 1..627: note = chr7:137531262-137531889
  misc_feature 1..627: note = hyper
  source 1..627: mol_type = genomic DNA

SEQ ID NO: 96474 - DNA, 280 bp, Homo sapiens; identical to SEQ ID NO: 31578
  misc_feature 1..280: note = chr7:137531908-137532188
  misc_feature 1..280: note = hyper
  source 1..280: mol_type = genomic DNA

SEQ ID NO: 96475 - DNA, 68 bp, Homo sapiens; identical to SEQ ID NO: 31579
  misc_feature 1..68: note = chr7:137532373-137532441
  misc_feature 1..68: note = hyper
  source 1..68: mol_type = genomic DNA

SEQ ID NO: 96476 - DNA, 206 bp, Homo sapiens
  misc_feature 1..206: note = chr7:137637131-137637337
  misc_feature 1..206: note = hypo
  source 1..206: mol_type = genomic DNA
ctgagaggatatccccgcccagccctcaggctctcagcctttcaactcaaatgtcaccttagagaaacagtgtccatgacccctacggtagccacaggtcccattttgtcatcttcactgcatttgccagtctgtgaaattagcttactgatttatctgttccagtttttatgatctggcccctgctttcccgcctttgcactaga

SEQ ID NO: 96477 - DNA, 87 bp, Homo sapiens
  misc_feature 1..87: note = chr7:137664095-137664182
  misc_feature 1..87: note = hypo
  source 1..87: mol_type = genomic DNA
aaagcacagcaagggcgggtcatcaggccaagacatcaaaaagcacaggctgcaactggtcctaccagtccttagtttaatataaga

SEQ ID NO: 96478 - DNA, 18 bp, Homo sapiens
  misc_feature 1..18: note = chr7:137693378-137693396
  misc_feature 1..18: note = hypo
  source 1..18: mol_type = genomic DNA
acacggcctcggtgtgtt

SEQ ID NO: 96479 - DNA, 140 bp, Homo sapiens
  misc_feature 1..140: note = chr7:138042204-138042344
  misc_feature 1..140: note = hypo
  source 1..140: mol_type = genomic DNA
tgaaggtgggagatccgccagctctgtacaaacgcaggcattagaggctggccagagcaggcgggagggcgagaaacaccctactttgcatctcattcatgatatgggttttttttttctttgagacggagtctcgctct

SEQ ID NO: 96480 - DNA, 143 bp, Homo sapiens
  misc_feature 1..143: note = chr7:1384815-1384958
  misc_feature 1..143: note = hypo
  source 1..143: mol_type = genomic DNA
ttctggataggggcacggtggatgggcaggctgcgccgggctgatccgctgtgaacagcggttttggagatggtacgtcttgcagaggcatggcaggaaccagcgcctggaggtgcgaatggcccagtcggctcagggggaca

SEQ ID NO: 96481 - DNA, 30 bp, Homo sapiens
  misc_feature 1..30: note = chr7:138574167-138574197
  misc_feature 1..30: note = hypo
  source 1..30: mol_type = genomic DNA
tgattgatgaaacatcgagcagttaatata

SEQ ID NO: 96482 - DNA, 38 bp, Homo sapiens
  misc_feature 1..38: note = chr7:138794899-138794937
  misc_feature 1..38: note = hyper
  source 1..38: mol_type = genomic DNA
ttgcttacctagaatcgctaactcggtgccctgaacca

SEQ ID NO: 96483 - DNA, 15 bp, Homo sapiens
  misc_feature 1..15: note = chr7:138845476-138845491
  misc_feature 1..15: note = hypo
  source 1..15: mol_type = genomic DNA
cggcccaagtcactt

SEQ ID NO: 96484 - DNA, 74 bp, Homo sapiens
  misc_feature 1..74: note = chr7:138912533-138912607
  misc_feature 1..74: note = hypo
  source 1..74: mol_type = genomic DNA
tcctgtatttaccaacgattccaacttcttggtttagccacgttgctgtgaactacgtccgagctcagagagct

SEQ ID NO: 96485 - DNA, 157 bp, Homo sapiens
  misc_feature 1..157: note = chr7:138913166-138913323
  misc_feature 1..157: note = hypo
  source 1..157: mol_type = genomic DNA
tctcaaaaacaaaaagagatttcaagaattctgaatactggtttactggaaactctggttatttgtgtacagctttgtgagcaaggacttaacccagaattaataaataaccaaggaaatatcactggttattaaggagcttcgaaagactaccaaa

SEQ ID NO: 96486 - DNA, 82 bp, Homo sapiens
  misc_feature 1..82: note = chr7:138957148-138957230
  misc_feature 1..82: note = hypo
  source 1..82: mol_type = genomic DNA
gaggactgccaggctcgtagtcaagctaagtgtgccaagtatgtatctcttctatttggactggcttttgcatttgagaagt

SEQ ID NO: 96487 - DNA, 82 bp, Homo sapiens
  misc_feature 1..82: note = chr7:139027220-139027302
  misc_feature 1..82: note = hypo
  source 1..82: mol_type = genomic DNA
gatgaagtggtaggccgaacaggaacttaaactttattgtaagtgtaatgggaagccattctaagattgtgatcacctccca

SEQ ID NO: 96488 - DNA, 30 bp, Homo sapiens
  misc_feature 1..30: note = chr7:139106981-139107011
  misc_feature 1..30: note = hypo
  source 1..30: mol_type = genomic DNA
cctcgtgacagagatcggaaagataagaag

SEQ ID NO: 96489 - DNA, 30 bp, Homo sapiens; identical to SEQ ID NO: 41485
  misc_feature 1..30: note = chr7:139112625-139112655
  misc_feature 1..30: note = hypo
  source 1..30: mol_type = genomic DNA

SEQ ID NO: 96490 - DNA, 86 bp, Homo sapiens
  misc_feature 1..86: note = chr7:139115423-139115509
  misc_feature 1..86: note = hypo
  source 1..86: mol_type = genomic DNA
ctgtattcataagagcggaaatatccatcaattagaaagcagataaacaggccaggtgtggtggctcacccctctaatcccagcac

SEQ ID NO: 96491 - DNA, 30 bp, Homo sapiens
  misc_feature 1..30: note = chr7:139123790-139123820
  misc_feature 1..30: note = hypo
  source 1..30: mol_type = genomic DNA
taatccccaggaatccgggagaaatgaaaa

SEQ ID NO: 96492 - DNA, 296 bp, Homo sapiens
  misc_feature 1..296: note = chr7:139167531-139167827
  misc_feature 1..296: note = hyper
  source 1..296: mol_type = genomic DNA
cggtcagctgcccagcggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccag

SEQ ID NO: 96493 - DNA, 500 bp, Homo sapiens; identical to SEQ ID NO: 31581
  misc_feature 1..500: note = chr7:139168114-139168614
  misc_feature 1..500: note = hyper
  source 1..500: mol_type = genomic DNA

SEQ ID NO: 96494 - DNA, 67 bp, Homo sapiens
  misc_feature 1..67: note = chr7:139168658-139168725
  misc_feature 1..67: note = hyper
  source 1..67: mol_type = genomic DNA
cgggagaaaagcagaacaccagcggaggcttgtggcagggaacccggagccccgcctgacccttccc

SEQ ID NO: 96495 - DNA, 38 bp, Homo sapiens
  misc_feature 1..38: note = chr7:139207995-139208033
  misc_feature 1..38: note = hyper
  source 1..38: mol_type = genomic DNA
taattgaatctgcaacgtcacttcgcttgctcctttag

SEQ ID NO: 96496 - DNA, 325 bp, Homo sapiens; identical to SEQ ID NO: 31583
  misc_feature 1..325: note = chr7:139208245-139208570
  misc_feature 1..325: note = hyper
  source 1..325: mol_type = genomic DNA

SEQ ID NO: 96497 - DNA, 196 bp, Homo sapiens; identical to SEQ ID NO: 31584
  misc_feature 1..196: note = chr7:139208614-139208810
  misc_feature 1..196: note = hyper
  source 1..196: mol_type = genomic DNA

SEQ ID NO: 96498 - DNA, 30 bp, Homo sapiens; identical to SEQ ID NO: 41486
  misc_feature 1..30: note = chr7:139245499-139245529
  misc_feature 1..30: note = hypo
  source 1..30: mol_type = genomic DNA

SEQ ID NO: 96499 - DNA, 30 bp, Homo sapiens
  misc_feature 1..30: note = chr7:139546165-139546195
  misc_feature 1..30: note = hypo
  source 1..30: mol_type = genomic DNA
tagatgtcaggtctccgtgtctcagtttcc

SEQ ID NO: 96500 - DNA, 205 bp, Homo sapiens
  misc_feature 1..205: note = chr7:1395730-1395935
  misc_feature 1..205: note = hypo
  source 1..205: mol_type = genomic DNA
ctccttgctgcctcccgccttgtcctcaacagccctgaagtccgtcctccactcagcttctcaggtggttctcaaaggttaacacaaccatgtccctcctgctccaaaccctccatggctcctgagtgcccctggaatagagcccaggctcctccgggatctgcaggtgccgcctgcctctgccattctccgtcagcccacgtca

SEQ ID NO: 96501 - DNA, 159 bp, Homo sapiens
  misc_feature 1..159: note = chr7:139650627-139650786
  misc_feature 1..159: note = hypo
  source 1..159: mol_type = genomic DNA
ctcgccctccatctacgggaccccctcgccctccatctacgggaccccctcgccctccatctacaggacccactccttcagcagaggagttgggcccctggtaacacaattctttccttacacccagagcacgtaggactgactcggaggaaactgcag

SEQ ID NO: 96502 - DNA, 30 bp, Homo sapiens
  misc_feature 1..30: note = chr7:139779255-139779285
  misc_feature 1..30: note = hypo
  source 1..30: mol_type = genomic DNA
cacgtgaggatgagccggcaggcctttgag

SEQ ID NO: 96503 - DNA, 30 bp, Homo sapiens
  misc_feature 1..30: note = chr7:1397930-1397960
  misc_feature 1..30: note = hypo
  source 1..30: mol_type = genomic DNA
tgctgtgaccccatacggagcatctcccca

SEQ ID NO: 96504 - DNA, 96 bp, Homo sapiens
  misc_feature 1..96: note = chr7:139842977-139843073
  misc_feature 1..96: note = hypo
  source 1..96: mol_type = genomic DNA
tcaaaaaaaaaaaaaaaaaagacataaaagagtacatatgatatattctatgtatgcagaaaattcaaaactagggaaagccgaagtatactgttt

SEQ ID NO: 96505 - DNA, 30 bp, Homo sapiens; identical to SEQ ID NO: 41488
  misc_feature 1..30: note = chr7:139919897-139919927
  misc_feature 1..30: note = hypo
  source 1..30: mol_type = genomic DNA

SEQ ID NO: 96506 - DNA, 195 bp, Homo sapiens
  misc_feature 1..195: note = chr7:139930151-139930346
  misc_feature 1..195: note = hyper
  source 1..195: mol_type = genomic DNA
agggatagagacaggcggagaccgctggggagtttcccggtgctcagccatcgcataggggggaacggacccttttgtgggccctcgggtccccccgtggtccccgctggcgcgctcgtcctctgccacccccagatctctgcgcactccccactcctgggcgttcgcactgccccccggcgcactctcgccgcc

SEQ ID NO: 96507 - DNA, 213 bp, Homo sapiens
  misc_feature 1..213: note = chr7:139938997-139939210
  misc_feature 1..213: note = hypo
  source 1..213: mol_type = genomic DNA
attgggtctaggtcacgcaggtagtaagcagagctgggctttgatgctgtggccgactctgcagcctctgcccaggttcttctttgggatacaactgctgacagctcaccgccagtctgttcccaggaatagccctgcctgaagggggctgcctggcccaagggtggctccttccttgcggggcagcctgaattcaaccgaaccatgtagggg

SEQ ID NO: 96508 - DNA, 68 bp, Homo sapiens; identical to SEQ ID NO: 41490
  misc_feature 1..68: note = chr7:140007275-140007343
  misc_feature 1..68: note = hypo
  source 1..68: mol_type = genomic DNA

SEQ ID NO: 96509 - DNA, 232 bp, Homo sapiens
  misc_feature 1..232: note = chr7:140015548-140015780
  misc_feature 1..232: note = hypo
  source 1..232: mol_type = genomic DNA
acgggggcacctggccgaaaaattatccccagaggcaaacatttaacagctgtgatgtcttaaataaatatcattcttgctgagcaagggaagaaagaaaagaataaacagaaaagagtgggagaaagaaagagaacagaatgcagattagatttaagaggggcagatacgatgatgaggggtggtgtctagatcagtgcaggagcactgagtagctcgctggggctaagcg

SEQ ID NO: 96510 - DNA, 21 bp, Homo sapiens
  misc_feature 1..21: note = chr7:140026923-140026944
  misc_feature 1..21: note = hypo
  source 1..21: mol_type = genomic DNA
acggagcgagattctgtctca

SEQ ID NO: 96511 - DNA, 31 bp, Homo sapiens; identical to SEQ ID NO: 41492
  misc_feature 1..31: note = chr7:140096707-140096738
  misc_feature 1..31: note = hypo
  source 1..31: mol_type = genomic DNA

SEQ ID NO: 96512 - DNA, 30 bp, Homo sapiens; identical to SEQ ID NO: 41493
  misc_feature 1..30: note = chr7:140097278-140097308
  misc_feature 1..30: note = hypo
  source 1..30: mol_type = genomic DNA

SEQ ID NO: 96513 - DNA, 154 bp, Homo sapiens
  misc_feature 1..154: note = chr7:140156524-140156678
  misc_feature 1..154: note = hypo
  source 1..154: mol_type = genomic DNA
agttggagaggatcccgaagcggcgctcactggggttggctttctcatagaccacctccatgcagatcccacacaccatgtccttgctgcgctgcacggcaaatgagagctccatgtccttctcatgggcctcaatgcacgactagagaaggtg

SEQ ID NO: 96514 - DNA, 19 bp, Homo sapiens
  misc_feature 1..19: note = chr7:140176253-140176272
  misc_feature 1..19: note = hypo
  source 1..19: mol_type = genomic DNA
agagcgacactccatctca

SEQ ID NO: 96515 - DNA, 120 bp, Homo sapiens
  misc_feature 1..120: note = chr7:140180178-140180298
  misc_feature 1..120: note = hypo
  source 1..120: mol_type = genomic DNA
ccgtctcaaaataataataatagtaatagataatagtacctacttcagagatggctgtgaaagttaaatgagaatctgtttaaaaacctttgtactggccgggcgcggtggctcacgcct

SEQ ID NO: 96516 - DNA, 76 bp, Homo sapiens
  misc_feature 1..76: note = chr7:140192162-140192238
  misc_feature 1..76: note = hypo
  source 1..76: mol_type = genomic DNA
ccactggtgccactgcgagcccagcgggggcagagcgagattacagccccaggggacagagcgagactccatctga

SEQ ID NO: 96517 - DNA, 153 bp, Homo sapiens
  misc_feature 1..153: note = chr7:140227048-140227201
  misc_feature 1..153: note = hypo
  source 1..153: mol_type = genomic DNA
gcagagccagcgccccgctctgttctccgcaccctgcagggagggggacagggctgagtgggagctcacctcttccagcggcagctccctgagcagtggcagcgagctggagagcagcccgatgaggaagggcgtcggcgagcacacgatgtc

SEQ ID NO: 96518 - DNA, 36 bp, Homo sapiens
  misc_feature 1..36: note = chr7:140268315-140268351
  misc_feature 1..36: note = hypo
  source 1..36: mol_type = genomic DNA
catgggagcaggggtcgctgccgttactgcagccac

SEQ ID NO: 96519 - DNA, 30 bp, Homo sapiens
  misc_feature 1..30: note = chr7:14029041-14029071
  misc_feature 1..30: note = hyper
  source 1..30: mol_type = genomic DNA
caaaactagcaatggcgatcaacgagactt

SEQ ID NO: 96520 - DNA, 62 bp, Homo sapiens
  misc_feature 1..62: note = chr7:14029493-14029555
  misc_feature 1..62: note = hyper
  source 1..62: mol_type = genomic DNA
tcctcagcctggaagcgccacggagagactcgatttcctctgtaacccgctgcttattgtta

SEQ ID NO: 96521 - DNA, 384 bp, Homo sapiens
  misc_feature 1..384: note = chr7:14029885-14030269
  misc_feature 1..384: note = hyper
  source 1..384: mol_type = genomic DNA
aaaattagatcctatcgttcgtgggacagaaacataaagaatctataaggaaggcacctaggagatgcagaattgctgattagcagaggttgtgatgggaggacaacagagcaagctaggtgaaaaagtataagtcaaaatggtccctacgtgtgcactgggaaaaggtacttccagtccactgtggctgtggggaggaggagggagtgcttggggttgctcgtatatcctagaacccgcacgtttcctgagcttttgttatgtatacacggaggcggagggtgtcacttactgtacttgacgctttcacttcctctccagcttttaaacagccagagcccagggttgggggcgagcggtgagatggctcgggtttcaaggaca

SEQ ID NO: 96522 - DNA, 43 bp, Homo sapiens; identical to SEQ ID NO: 31586
  misc_feature 1..43: note = chr7:140339825-140339868
  misc_feature 1..43: note = hyper
  source 1..43: mol_type = genomic DNA

SEQ ID NO: 96523 - DNA, 260 bp, Homo sapiens
  misc_feature 1..260: note = chr7:140339965-140340225
  misc_feature 1..260: note = hyper
  source 1..260: mol_type = genomic DNA
cgcgcgcgcgcggacacacacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactcccgtctgcagagccgcttcccccgtcagggctcaggccgcgcgagccgtttcctcc

SEQ ID NO: 96524 - DNA, 454 bp, Homo sapiens
  misc_feature 1..454: note = chr7:140340551-140341005
  misc_feature 1..454: note = hyper
  source 1..454: mol_type = genomic DNA
ggcccagcgcaggctcgcccgcggcccctgcctcctcctgccgtggctccgcgacgatctgcgcgacgcgcgccccctcctcccgacccatcccgcccggcccagtgagctaatccgcagctggcgggcgcccggccggttgccacggcaacccctctcccagggcccggccccgcgcggagctgcggtaaacaggaccttctgccggactcgccccctcgcctctcggggtgggggagaggtggcttaacccttcctgggaggacgcccgccgcgcgcgggctccattccacccaggcccgggcggattcgcgaggtgcttccggcctgaggcttagacctggacgtccaagcctggggaacggcggccgcgtgcccggccccgcttactctaggcagttaacacactctcggcaccgggccggggccgggggcacctcgggcagtgagtcag

SEQ ID NO: 96525 - DNA, 23 bp, Homo sapiens
  misc_feature 1..23: note = chr7:140732424-140732447
  misc_feature 1..23: note = hypo
  source 1..23: mol_type = genomic DNA
gaataggaagagctccggtctac

SEQ ID NO: 96526 - DNA, 226 bp, Homo sapiens
  misc_feature 1..226: note = chr7:140771324-140771550
  misc_feature 1..226: note = hyper
  source 1..226: mol_type = genomic DNA
aatatggtggaggtgcgctcattttggctcacaagccccgttgtgcaaagcagggtgtcagagactctctttttccccagggcaactctttacccggcaatgccggacctcgactttggggtgagggtgaaaacgaggggtgagcattagagtgaaaaacccagcgtttgatgccgggagggagggtcccagcctttgcggcgccgtctcacgtgagcagagcagg

SEQ ID NO: 96527 - DNA, 72 bp, Homo sapiens; identical to SEQ ID NO: 31590
  misc_feature 1..72: note = chr7:140771769-140771841
  misc_feature 1..72: note = hyper
  source 1..72: mol_type = genomic DNA

SEQ ID NO: 96528 - DNA, 395 bp, Homo sapiens
  misc_feature 1..395: note = chr7:140772281-140772676
  misc_feature 1..395: note = hyper
  source 1..395: mol_type = genomic DNA
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagaggaggaggcgacgaggggaagccgagtgacccagcctccctcccccaccctctccccattcatctcggcgaccaccgcgcgccgggagc

SEQ ID NO: 96529 - DNA, 1703 bp, Homo sapiens
  misc_feature 1..1703: note = chr7:140772716-140774419
  misc_feature 1..1703: note = hyper
  source 1..1703: mol_type = genomic DNA
cgctgtcgagtgagccggcatctcggcgcccgggtgggctgcgaagaaaatggtgcaatctgagagcgactgagcccagctgggcagagcagacggggtgccagagtgccaagggctcaggtgcctggagaaaggggcggattgtttggaggggccgggaccggggttttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactcc

SEQ ID NO: 96530 - DNA, 292 bp, Homo sapiens
  misc_feature 1..292: note = chr7:1408479-1408771
  misc_feature 1..292: note = hyper
  source 1..292: mol_type = genomic DNA
ctgaaccccgggctgcgctctccccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 96531 - DNA, 201 bp, Homo sapiens; identical to SEQ ID NO: 31000
  misc_feature 1..201: note = chr7:1408874-1409075
  misc_feature 1..201: note = hyper
  source 1..201: mol_type = genomic DNA

SEQ ID NO: 96532 - DNA, 36 bp, Homo sapiens
  misc_feature 1..36: note = chr7:140992705-140992741
  misc_feature 1..36: note = hypo
  source 1..36: mol_type = genomic DNA
gggcttacaagtgtgagccaccgcacccggccagat

SEQ ID NO: 96533 - DNA, 187 bp, Homo sapiens
  misc_feature 1..187: note = chr7:141007214-141007401
  misc_feature 1..187: note = hypo
  source 1..187: mol_type = genomic DNA
aggggatcctggcagcggctgccactcacttgctgggtcccctacatgctttcctcctcagtagggctcctttctgggagcccccacccttaggccaacaggaggctcccatcagactctgccggagcacatatataccagaatccggcatttcagaggcactgaggggtcacgggacctctgaact

SEQ ID NO: 96534 - DNA, 30 bp, Homo sapiens
  misc_feature 1..30: note = chr7:141137501-141137531
  misc_feature 1..30: note = hypo
  source 1..30: mol_type = genomic DNA
aggccttatgcagtacgtggcagggctgct

SEQ ID NO: 96535 - DNA, 236 bp, Homo sapiens
  misc_feature 1..236: note = chr7:141211363-141211599
  misc_feature 1..236: note = hyper
  source 1..236: mol_type = genomic DNA
ctgctactagccagccggctggaaaatgtggccaagaaaaccgcagagaccaatgttcggaggagaaaaccagaaagaggggcctgcctggcccctttgatcctttatggccgattccgtggacattgctgctcctcacgccggcagccctctcttgagtacctcaattgcagtctccagaccctccaccccgccaggcattcctgggtcggtgtcccagtcggtcacagtcatcg

SEQ ID NO: 96536 - DNA, 29 bp, Homo sapiens
  misc_feature 1..29: note = chr7:141534669-141534698
  misc_feature 1..29: note = hypo
  source 1..29: mol_type = genomic DNA
caggcgtaagccaccgtgcccggcctcgt

SEQ ID NO: 96537 - DNA, 24 bp, Homo sapiens
  misc_feature 1..24: note = chr7:141557650-141557674
  misc_feature 1..24: note = hypo
  source 1..24: mol_type = genomic DNA
gtgagccaccgtgcccagctgcta

SEQ ID NO: 96538 - DNA, 210 bp, Homo sapiens
  misc_feature 1..210: note = chr7:1416015-1416225
  misc_feature 1..210: note = hypo
  source 1..210: mol_type = genomic DNA
gcaaagtggtgggttcgggacgttcaccgcagtgttgtttgtaacagccaaaggctggaaatcagctggcagcccatcagaggacttgggtaagtaaatggcggccatccaccagcagggcatcgtgcaggcactaaactcaatgctacaggagaattcctcgtggcacaggaaaggtctcatcgtataccgttgcgggaaaagggcagg

SEQ ID NO: 96539 - DNA, 264 bp, Homo sapiens
  misc_feature 1..264: note = chr7:1423398-1423662
  misc_feature 1..264: note = hypo
  source 1..264: mol_type = genomic DNA
tacctcggggagccccgcagagaaggatccttagccccactccatccttctctgccgctgttccgccccctgccccagcaggaacagtctctacccctcgtctgcctcagcatggacagccccaaaaggcccccgctccatccctttctcagcagggttggcctgcaacagaccagacatccagcctgccgaggaggggcagggggtcttgctgccttccccccgcccagtccctgctgcctccacggccggacccccagcttc

SEQ ID NO: 96540 - DNA, 306 bp, Homo sapiens
  misc_feature 1..306: note = chr7:143042619-143042925
  misc_feature 1..306: note = hyper
  source 1..306: mol_type = genomic DNA
tgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgaggtgaccgcgccgggaagggctagggagtgggatagatcaggagcaaagggaaaagcgtcgtctgggctgg

SEQ ID NO: 96541 - DNA, 84 bp, Homo sapiens
  misc_feature 1..84: note = chr7:143060085-143060169
  misc_feature 1..84: note = hyper
  source 1..84: mol_type = genomic DNA
ttgggtttcaggagccgaggcacgaacccagggcctaccccgaggttctggttgatggattttgcgggccggggtcaggggatg

SEQ ID NO: 96542 - DNA, 42 bp, Homo sapiens
  misc_feature 1..42: note = chr7:143579623-143579665
  misc_feature 1..42: note = hyper
  source 1..42: mol_type = genomic DNA
tcaccagcagaaatacggacacaaaggggattctctgtcccc

SEQ ID NO: 96543 - DNA, 285 bp, Homo sapiens; identical to SEQ ID NO: 31596
  misc_feature 1..285: note = chr7:143579666-143579951
  misc_feature 1..285: note = hyper
  source 1..285: mol_type = genomic DNA

SEQ ID NO: 96544 - DNA, 143 bp, Homo sapiens; identical to SEQ ID NO: 9262
  misc_feature 1..143: note = chr7:143579952-143580095
  misc_feature 1..143: note = hyper
  source 1..143: mol_type = genomic DNA

SEQ ID NO: 96545 - DNA, 30 bp, Homo sapiens
  misc_feature 1..30: note = chr7:143737774-143737804
  misc_feature 1..30: note = hypo
  source 1..30: mol_type = genomic DNA
aattggttgggaggccgaggcgggtggatc

SEQ ID NO: 96546 - DNA, 30 bp, Homo sapiens
  misc_feature 1..30: note = chr7:144185679-144185709
  misc_feature 1..30: note = hypo
  source 1..30: mol_type = genomic DNA
acacacacacgtgcacgtggaggcacacac

SEQ ID NO: 96547 - DNA, 144 bp, Homo sapiens; identical to SEQ ID NO: 31001
  misc_feature 1..144: note = chr7:1443541-1443685
  misc_feature 1..144: note = hyper
  source 1..144: mol_type = genomic DNA

SEQ ID NO: 96548 - DNA, 41 bp, Homo sapiens
  misc_feature 1..41: note = chr7:1443733-1443774
  misc_feature 1..41: note = hyper
  source 1..41: mol_type = genomic DNA
cggctggtctctttccctcccctctccgtgttcccaggcag

SEQ ID NO: 96549 - DNA, 30 bp, Homo sapiens; identical to SEQ ID NO: 41496
  misc_feature 1..30: note = chr7:144488206-144488236
  misc_feature 1..30: note = hypo
  source 1..30: mol_type = genomic DNA

SEQ ID NO: 96550 - DNA, 30 bp, Homo sapiens
  misc_feature 1..30: note = chr7:144565945-144565975
  misc_feature 1..30: note = hypo
  source 1..30: mol_type = genomic DNA
gtgagccaccgcgcccggccatgataattt

SEQ ID NO: 96551 - DNA, 132 bp, Homo sapiens
  misc_feature 1..132: note = chr7:1451244-1451376
  misc_feature 1..132: note = hypo
  source 1..132: mol_type = genomic DNA
tcttttctgctggggcgcccggcgggccctgcctgtggttcgccctgtgtgcgggcggtgtgggcgtctttgccgcagggtgcttgtcgtggcaagggttctttgtgtgtacttctgcgttgacatgcatca

SEQ ID NO: 96552 - DNA, 104 bp, Homo sapiens
  misc_feature 1..104: note = chr7:1452435-1452539
  misc_feature 1..104: note = hyper
  source 1..104: mol_type = genomic DNA
gcgcgcgcgggtgcacgtgcgtaatggatgcacacgcatgcagctggtgtgcgtgcagtcgggcgcacctgtaaccggtgcgcaccccgcgtctggcgtgcaag

SEQ ID NO: 96553 - DNA, 30 bp, Homo sapiens; identical to SEQ ID NO: 41075
  misc_feature 1..30: note = chr7:1453817-1453847
  misc_feature 1..30: note = hypo
  source 1..30: mol_type = genomic DNA

SEQ ID NO: 96554 - DNA, 306 bp, Homo sapiens
  misc_feature 1..306: note = chr7:145812702-145813008
  misc_feature 1..306: note = hyper
  source 1..306: mol_type = genomic DNA
gcatatgtatgagtacgaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacac

SEQ ID NO: 96555 - DNA, 382 bp, Homo sapiens; identical to SEQ ID NO: 31599
  misc_feature 1..382: note = chr7:145813009-145813391
  misc_feature 1..382: note = hyper
  source 1..382: mol_type = genomic DNA

SEQ ID NO: 96556 - DNA, 318 bp, Homo sapiens
  misc_feature 1..318: note = chr7:145813403-145813721
  misc_feature 1..318: note = hyper
  source 1..318: mol_type = genomic DNA
cgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccgg

SEQ ID NO: 96557 - DNA, 254 bp, Homo sapiens
  misc_feature 1..254: note = chr7:145813945-145814199
  misc_feature 1..254: note = hyper
  source 1..254: mol_type = genomic DNA
cgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacactt

SEQ ID NO: 96558 - DNA, 154 bp, Homo sapiens
  misc_feature 1..154: note = chr7:1458926-1459080
  misc_feature 1..154: note = hypo
  source 1..154: mol_type = genomic DNA
aggcactcagtgttccgggccctgttacccctccagctcccataaccccgtctcctcctcctcctcgccctcctcctcctcgctgtctctgcaccacttccacctgcccgggcctttgcacctgcaggttcgtaccctacggggtgtgccctgc

SEQ ID NO: 96559 - DNA, 185 bp, Homo sapiens
  misc_feature 1..185: note = chr7:1460773-1460958
  misc_feature 1..185: note = hypo
  source 1..185: mol_type = genomic DNA
gagcgtgtcatttcccgcatgtgacacagagtgcggactgtgcagaaggcggctctgtgcctcggaaggcagggtgcagaggcgtgcagcgctcaccacggggatgcggccggctcctgggacgggacctggaacgcggatgtggccggatgtttagtgggtgccgtgcacggtgtctgacacat

SEQ ID NO: 96560 - DNA, 22 bp, Homo sapiens
  misc_feature 1..22: note = chr7:146300226-146300248
  misc_feature 1..22: note = hypo
  source 1..22: mol_type = genomic DNA
gggcgaggtggctcacgcctgt

SEQ ID NO: 96561 - DNA, 23 bp, Homo sapiens
  misc_feature 1..23: note = chr7:146757526-146757549
  misc_feature 1..23: note = hypo
  source 1..23: mol_type = genomic DNA
tgtgcaggctgggcacgatggct

SEQ ID NO: 96562 - DNA, 18 bp, Homo sapiens
  misc_feature 1..18: note = chr7:146758938-146758956
  misc_feature 1..18: note = hypo
  source 1..18: mol_type = genomic DNA
ttctttggccgggcacgg

SEQ ID NO: 96563 - DNA, 18 bp, Homo sapiens
  misc_feature 1..18: note = chr7:147750129-147750147
  misc_feature 1..18: note = hypo
  source 1..18: mol_type = genomic DNA
ctccgtctcaaaaaaaca

SEQ ID NO: 96564 - DNA, 19 bp, Homo sapiens
  misc_feature 1..19: note = chr7:147816617-147816636
  misc_feature 1..19: note = hypo
  source 1..19: mol_type = genomic DNA
actccgtctcagaaaaaaa

SEQ ID NO: 96565 - DNA, 58 bp, Homo sapiens
  misc_feature 1..58: note = chr7:147939618-147939676
  misc_feature 1..58: note = hyper
  source 1..58: mol_type = genomic DNA
gttttctataaacaccgaccaaaaccagagtcctaggttatagcgcgggttacttgca

SEQ ID NO: 96566 - DNA, 27 bp, Homo sapiens
  misc_feature 1..27: note = chr7:147991189-147991216
  misc_feature 1..27: note = hypo
  source 1..27: mol_type = genomic DNA
ggaaaaagcaggcggtgtttcctattc

SEQ ID NO: 96567 - DNA, 95 bp, Homo sapiens
  misc_feature 1..95: note = chr7:148224591-148224686
  misc_feature 1..95: note = hypo
  source 1..95: mol_type = genomic DNA
tgagccaccgcgcccagccgacagcaatcttttattgaaccagagctgctctttgtggatgaggtctaactcctatacagcgtgctcagagtagc

SEQ ID NO: 96568 - DNA, 30 bp, Homo sapiens; identical to SEQ ID NO: 41499
  misc_feature 1..30: note = chr7:148500594-148500624
  misc_feature 1..30: note = hypo
  source 1..30: mol_type = genomic DNA

SEQ ID NO: 96569 - DNA, 20 bp, Homo sapiens
  misc_feature 1..20: note = chr7:148582580-148582600
  misc_feature 1..20: note = hypo
  source 1..20: mol_type = genomic DNA
aggatatttgcaaggcgcgg

SEQ ID NO: 96570 - DNA, 95 bp, Homo sapiens; identical to SEQ ID NO: 5071
  misc_feature 1..95: note = chr7:148640241-148640336
  misc_feature 1..95: note = hypo
  source 1..95: mol_type = genomic DNA

SEQ ID NO: 96571 - DNA, 24 bp, Homo sapiens
  misc_feature 1..24: note = chr7:148819014-148819038
  misc_feature 1..24: note = hypo
  source 1..24: mol_type = genomic DNA
tgtttttttttgagacggagtctc

SEQ ID NO: 96572 - DNA, 213 bp, Homo sapiens
  misc_feature 1..213: note = chr7:148841978-148842191
  misc_feature 1..213: note = hypo
  source 1..213: mol_type = genomic DNA
cttctcggctactacattttaaataataaaattatacaacagaattttctttccaagaaaattcagattattatttttttgtaatctactcatattgtgagtcagagaatggcaattttcattattaagcattcaccatctgacaaatatgtatattcaggtaaatcccaaattacggactgcatatgtagccacaggcgaaaagtaacttag

SEQ ID NO: 96573 - DNA, 149 bp, Homo sapiens; identical to SEQ ID NO: 41502
  misc_feature 1..149: note = chr7:148846075-148846224
  misc_feature 1..149: note = hypo
  source 1..149: mol_type = genomic DNA

SEQ ID NO: 96574 - DNA, 40 bp, Homo sapiens
  misc_feature 1..40: note = chr7:148883977-148884017
  misc_feature 1..40: note = hypo
  source 1..40: mol_type = genomic DNA
gattacaggagtgagccaccgcgcccggcccgcgtaaagc

SEQ ID NO: 96575 - DNA, 37 bp, Homo sapiens
  misc_feature 1..37: note = chr7:148959621-148959658
  misc_feature 1..37: note = hyper
  source 1..37: mol_type = genomic DNA
cccaaatgccaggcccggcgggcggggccccgacgtc

SEQ ID NO: 96576 - DNA, 110 bp, Homo sapiens
  misc_feature 1..110: note = chr7:149110-149220
  misc_feature 1..110: note = hyper
  source 1..110: mol_type = genomic DNA
gtgggcagggctgcccgagagacccaggcggccattgcccgccctgcgtctgcgcctgcgccggagcctcctccacactgcgccagcgccgagtccggccgcctcctcat

SEQ ID NO: 96577 - DNA, 320 bp, Homo sapiens
  misc_feature 1..320: note = chr7:149111906-149112226
  misc_feature 1..320: note = hyper
  source 1..320: mol_type = genomic DNA
ctttccaggagcagccgctggagatcctgcctctccaagagaacctggctaacccccacacttaggtcagaagaaatgtgtgatgggaaaccagccctctctgggagtgtgaaggtaaagacggtcctatatttcagttccagtggggctgcagggtcttttgctatcggtgtgctatgtatgcaggtcttgctagagactgagaacctctaaaagtcattgcgcagagggaacgcggatttacccggcatggtctttggaaatcagtgtgctgtggaagcaggtcttgctagagccaagaaacctctaaaagccactat

SEQ ID NO: 96578 - skipped

SEQ ID NO: 96579 - DNA, 38 bp, Homo sapiens
  misc_feature 1..38: note = chr7:149118656-149118694
  misc_feature 1..38: note = hypo
  source 1..38: mol_type = genomic DNA
aaaaaaagtgcaggccgggcgctgtggctcacgcctgt

SEQ ID NO: 96580 - DNA, 184 bp, Homo sapiens
  misc_feature 1..184: note = chr7:149119889-149120073
  misc_feature 1..184: note = hyper
  source 1..184: mol_type = genomic DNA
cagcaccagtgagaccgacacggttgtgccccatcccacaggcgccaaatggagggcgcagggttttaggagctcgcgtagggcctctcgggcggcagcaatggagccgcgaggccggcggggagaccgaggacgggacccgctgagctctgggtgagctggggggactcgaggggacctggat

SEQ ID NO: 96581 - DNA, 172 bp, Homo sapiens
  misc_feature 1..172: note = chr7:149159300-149159472
  misc_feature 1..172: note = hypo
  source 1..172: mol_type = genomic DNA
ataaactacagtttacgttccattccccctagaggaatgagaacaaacctgctgccagcgacatctgcatgcatgtctcattgtgcactgctaaagtgcgtctctagagacgcctagacatgggactctggatggcaagagcaccttcatctttccccggcttcccgaactg

SEQ ID NO: 96582 - DNA, 30 bp, Homo sapiens
  misc_feature 1..30: note = chr7:149184025-149184055
  misc_feature 1..30: note = hypo
  source 1..30: mol_type = genomic DNA
ggggtccccatgccccggggaacctggact

SEQ ID NO: 96583 - DNA, 32 bp, Homo sapiens
  misc_feature 1..32: note = chr7:149389639-149389671
  misc_feature 1..32: note = hyper
  source 1..32: mol_type = genomic DNA
tgcacaccacctaggcgcgtgtattagagcgg

SEQ ID NO: 96584 - DNA, 21 bp, Homo sapiens
  misc_feature 1..21: note = chr7:149389934-149389955
  misc_feature 1..21: note = hyper
  source 1..21: mol_type = genomic DNA
cgcctccgcaccctggggagc

SEQ ID NO: 96585 - DNA, 389 bp, Homo sapiens
  misc_feature 1..389: note = chr7:149411339-149411728
  misc_feature 1..389: note = hyper
  source 1..389: mol_type = genomic DNA
cagaggagagtgggccgcgcttccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 96586 - DNA, 575 bp, Homo sapiens; identical to SEQ ID NO: 31605
  misc_feature 1..575: note = chr7:149411834-149412409
  misc_feature 1..575: note = hyper
  source 1..575: mol_type = genomic DNA

SEQ ID NO: 96587 - DNA, 143 bp, Homo sapiens
  misc_feature 1..143: note = chr7:149427347-149427490
  misc_feature 1..143: note = hypo
  source 1..143: mol_type = genomic DNA
gccccggctccagctcgagcttcagcggctctgaaggagaagacccgaggccagagcctgatctctggaagccgctcccccagggtgagcctgtgcggagagggaggatagcgggatgtgtgccagggcgccagtcaccactc

SEQ ID NO: 96588 - DNA, 30 bp, Homo sapiens
  misc_feature 1..30: note = chr7:149480372-149480402
  misc_feature 1..30: note = hypo
  source 1..30: mol_type = genomic DNA
acgccttcgcagaggcggcctgtgccatcc

SEQ ID NO: 96589 - DNA, 30 bp, Homo sapiens
  misc_feature 1..30: note = chr7:149489914-149489944
  misc_feature 1..30: note = hypo
  source 1..30: mol_type = genomic DNA
cacacatccccaattcggaacccctgccct

SEQ ID NO: 96590 - DNA, 47 bp, Homo sapiens
  misc_feature 1..47: note = chr7:149513473-149513520
  misc_feature 1..47: note = hypo
  source 1..47: mol_type = genomic DNA
gctggccgcctgtaccgtgaatgccagcccggcgagggatgcccctt

SEQ ID NO: 96591 - DNA, 141 bp, Homo sapiens
  misc_feature 1..141: note = chr7:149518573-149518714
  misc_feature 1..141: note = hypo
  source 1..141: mol_type = genomic DNA
tgcctgcagggcactcgctcccgcaccctgggggacagctggctgcagggggagtgccagcggtggtgagtgcagggcagggaggggggctggaaccgccctgctggagagcagagtcctgagtcccggctctttcccagc

SEQ ID NO: 96592 - DNA, 40 bp, Homo sapiens
  misc_feature 1..40: note = chr7:149529824-149529864
  misc_feature 1..40: note = hypo
  source 1..40: mol_type = genomic DNA
tggccctagttcacccgctccctctcgcccaggagccata

SEQ ID NO: 96593 - DNA, 338 bp, Homo sapiens; identical to SEQ ID NO: 31606
  misc_feature 1..338: note = chr7:149744461-149744799
  misc_feature 1..338: note = hyper
  source 1..338: mol_type = genomic DNA

SEQ ID NO: 96594 - DNA, 137 bp, Homo sapiens; identical to SEQ ID NO: 31607
  misc_feature 1..137: note = chr7:149744950-149745087
  misc_feature 1..137: note = hyper
  source 1..137: mol_type = genomic DNA

SEQ ID NO: 96595 - DNA, 15 bp, Homo sapiens
  misc_feature 1..15: note = chr7:149745123-149745138
  misc_feature 1..15: note = hyper
  source 1..15: mol_type = genomic DNA
cgactctacctggct

SEQ ID NO: 96596 - DNA, 15 bp, Homo sapiens
  misc_feature 1..15: note = chr7:149745575-149745590
  misc_feature 1..15: note = hyper
  source 1..15: mol_type = genomic DNA
gcggtgggggagtcc

SEQ ID NO: 96597 - DNA, 37 bp, Homo sapiens
  misc_feature 1..37: note = chr7:149917110-149917147
  misc_feature 1..37: note = hyper
  source 1..37: mol_type = genomic DNA
agccctgctgctggccgcgggtctacaaaacagcata

SEQ ID NO: 96598 - DNA, 74 bp, Homo sapiens; identical to SEQ ID NO: 31610
  misc_feature 1..74: note = chr7:149917321-149917395
  misc_feature 1..74: note = hyper
  source 1..74: mol_type = genomic DNA

SEQ ID NO: 96599 - DNA, 51 bp, Homo sapiens
  misc_feature 1..51: note = chr7:149917773-149917824
  misc_feature 1..51: note = hyper
  source 1..51: mol_type = genomic DNA
ctaggctctttcctgcgcaaggggtggggaaacccgcgaaagccagggagt

SEQ ID NO: 96600 - DNA, 303 bp, Homo sapiens
  misc_feature 1..303: note = chr7:149917888-149918191
  misc_feature 1..303: note = hyper
  source 1..303: mol_type = genomic DNA
cgctccgctccagggcggatctttccacacccccctcaccctcaaaagctcaggctggagcggtcatcagtgcggactccggcaccccacccacccagcaggggttaaggagggactggtgcccactcttgcctacagctcctgcgcagggctccagccgccaaatcttcccgggatggtcgggaggtggcataagaggttttgccaggaaccactgcacaggcgaaagagagacagtggagtgggcggaggaggagctgggacggcacccgggctcgttagcccaggctgcacgagctacag

SEQ ID NO: 96601 - DNA, 15 bp, Homo sapiens
  misc_feature 1..15: note = chr7:149918262-149918277
  misc_feature 1..15: note = hyper
  source 1..15: mol_type = genomic DNA
cggcccaattggctt

SEQ ID NO: 96602 - DNA, 93 bp, Homo sapiens; identical to SEQ ID NO: 41504
  misc_feature 1..93: note = chr7:150049533-150049626
  misc_feature 1..93: note = hypo
  source 1..93: mol_type = genomic DNA

SEQ ID NO: 96603 - DNA, 1037 bp, Homo sapiens
  misc_feature 1..1037: note = chr7:150068543-150069580
  misc_feature 1..1037: note = hypo
  source 1..1037: mol_type = genomic DNA
ctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgca

SEQ ID NO: 96604 - DNA, 523 bp, Homo sapiens
  misc_feature 1..523: note = chr7:150069934-150070457
  misc_feature 1..523: note = hypo
  source 1..523: mol_type = genomic DNA
gagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctg

SEQ ID NO: 96605 - DNA, 152 bp, Homo sapiens
  misc_feature 1..152: note = chr7:150079238-150079390
  misc_feature 1..152: note = hypo
  source 1..152: mol_type = genomic DNA
tcctgcatggtggagcgtggaggctcctgtgtggcgctgggggcctctgagattcccaactggctggaaggagtgatggcttaggaggagtgagtggcagcggggacgctggcagagaggcttgtacagatactgcccgatgcatccggctc

SEQ ID NO: 96606 - DNA, 185 bp, Homo sapiens
  misc_feature 1..185: note = chr7:150081081-150081266
  misc_feature 1..185: note = hypo
  source 1..185: mol_type = genomic DNA
tgcctccccctgccccgggcctctccacctgctgctagctcaatcccctctttgtgtggttggtcttcagttgtcatggcagctgggcccaggctgaggcctgcccactgtgaggctcttaactgaactgcagcctgacccggtgcgcggagggccgggccagggccaggcgtgggaagggggcc

SEQ ID NO: 96607 - DNA, 48 bp, Homo sapiens
  misc_feature 1..48: note = chr7:150101959-150102007
  misc_feature 1..48: note = hyper
  source 1..48: mol_type = genomic DNA
cagtcctgaaaccctcgcccagggccgctccgccgccgggctccggcg

SEQ ID NO: 96608 - DNA, 477 bp, Homo sapiens
  misc_feature 1..477: note = chr7:1503320-1503797
  misc_feature 1..477: note = hypo
  source 1..477: mol_type = genomic DNA
catggcctgaggcatcgctcatttcagtccaaaacatccaccttggcttgcattagcttagctcctgggtccccaagaggcgctgcagaggtggggacccaggtgccacacccggaggggtggggcaggcttatgaggggttgactccttccaccagtggattcaaccctgaacgtcacctgaccaaggctgctgggccaagctggaacagaatcggatccttgagtctgggaggcggaggcggttcgggaatgcagagggcgtgagagagaaccaagggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgcagagcgtggaagggacgttgccctccccac

SEQ ID NO: 96609 - DNA, 238 bp, Homo sapiens
  misc_feature 1..238: note = chr7:150497647-150497885
  misc_feature 1..238: note = hyper
  source 1..238: mol_type = genomic DNA
gggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctccc

SEQ ID NO: 96610 - DNA, 30 bp, Homo sapiens
  misc_feature 1..30: note = chr7:1505469-1505499
  misc_feature 1..30: note = hypo
  source 1..30: mol_type = genomic DNA
cagcagcccctccaccgtatcccagctctg

SEQ ID NO: 96611 - DNA, 87 bp, Homo sapiens
  misc_feature 1..87: note = chr7:150554703-150554790
  misc_feature 1..87: note = hypo
  source 1..87: mol_type = genomic DNA
tcatgagttagcccccggcatcgactgcccggagaccgccaccttcctggacactttccactactatgatgccgatgacccggtcca

SEQ ID NO: 96612 - DNA, 30 bp, Homo sapiens
  misc_feature 1..30: note = chr7:150609213-150609243
  misc_feature 1..30: note = hypo
  source 1..30: mol_type = genomic DNA
cttggaggagaaaagcgggactgggttaca

SEQ ID NO: 96613 - DNA, 38 bp, Homo sapiens
  misc_feature 1..38: note = chr7:150653091-150653129
  misc_feature 1..38: note = hyper
  source 1..38: mol_type = genomic DNA
tctccctgacacccccgcccagccggtccagtgctgag

SEQ ID NO: 96614 - DNA, 30 bp, Homo sapiens
  misc_feature 1..30: note = chr7:150660247-150660277
  misc_feature 1..30: note = hyper
  source 1..30: mol_type = genomic DNA
cacagcccacactcccgaggcagccagcac

SEQ ID NO: 96615 - DNA, 243 bp, Homo sapiens
  misc_feature 1..243: note = chr7:150715080-150715323
  misc_feature 1..243: note = hyper
  source 1..243: mol_type = genomic DNA
gaaaagcagaaacagcggggtgaggagcggggacaggagctcctccaggagggagacctggggaagcagcggtgaggctgagcaggggtcgctgaggggcccacgcgcgttatcaggaccaagcagtccccagcgaccctcgccagggcaagaagcctccccacccagtcactccctagactcctggtatagtccgtttgtctcatgccctctcccagacagaccctccgcgcagacagaccc

SEQ ID NO: 96616 - DNA, 742 bp, Homo sapiens
  misc_feature 1..742: note = chr7:150715618-150716360
  misc_feature 1..742: note = hyper
  source 1..742: mol_type = genomic DNA
ggagaggtaaggattcggggggaacctcacatggccccagatcagagaaaccaacacacaccaccaccccgggcatctgccgtcgcacctggcgacggtggcggtgaccccgagcgcggtcatggcggtgagcacgtgctccacggctagcacgtcctcgtcgtagacggtgagcacaagcagcgcggcgaagagtgcacccgcgaagaaaacgagctggcgggccagcagcgtgcgcaggggcgcggggggcgcagcggtgcgcaggaaggcggcggcggggcggtaggcgcgggccaggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcggcagctcccagcccccgcggaagagcgagaagggaccgcggaagagcagcaggtcgacattgagcgccaggccgcggctgaggaaagccgcactgcctccccagggcagcgggcagcgggccggcagcaggcctttgttggccagcgccacctggtagttggtgtagcgcaggatgcggtggtggatgtcc

SEQ ID NO: 96617 - DNA, 294 bp, Homo sapiens
  misc_feature 1..294: note = chr7:150746049-150746343
  misc_feature 1..294: note = hypo
  source 1..294: mol_type = genomic DNA
gcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgc

SEQ ID NO: 96618 - DNA, 542 bp, Homo sapiens
  misc_feature 1..542: note = chr7:150748043-150748585
  misc_feature 1..542: note = hyper
  source 1..542: mol_type = genomic DNA
aggggctggggttttcgtcccatggcgggcagggcccagggagctgaggctgcttctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgcttaatctttctggccccgggggatgctgacg

SEQ ID NO: 96619 - DNA, 156 bp, Homo sapiens
  misc_feature 1..156: note = chr7:150753912-150754068
  misc_feature 1..156: note = hypo
  source 1..156: mol_type = genomic DNA
ggtccgcctgacagacgtccagtgtcagcccccgcctcccccaagcggccacaccggcaaggagcacccgcctcccgcacacctgacgatgttcttgtgcttcagctccttgagtaggcagatctcccggagggcggaactcggcacaccctgcat

SEQ ID NO: 96620 - DNA, 267 bp, Homo sapiens
  misc_feature 1..267: note = chr7:150758966-150759233
  misc_feature 1..267: note = hypo
  source 1..267: mol_type = genomic DNA
ccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacggtgagtgtggcccccaggtcgccagcccaaccttccctccctgggcagccttgggtgctccggccaagggtcctcgccaaccaggggtgtgagcgtgtgtgagtgtgg

SEQ ID NO: 96621 - DNA, 171 bp, Homo sapiens
  misc_feature 1..171: note = chr7:150773894-150774065
  misc_feature 1..171: note = hypo
  source 1..171: mol_type = genomic DNA
gggactccagttcctcgaagggtagctgtggggagaggagagggcggcaggttacccgcaggctgggagtgaggatgcgccacgggccaggccagggccactcaccggcaggagctggtagcccatcaggcctaggtgccgctccctcagggccctcgagcccagcagcac

SEQ ID NO: 96622 - DNA, 33 bp, Homo sapiens; identical to SEQ ID NO: 41512
  misc_feature 1..33: note = chr7:150774325-150774358
  misc_feature 1..33: note = hypo
  source 1..33: mol_type = genomic DNA

SEQ ID NO: 96623 - DNA, 153 bp, Homo sapiens
  misc_feature 1..153: note = chr7:150774704-150774857
  misc_feature 1..153: note = hypo
  source 1..153: mol_type = genomic DNA
cacctgtacttgcagcgggcacggtcggtgatgagaggctggggaaagatgggcacttgctgccttcggggaaggcggggaccccggtatcctgggagctccagctccacggccgtgtccagcagggagaggtagcgacgcacaatcagagca

SEQ ID NO: 96624 - DNA, 73 bp, Homo sapiens; identical to SEQ ID NO: 41514
  misc_feature 1..73: note = chr7:150811286-150811359
  misc_feature 1..73: note = hypo
  source 1..73: mol_type = genomic DNA

SEQ ID NO: 96625 - DNA, 30 bp, Homo sapiens
  misc_feature 1..30: note = chr7:150813180-150813210
  misc_feature 1..30: note = hypo
  source 1..30: mol_type = genomic DNA
ggaacctggaggtgacggagatgggggcct

SEQ ID NO: 96626 - DNA, 330 bp, Homo sapiens; identical to SEQ ID NO: 41515
  misc_feature 1..330: note = chr7:150823565-150823895
  misc_feature 1..330: note = hypo
  source 1..330: mol_type = genomic DNA

SEQ ID NO: 96627 - DNA, 30 bp, Homo sapiens
  misc_feature 1..30: note = chr7:150826816-150826846
  misc_feature 1..30: note = hypo
  source 1..30: mol_type = genomic DNA
actcgcgagtccttgcgaggcaatgagagg

SEQ ID NO: 96628 - DNA, 178 bp, Homo sapiens
  misc_feature 1..178: note = chr7:150864219-150864397
  misc_feature 1..178: note = hyper
  source 1..178: mol_type = genomic DNA
ggctcggggttgtttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccgg

SEQ ID NO: 96629 - DNA, 314 bp, Homo sapiens
  misc_feature 1..314: note = chr7:150864610-150864924
  misc_feature 1..314: note = hyper
  source 1..314: mol_type = genomic DNA
cgctaccgcctccggcccgctgcatcttgttcggagctgcggccgccccggggcgctcctctctgggcgcctccgtgcgccccgcggctcgggcgccccgcgcggacacgcagggctcgctccctggctcccgggccgaggtggcggcggggcgcgggctcggcgcagtgtggctccggcgccgcgctccctctctctcataaggagggagggggcgggcgagcaggcgggctgggggtgtcgccctccggactcatccatcttcctcaaattacgcttcatttcctccctccgcccgccgccgccgcgcccgg

SEQ ID NO: 96630 - DNA, 399 bp, Homo sapiens
  misc_feature 1..399: note = chr7:150870816-150871215
  misc_feature 1..399: note = hypo
  source 1..399: mol_type = genomic DNA
ctccaaactctttcccgcaccagcgagcccgcactcgcatgatacccagacctgcgctcgacctggccccagatccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggtccgtcctgccactcct

SEQ ID NO: 96631 - DNA, 136 bp, Homo sapiens
  misc_feature 1..136: note = chr7:150872876-150873012
  misc_feature 1..136: note = hypo
  source 1..136: mol_type = genomic DNA
acatcacccggctgccgctgtcggtccgcttctctgcattgggaattgcagcatccacacctgcctgcggagctgggcctcctgctgccagggctacctggcctgagttagtgcagaggcgcgccctctgcaggct

SEQ ID NO: 96632 - DNA, 83 bp, Homo sapiens
  misc_feature 1..83: note = chr7:150884625-150884708
  misc_feature 1..83: note = hypo
  source 1..83: mol_type = genomic DNA
accttgccaggtccccggtgtagagggcattctgcagggccatgtcttggcagagcagtggtgatggccgagggggctcccag

SEQ ID NO: 96633 - DNA, 30 bp, Homo sapiens
  misc_feature 1..30: note = chr7:151077135-151077165
  misc_feature 1..30: note = hypo
  source 1..30: mol_type = genomic DNA
agacctggccacccccgaggtctgtgtgtg

SEQ ID NO: 96634 - DNA, 76 bp, Homo sapiens
  misc_feature 1..76: note = chr7:151082136-151082212
  misc_feature 1..76: note = hypo
  source 1..76: mol_type = genomic DNA
tggggtggcacaggtcgtgcagggccaagtcacttacaggtgcccgcgtggtacttgagggcgctcacgttgcgtc

SEQ ID NO: 96635 - DNA, 48 bp, Homo sapiens
  misc_feature 1..48: note = chr7:151088640-151088688
  misc_feature 1..48: note = hypo
  source 1..48: mol_type = genomic DNA
gattctgtttctctgcgcaccgggtctggggcccgacagtccttttca

SEQ ID NO: 96636 - DNA, 358 bp, Homo sapiens
  misc_feature 1..358: note = chr7:151106208-151106566
  misc_feature 1..358: note = hyper
  source 1..358: mol_type = genomic DNA
agggagatttcctgccgctggttgacaaatgatcttcgcctttgtagcggacgcccctcgacccacccacccgatcccggccgcaccctgctctgcacccgcaccccacccccagacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgc

SEQ ID NO: 96637 - DNA, 400 bp, Homo sapiens; identical to SEQ ID NO: 3135
  misc_feature 1..400: note = chr7:151106589-151106989
  misc_feature 1..400: note = hyper
  source 1..400: mol_type = genomic DNA

SEQ ID NO: 96638 - DNA, 242 bp, Homo sapiens; identical to SEQ ID NO: 31619
  misc_feature 1..242: note = chr7:151107395-151107637
  misc_feature 1..242: note = hyper
  source 1..242: mol_type = genomic DNA

SEQ ID NO: 96639 - DNA, 205 bp, Homo sapiens; identical to SEQ ID NO: 31620
  misc_feature 1..205: note = chr7:151107638-151107843
  misc_feature 1..205: note = hyper
  source 1..205: mol_type = genomic DNA

SEQ ID NO: 96640 - DNA, 81 bp, Homo sapiens
  misc_feature 1..81: note = chr7:151137032-151137113
  misc_feature 1..81: note = hyper
  source 1..81: mol_type = genomic DNA
gtttacaccgggcagcgccctgctggctcagcgccgccccggacaaaagatttgctgggccggccccggagcgttagtgct

SEQ ID NO: 96641 - DNA, 417 bp, Homo sapiens
  misc_feature 1..417: note = chr7:151145500-151145917
  misc_feature 1..417: note = hyper
  source 1..417: mol_type = genomic DNA
ggccgagggccccagcggagctcggcgggggtgcggggcggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagctgggcctgggcctctgcaggggtcgccccgccagcccgggccccctggctgcgccccgtttccagccggcgtcagggagggggctgcagtgctccgggggtcatcggattcgggcggggaaggaaaggcgggacgtctgcgccccagaagacagtccccgggtctcccaccctgaaagccagcgaggttcgggtaaatgaaagt

SEQ ID NO: 96642 - DNA, 30 bp, Homo sapiens
  misc_feature 1..30: note = chr7:151423801-151423831
  misc_feature 1..30: note = hypo
  source 1..30: mol_type = genomic DNA
aaattcaaaaccagacgatgccaatcttga

SEQ ID NO: 96643 - DNA, 32 bp, Homo sapiens
  misc_feature 1..32: note = chr7:151501814-151501846
  misc_feature 1..32: note = hypo
  source 1..32: mol_type = genomic DNA
tccgtggtgttccatcgcggcacagagtcggc

SEQ ID NO: 96644 - DNA, 175 bp, Homo sapiens
  misc_feature 1..175: note = chr7:151553599-151553774
  misc_feature 1..175: note = hypo
  source 1..175: mol_type = genomic DNA
gggttcaattggcctcgccgtggcccttaggcaaacaactcattctatctgagcctccgtttctccaactgtaaaaaccgggtgaatactaggaacaggcagagttgctgatgagttaaatggcaaaatatgtgaaagacgttaagtctggcacccacaccgaatataactcagt

SEQ ID NO: 96645 - DNA, 72 bp, Homo sapiens
  misc_feature 1..72: note = chr7:151569929-151570001
  misc_feature 1..72: note = hypo
  source 1..72: mol_type = genomic DNA
ggaggctatccacagcgtccaccgcagcttcttcacgccttcaggagggggtcctcacgccttaggcctggt

SEQ ID NO: 96646 - DNA, 198 bp, Homo sapiens
  misc_feature 1..198: note = chr7:151574921-151575119
  misc_feature 1..198: note = hyper
  source 1..198: mol_type = genomic DNA
gttcatcaaggtttgcgcagtggatccgcggtaagtgcgtgtccccacgccgcgggaaacgtggggctcctgagactgcggaaagaattgggagaaggggagggctcgaagacccgggcgagggttcccggtgcggcccaggtcctttagagccccgggtgggcatccagtaccgcctgctgccgagggccctagagg

SEQ ID NO: 96647 - DNA, 30 bp, Homo sapiens; identical to SEQ ID NO: 41520
  misc_feature 1..30: note = chr7:151585396-151585426
  misc_feature 1..30: note = hypo
  source 1..30: mol_type = genomic DNA

SEQ ID NO: 96648 - DNA, 30 bp, Homo sapiens
  misc_feature 1..30: note = chr7:151585720-151585750
  misc_feature 1..30: note = hypo
  source 1..30: mol_type = genomic DNA
agtgagaaacacaggcgtggaggattttcc

SEQ ID NO: 96649 - DNA, 336 bp, Homo sapiens
  misc_feature 1..336: note = chr7:151591649-151591985
  misc_feature 1..336: note = hypo
  source 1..336: mol_type = genomic DNA
ggctcaagccctccccgatccctccgccctctccgatcctccgtcctccccactcctccgccctctccgatccgtcgtcctccccgctcctccgccctcccagttcctccgccctcctggcttctctgccctcatcgctcctctgccctccctgctcctccatcctccctgctcctctgccctccccaatcctgtctcctccctgctcctctgccctccccaatcctgtctcctccctgctcctctgccctccctgctccttcgtcctccccgctcgtcctccctcccgctcctctgtcctcccccctcctccatcctccccgctcctccgccctc

SEQ ID NO: 96650 - DNA, 63 bp, Homo sapiens; identical to SEQ ID NO: 41080
  misc_feature 1..63: note = chr7:1516637-1516700
  misc_feature 1..63: note = hypo
  source 1..63: mol_type = genomic DNA

SEQ ID NO: 96651 - DNA, 185 bp, Homo sapiens
  misc_feature 1..185: note = chr7:151706792-151706977
  misc_feature 1..185: note = hypo
  source 1..185: mol_type = genomic DNA
ccaaccataggtctacgctccctggaccttcccatgttccagtaactaagggaatagcacttggcagggcaagtctactctgatcgccgagggtctgtgccacacccttgttgatatttttagtaggatacttgcatcagtccccatggctgtaactaatacctgtatcacgataatatccaact

SEQ ID NO: 96652 - DNA, 30 bp, Homo sapiens
  misc_feature 1..30: note = chr7:151717267-151717297
  misc_feature 1..30: note = hypo
  source 1..30: mol_type = genomic DNA
agggagccatgctctcgtgactttggctga

SEQ ID NO: 96653 - DNA, 36 bp, Homo sapiens
  misc_feature 1..36: note = chr7:151723170-151723206
  misc_feature 1..36: note = hyper
  source 1..36: mol_type = genomic DNA
ctcctgaggcttgttcgcgggcgtgggggcgaggac

SEQ ID NO: 96654 - DNA, 38 bp, Homo sapiens
  misc_feature 1..38: note = chr7:151812801-151812839
  misc_feature 1..38: note = hypo
  source 1..38: mol_type = genomic DNA
aaaacttacatttaccgccaggagcttgacagcttcct

SEQ ID NO: 96655 - DNA, 21 bp, Homo sapiens
  misc_feature 1..21: note = chr7:152085353-152085374
  misc_feature 1..21: note = hypo
  source 1..21: mol_type = genomic DNA
tatgctctggccaggcgtggt

SEQ ID NO: 96656 - DNA, 196 bp, Homo sapiens
  misc_feature 1..196: note = chr7:152159631-152159827
  misc_feature 1..196: note = hypo
  source 1..196: mol_type = genomic DNA
tagccaagggtttctcgtgtttgatgccaaatgccttgtgcggggattggctccaaacctcagcctcatcagtcaatttatccttacgttcaagagcagccatttacaaaacgagctcagaaaattaaaaaaaaaatacaaactttaaatcgccagaatactgcataaactaaaagtaggccgggcgcagtggctc

SEQ ID NO: 96657 - DNA, 40 bp, Homo sapiens; identical to SEQ ID NO: 41523
  misc_feature 1..40: note = chr7:152337514-152337554
  misc_feature 1..40: note = hypo
  source 1..40: mol_type = genomic DNA

SEQ ID NO: 96658 - DNA, 79 bp, Homo sapiens
  misc_feature 1..79: note = chr7:152371357-152371436
  misc_feature 1..79: note = hypo
  source 1..79: mol_type = genomic DNA
gattgcaaaaatcatcggaccttaacctgggtttcaaataatcatttaaatataaggttttggccgggcgcagtggctc

SEQ ID NO: 96659 - DNA, 19 bp, Homo sapiens
  misc_feature 1..19: note = chr7:152374378-152374397
  misc_feature 1..19: note = hypo
  source 1..19: mol_type = genomic DNA
agcttaggcctgaatcgtg

SEQ ID NO: 96660 - DNA, 138 bp, Homo sapiens
  misc_feature 1..138: note = chr7:152537420-152537558
  misc_feature 1..138: note = hypo
  source 1..138: mol_type = genomic DNA
acccactgtgcttgtcgccgtcctgccttccctgggccggtgctgacgtcattaccctctaatttcccctcagacctgcgagcggcctggtgatgtcttcacagatgagggcgtgggagcccacgggtggggggtttg

SEQ ID NO: 96661 - DNA, 30 bp, Homo sapiens
  misc_feature 1..30: note = chr7:152603655-152603685
  misc_feature 1..30: note = hypo
  source 1..30: mol_type = genomic DNA
cagaaagaggcttcacgagaaactggagct

SEQ ID NO: 96662 - DNA, 18 bp, Homo sapiens
  misc_feature 1..18: note = chr7:152622496-152622514
  misc_feature 1..18: note = hyper
  source 1..18: mol_type = genomic DNA
gggaacggtggaggccgc

SEQ ID NO: 96663 - DNA, 270 bp, Homo sapiens
  misc_feature 1..270: note = chr7:152622545-152622815
  misc_feature 1..270: note = hyper
  source 1..270: mol_type = genomic DNA
cggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccaggtgtggaatcaaaacagatcccagagcgcgatccgcggggcttttggaaggagcc

SEQ ID NO: 96664 - DNA, 38 bp, Homo sapiens
  misc_feature 1..38: note = chr7:152622816-152622854
  misc_feature 1..38: note = hyper
  source 1..38: mol_type = genomic DNA
cccagggctggagattccgacgcaaagacccggaggcc

SEQ ID NO: 96665 - DNA, 175 bp, Homo sapiens; identical to SEQ ID NO: 15049
  misc_feature 1..175: note = chr7:152693809-152693984
  misc_feature 1..175: note = hypo
  source 1..175: mol_type = genomic DNA

SEQ ID NO: 96666 - DNA, 42 bp, Homo sapiens
  misc_feature 1..42: note = chr7:152775969-152776011
  misc_feature 1..42: note = hypo
  source 1..42: mol_type = genomic DNA
ggcttcagaaagggacgaaatcttttttttccatgttaagat

SEQ ID NO: 96667 - DNA, 210 bp, Homo sapiens
  misc_feature 1..210: note = chr7:152782995-152783205
  misc_feature 1..210: note = hypo
  source 1..210: mol_type = genomic DNA
ggagttaagttaacccgaggtcttaattttattaaatgatcactgcggtgcagtgggttgaatatgggattcagaaatagaaggtttggcttcatttggtccacaaatagtcattgctgtgttcacagattggtacacagtgatgtataatagcggagacagacagattgcaagctctgtgacagcgatgacgaacgtgggacgtgaaaa

SEQ ID NO: 96668 - DNA, 34 bp, Homo sapiens; identical to SEQ ID NO: 41526
  misc_feature 1..34: note = chr7:152984071-152984105
  misc_feature 1..34: note = hypo
  source 1..34: mol_type = genomic DNA

SEQ ID NO: 96669 - DNA, 23 bp, Homo sapiens
  misc_feature 1..23: note = chr7:153041593-153041616
  misc_feature 1..23: note = hypo
  source 1..23: mol_type = genomic DNA
tttttttttttgagacggagtct

SEQ ID NO: 96670 - DNA, 22 bp, Homo sapiens
  misc_feature 1..22: note = chr7:153041856-153041878
  misc_feature 1..22: note = hypo
  source 1..22: mol_type = genomic DNA
ttacaggcgtaagccaacaagc

SEQ ID NO: 96671 - DNA, 198 bp, Homo sapiens
  misc_feature 1..198: note = chr7:153102258-153102456
  misc_feature 1..198: note = hypo
  source 1..198: mol_type = genomic DNA
cagtgcccaaacaatcggctccccgttctcttacgtcacttcacaatggcaggggcctttccagcacccacttctagggcacacagggccttcccggcaaacactcaagatgatgcttaggtttggatcgagatttctttctgaggccctgacccacattctgagatagaaggcactctccagcggcattgtctaagt

SEQ ID NO: 96672 - DNA, 42 bp, Homo sapiens; identical to SEQ ID NO: 41081
  misc_feature 1..42: note = chr7:1532979-1533021
  misc_feature 1..42: note = hypo
  source 1..42: mol_type = genomic DNA

SEQ ID NO: 96673 - DNA, 30 bp, Homo sapiens; identical to SEQ ID NO: 31625
  misc_feature 1..30: note = chr7:153445126-153445156
  misc_feature 1..30: note = hyper
  source 1..30: mol_type = genomic DNA

SEQ ID NO: 96674 - DNA, 117 bp, Homo sapiens; identical to SEQ ID NO: 9283
  misc_feature 1..117: note = chr7:153446175-153446292
  misc_feature 1..117: note = hyper
  source 1..117: mol_type = genomic DNA

SEQ ID NO: 96675 - DNA, 22 bp, Homo sapiens
  misc_feature 1..22: note = chr7:153505321-153505343
  misc_feature 1..22: note = hypo
  source 1..22: mol_type = genomic DNA
gcgtgtgtgcacgtgcgtgcgt

SEQ ID NO: 96676 - DNA, 38 bp, Homo sapiens
  misc_feature 1..38: note = chr7:153519547-153519585
  misc_feature 1..38: note = hypo
  source 1..38: mol_type = genomic DNA
ttacaggcatgagccactgtgcccggttaatcattttg

SEQ ID NO: 96677 - DNA, 80 bp, Homo sapiens; identical to SEQ ID NO: 41529
  misc_feature 1..80: note = chr7:153540019-153540099
  misc_feature 1..80: note = hypo
  source 1..80: mol_type = genomic DNA

SEQ ID NO: 96678 - DNA, 228 bp, Homo sapiens
  misc_feature 1..228: note = chr7:153583302-153583530
  misc_feature 1..228: note = hyper
  source 1..228: mol_type = genomic DNA
tttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagc

SEQ ID NO: 96679 - DNA, 839 bp, Homo sapiens
  misc_feature 1..839: note = chr7:153583631-153584470
  misc_feature 1..839: note = hyper
  source 1..839: mol_type = genomic DNA
cggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 96680 - DNA, 368 bp, Homo sapiens
  misc_feature 1..368: note = chr7:153584779-153585147
  misc_feature 1..368: note = hyper
  source 1..368: mol_type = genomic DNA
ggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcaga

SEQ ID NO: 96681 - skipped

SEQ ID NO: 96682 - DNA, 30 bp, Homo sapiens; identical to SEQ ID NO: 41530
  misc_feature 1..30: note = chr7:153641678-153641708
  misc_feature 1..30: note = hypo
  source 1..30: mol_type = genomic DNA

SEQ ID NO: 96683 - DNA, 390 bp, Homo sapiens
  misc_feature 1..390: note = chr7:153749653-153750043
  misc_feature 1..390: note = hyper
  source 1..390: mol_type = genomic DNA
agagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccg

SEQ ID NO: 96684 - DNA, 76 bp, Homo sapiens; identical to SEQ ID NO: 31632
  misc_feature 1..76: note = chr7:153750249-153750325
  misc_feature 1..76: note = hyper
  source 1..76: mol_type = genomic DNA

SEQ ID NO: 96685 - DNA, 30 bp, Homo sapiens
  misc_feature 1..30: note = chr7:153789907-153789937
  misc_feature 1..30: note = hypo
  source 1..30: mol_type = genomic DNA
ttgatgattcttacccgagtcaagtattat

SEQ ID NO: 96686 - DNA, 324 bp, Homo sapiens
  misc_feature 1..324: note = chr7:153820811-153821135
  misc_feature 1..324: note = hypo
  source 1..324: mol_type = genomic DNA
gacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacc

SEQ ID NO: 96687 - DNA, 30 bp, Homo sapiens; identical to SEQ ID NO: 41531
  misc_feature 1..30: note = chr7:153896397-153896427
  misc_feature 1..30: note = hypo
  source 1..30: mol_type = genomic DNA

SEQ ID NO: 96688 - skipped

SEQ ID NO: 96689 - DNA, 30 bp, Homo sapiens
  misc_feature 1..30: note = chr7:154062573-154062603
  misc_feature 1..30: note = hypo
  source 1..30: mol_type = genomic DNA
tgaaccagcttgaatcggaggggaacgtgt

SEQ ID NO: 96690 - DNA, 30 bp, Homo sapiens
  misc_feature 1..30: note = chr7:154063085-154063115
  misc_feature 1..30: note = hypo
  source 1..30: mol_type = genomic DNA
cttgtctctatcttccggggtaagcctgcg

SEQ ID NO: 96691 - DNA, 30 bp, Homo sapiens
  misc_feature 1..30: note = chr7:154065573-154065603
  misc_feature 1..30: note = hypo
  source 1..30: mol_type = genomic DNA
ctgcagtgtttactccggataattttgcca

SEQ ID NO: 96692 - DNA, 40 bp, Homo sapiens; identical to SEQ ID NO: 41532
  misc_feature 1..40: note = chr7:154088244-154088284
  misc_feature 1..40: note = hypo
  source 1..40: mol_type = genomic DNA

SEQ ID NO: 96693 - DNA, 66 bp, Homo sapiens
  misc_feature 1..66: note = chr7:154186455-154186521
  misc_feature 1..66: note = hypo
  source 1..66: mol_type = genomic DNA
tgagtatttgcaggacgctgttctgagattggtgtagacctttctaatatccggcactttgcagtt

SEQ ID NO: 96694 - DNA, 29 bp, Homo sapiens
  misc_feature 1..29: note = chr7:15431976-15432005
  misc_feature 1..29: note = hypo
  source 1..29: mol_type = genomic DNA
tgagtcaacatgcccggccctatttcctt

SEQ ID NO: 96695 - DNA, 155 bp, Homo sapiens
  misc_feature 1..155: note = chr7:15435723-15435878
  misc_feature 1..155: note = hypo
  source 1..155: mol_type = genomic DNA
ctttccatttcagaacggacagaaatatttgcatgcaaaagactgtaaaccttgttttatatgtcaatttagccctccctcgtccagaaatggtgggttcttggcctcgctgacttcaagaaagaagccccacggaccctcgcagtgagtgctac

SEQ ID NO: 96696 - DNA, 30 bp, Homo sapiens
  misc_feature 1..30: note = chr7:154438196-154438226
  misc_feature 1..30: note = hypo
  source 1..30: mol_type = genomic DNA
cccttcaagccacagcgtcaaaacctcctt

SEQ ID NO: 96697 - DNA, 30 bp, Homo sapiens
  misc_feature 1..30: note = chr7:154468234-154468264
  misc_feature 1..30: note = hypo
  source 1..30: mol_type = genomic DNA
gacctgctacacaggcgttccctgactgac

SEQ ID NO: 96698 - DNA, 30 bp, Homo sapiens
  misc_feature 1..30: note = chr7:154486585-154486615
  misc_feature 1..30: note = hypo
  source 1..30: mol_type = genomic DNA
ccaccaccttctcctcgtgccacacacaca

SEQ ID NO: 96699 - DNA, 30 bp, Homo sapiens
  misc_feature 1..30: note = chr7:154540210-154540240
  misc_feature 1..30: note = hypo
  source 1..30: mol_type = genomic DNA
cgcggcactagacaacgccaagagaatggc

SEQ ID NO: 96700 - DNA, 219 bp, Homo sapiens
  misc_feature 1..219: note = chr7:154542071-154542290
  misc_feature 1..219: note = hypo
  source 1..219: mol_type = genomic DNA
gagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggc

SEQ ID NO: 96701 - DNA, 39 bp, Homo sapiens; identical to SEQ ID NO: 15050
  misc_feature 1..39: note = chr7:154561150-154561189
  misc_feature 1..39: note = hypo
  source 1..39: mol_type = genomic DNA

SEQ ID NO: 96702 - DNA, 153 bp, Homo sapiens
  misc_feature 1..153: note = chr7:154597586-154597739
  misc_feature 1..153: note = hypo
  source 1..153: mol_type = genomic DNA
taaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcc

SEQ ID NO: 96703 - DNA, 71 bp, Homo sapiens
  misc_feature 1..71: note = chr7:154622694-154622765
  misc_feature 1..71: note = hypo
  source 1..71: mol_type = genomic DNA
caggattctctaccacggactctgttcttgcctctcaccgtccacgcccaggtgaccgtgtcatccccacg

SEQ ID NO: 96704 - DNA, 153 bp, Homo sapiens
  misc_feature 1..153: note = chr7:154665013-154665166
  misc_feature 1..153: note = hypo
  source 1..153: mol_type = genomic DNA
tctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagag

SEQ ID NO: 96705 - DNA, 34 bp, Homo sapiens
  misc_feature 1..34: note = chr7:154667699-154667733
  misc_feature 1..34: note = hypo
  source 1..34: mol_type = genomic DNA
ggtggtaaagtgtgacggccgtggcagcggcttc

SEQ ID NO: 96706 - DNA, 41 bp, Homo sapiens; identical to SEQ ID NO: 41536
  misc_feature 1..41: note = chr7:154670093-154670134
  misc_feature 1..41: note = hypo
  source 1..41: mol_type = genomic DNA

SEQ ID NO: 96707 - DNA, 30 bp, Homo sapiens
  misc_feature 1..30: note = chr7:154674338-154674368
  misc_feature 1..30: note = hypo
  source 1..30: mol_type = genomic DNA
aagggggcacctgtgcgttatgttctgcag

SEQ ID NO: 96708 - DNA, 30 bp, Homo sapiens
  misc_feature 1..30: note = chr7:154675853-154675883
  misc_feature 1..30: note = hypo
  source 1..30: mol_type = genomic DNA
acacatgctcatacacgtttacccatacac

SEQ ID NO: 96709 - DNA, 30 bp, Homo sapiens
  misc_feature 1..30: note = chr7:154687918-154687948
  misc_feature 1..30: note = hypo
  source 1..30: mol_type = genomic DNA
ctgcgtgttcgtagacgggcagctacgccg

SEQ ID NO: 96710 - DNA, 30 bp, Homo sapiens
  misc_feature 1..30: note = chr7:154697056-154697086
  misc_feature 1..30: note = hypo
  source 1..30: mol_type = genomic DNA
gctgctagcactccacgccagccctgcaaa

SEQ ID NO: 96711 - DNA, 30 bp, Homo sapiens
  misc_feature 1..30: note = chr7:154708250-154708280
  misc_feature 1..30: note = hypo
  source 1..30: mol_type = genomic DNA
tgggaacagatgggccgagtggggggcagg

SEQ ID NO: 96712 - DNA, 222 bp, Homo sapiens
  misc_feature 1..222: note = chr7:1547246-1547468
  misc_feature 1..222: note = hypo
  source 1..222: mol_type = genomic DNA
tctccactgatggcccgggcaggaccacaggcgttccgtcatcctgggggggtgtgcagggtctgccctgtgctcttcatcggcgtctccctgatgagtaatgatgagcgttttctcatctttttttgtcatccgtgtatctgcattattggtgtctgttcaaattgtttgctcactttttgaaaatattttttatggccaggcgcgatggctcacgcctgt

SEQ ID NO: 96713 - DNA, 340 bp, Homo sapiens
  misc_feature 1..340: note = chr7:154861690-154862030
  misc_feature 1..340: note = hyper
  source 1..340: mol_type = genomic DNA
ccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgc

SEQ ID NO: 96714 - DNA, 400 bp, Homo sapiens
  misc_feature 1..400: note = chr7:154862031-154862431
  misc_feature 1..400: note = hyper
  source 1..400: mol_type = genomic DNA
ccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacac

SEQ ID NO: 96715 - DNA, 133 bp, Homo sapiens
  misc_feature 1..133: note = chr7:154922507-154922640
  misc_feature 1..133: note = hypo
  source 1..133: mol_type = genomic DNA
tggatgttgtgtcaccgtccacactccccgctggtcccaccaataggactaaagccctcatccttctggctggccgctgccagtgccgtcagctgaaggctcccggctaagtctcttccggtctcatgggtcg

SEQ ID NO: 96716 - DNA, 203 bp, Homo sapiens
  misc_feature 1..203: note = chr7:154926142-154926345
  misc_feature 1..203: note = hypo
  source 1..203: mol_type = genomic DNA
ttgtgaatgaatgcacgtctcaggttttaccttcacagcagtcacatattacctccttcacccactccaggacaagaacaggcagcacacagtttacactgctgtgcatcttgtttttctttttacgtaatagattgtgacactctttccgcatcagtacataagaatttcatctttggccgggcgcggtggctcacgcctgt

SEQ ID NO: 96717 - DNA, 30 bp, Homo sapiens
  misc_feature 1..30: note = chr7:154959001-154959031
  misc_feature 1..30: note = hypo
  source 1..30: mol_type = genomic DNA
caggcagcgccctggcgcaggtgaagcagc

SEQ ID NO: 96718 - DNA, 30 bp, Homo sapiens
  misc_feature 1..30: note = chr7:154982436-154982466
  misc_feature 1..30: note = hyper
  source 1..30: mol_type = genomic DNA
tctcaaaccccggggcgggaccctgcacta

SEQ ID NO: 96719 - DNA, 114 bp, Homo sapiens
  misc_feature 1..114: note = chr7:155018128-155018242
  misc_feature 1..114: note = hypo
  source 1..114: mol_type = genomic DNA
tgacaaggtgcatggcgcggccaggacagccttgtgcaggggacagcggaagctcaggagacaaggtcagaggtggtggggccccgccacggagggcaccgaggggaggaactg

SEQ ID NO: 96720 - DNA, 145 bp, Homo sapiens
  misc_feature 1..145: note = chr7:155052879-155053024
  misc_feature 1..145: note = hypo
  source 1..145: mol_type = genomic DNA
ttgacttcaaacttccggcttccaggatgacgagagcatcagttgccctcactttaaggtctcaagttctgtacattctgcacattcccagaaaaggttggtcacagcagcctacagtatttcagtttagcgtattcttctgtgt

SEQ ID NO: 96721 - DNA, 51 bp, Homo sapiens
  misc_feature 1..51: note = chr7:155053384-155053435
  misc_feature 1..51: note = hypo
  source 1..51: mol_type = genomic DNA
gcagaggccagcactcgctttgcccacaggggcactcgcacccatgagcct

SEQ ID NO: 96722 - DNA, 162 bp, Homo sapiens
  misc_feature 1..162: note = chr7:155130632-155130794
  misc_feature 1..162: note = hypo
  source 1..162: mol_type = genomic DNA
gtgcagggaggccagcggccgggacagaggcacgtataccgcggtcagtggccgggacagaggcacatgcagggggaccagtggccaggacagagactcatttacggaggccagaggcaggcacagaggcgcgtgcagggaggccagcggctgggacagagg

SEQ ID NO: 96723 - DNA, 44 bp, Homo sapiens; identical to SEQ ID NO: 41539
  misc_feature 1..44: note = chr7:155133192-155133236
  misc_feature 1..44: note = hypo
  source 1..44: mol_type = genomic DNA

SEQ ID NO: 96724 - DNA, 145 bp, Homo sapiens
  misc_feature 1..145: note = chr7:155144931-155145076
  misc_feature 1..145: note = hypo
  source 1..145: mol_type = genomic DNA
cctcctgatgtgtaccggggcgaggcttacctggatgaacaccgtgaatgaaatggaacagcagtgggtcgagccccgccttggggcatcgcagcaccaggaacgtggctcgcactaacatgcgtgacctcggctaagcttcatg

SEQ ID NO: 96725 - DNA, 2623 bp, Homo sapiens
  misc_feature 1..2623: note = chr7:155164415-155167038
  misc_feature 1..2623: note = hyper
  source 1..2623: mol_type = genomic DNA
aacaacttcgtgacccgctccatcccctctttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagc

SEQ ID NO: 96726 - DNA, 51 bp, Homo sapiens; identical to SEQ ID NO: 728
  misc_feature 1..51: note = chr7:155167039-155167090
  misc_feature 1..51: note = hyper
  source 1..51: mol_type = genomic DNA

SEQ ID NO: 96727 - DNA, 487 bp, Homo sapiens; identical to SEQ ID NO: 729
  misc_feature 1..487: note = chr7:155167174-155167661
  misc_feature 1..487: note = hyper
  source 1..487: mol_type = genomic DNA

SEQ ID NO: 96728 - DNA, 11 bp, Homo sapiens
  misc_feature 1..11: note = chr7:155167833-155167844
  misc_feature 1..11: note = hyper
  source 1..11: mol_type = genomic DNA
cgcccagggcc

SEQ ID NO: 96729 - DNA, 64 bp, Homo sapiens; identical to SEQ ID NO: 31640
  misc_feature 1..64: note = chr7:155167845-155167909
  misc_feature 1..64: note = hyper
  source 1..64: mol_type = genomic DNA

SEQ ID NO: 96730 - DNA, 143 bp, Homo sapiens
  misc_feature 1..143: note = chr7:155168178-155168321
  misc_feature 1..143: note = hyper
  source 1..143: mol_type = genomic DNA
cctcagattagggaccggaggaaggaagtgcaactcccagagagggcagccagccttagcggcggtgacagcttcctcacggtggtcctgcagctggagctccagagaaagaagggaggaagcacttccggaagtctctgcca

SEQ ID NO: 96731 - DNA, 85 bp, Homo sapiens; identical to SEQ ID NO: 31641
  misc_feature 1..85: note = chr7:155168529-155168614
  misc_feature 1..85: note = hyper
  source 1..85: mol_type = genomic DNA

SEQ ID NO: 96732 - DNA, 761 bp, Homo sapiens
  misc_feature 1..761: note = chr7:155170182-155170943
  misc_feature 1..761: note = hyper
  source 1..761: mol_type = genomic DNA
ggtgggctcctaaagcgtcccatttctccctttagatttggggccccccagctgataaaggagttgtgattgcaggtggatttgatctgatttcccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggactccttggacctggggatgaattcttgccaactatctccaaatatttcccctacaccatgccagtgcaattcatgtctccaaaccccctctcctccacaaaaacgaaacaaaacaaaaccccaggtccaggagctcaggcccaggccggatccaagacgcggcagccaggcagccccgccgcgagcctgtgcgggcttgagccggcttggcccccggaagccccagccccgcgctcggcagcgtgcgcccagcgcccagaagaagcagctccaggcggccgcgctccccgtcccgccgcggtgcggtcggatgcccagctcgcgtccagacccgcgggatgcagacccggatcagtcaggcttgagggctgctccgcatagaccaacgtccggggaaggcacacagtggccgagggcccgcgcgcttgggctacggctgtgatggtatctgcgctgcttgcgcctt

SEQ ID NO: 96733 - DNA, 1251 bp, Homo sapiens
  misc_feature 1..1251: note = chr7:155173869-155175120
  misc_feature 1..1251: note = hyper
  source 1..1251: mol_type = genomic DNA
cttcaccttccaaaccgcagtccctggtgatcctgacttttgcagcctggctctgggtccacacggggctggagaaggggattcggtctgaatgggttcgtggagggtggggcagggggctgagctgaggaacgcgctggcgagggagtcagatactgttacttcgtattttaggaatgtatttctcctgcacacccctccctcccctgcccacccccctctcccagtatcattgctctttgaaatgtcatgaacttggcgctttcagaccaaaccgccgggctcaggcccgagacaatgggattgtcagagggccagcgcggagctttttctgcgtgttcacggagcgttaagcctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatgggagccctggcgcgcgctgggcaccgcgcggtgagtgtcgggggtgggggccgcgggtctccagcagcccctgccctgtgcggaccgccgccccgagggtccctgcttgcgggtccggggctgggcgtgcctggctcccc

SEQ ID NO: 96734 - DNA, 161 bp, Homo sapiens
  misc_feature 1..161: note = chr7:155202728-155202889
  misc_feature 1..161: note = hypo
  source 1..161: mol_type = genomic DNA
gcacgcatgtgagagcgcaggtgtctgtgtgtatagaagagtgtgttgtgtgaatgcatgcatgtgcttaccctttgtatcccccacctgcttccctgccttgcccacgctcatgcggggagggggcgcggggagggggcgcaggacgggcctggtccagg

SEQ ID NO: 96735 - DNA, 35 bp, Homo sapiens
  misc_feature 1..35: note = chr7:155215884-155215919
  misc_feature 1..35: note = hypo
  source 1..35: mol_type = genomic DNA
cctgccagagagccccggcccgccctccctggagc

SEQ ID NO: 96736 - DNA, 30 bp, Homo sapiens
  misc_feature 1..30: note = chr7:155220048-155220078
  misc_feature 1..30: note = hypo
  source 1..30: mol_type = genomic DNA
gggacggggactcctcgttccacacagagc

SEQ ID NO: 96737 - DNA, 172 bp, Homo sapiens
  misc_feature 1..172: note = chr7:155241318-155241490
  misc_feature 1..172: note = hyper
  source 1..172: mol_type = genomic DNA
attctcggaggcctgcggtgggagccagggcgcggcggagagggtttcccacctcttccccagcaagcgggagggaggcgccgggctgaggctgcgctgagctcgagctcgccgcccgggtggacccgccctgttcaagcgcggaggggcggaggcctggttgggttgtagc

SEQ ID NO: 96738 - DNA, 818 bp, Homo sapiens; identical to SEQ ID NO: 31646
  misc_feature 1..818: note = chr7:155241491-155242309
  misc_feature 1..818: note = hyper
  source 1..818: mol_type = genomic DNA

SEQ ID NO: 96739 - DNA, 140 bp, Homo sapiens; identical to SEQ ID NO: 31647
  misc_feature 1..140: note = chr7:155242379-155242519
  misc_feature 1..140: note = hyper
  source 1..140: mol_type = genomic DNA

SEQ ID NO: 96740 - DNA, 835 bp, Homo sapiens
  misc_feature 1..835: note = chr7:155242699-155243534
  misc_feature 1..835: note = hyper
  source 1..835: mol_type = genomic DNA
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattcctgggagatgtggagagcctggggc

SEQ ID NO: 96741 - DNA, 615 bp, Homo sapiens
  misc_feature 1..615: note = chr7:155243755-155244370
  misc_feature 1..615: note = hyper
  source 1..615: mol_type = genomic DNA
cggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcgcgcgtatcccgtttcttcctccca

SEQ ID NO: 96742 - DNA, 30 bp, Homo sapiens
  misc_feature 1..30: note = chr7:155244661-155244691
  misc_feature 1..30: note = hyper
  source 1..30: mol_type = genomic DNA
gaaaggatgggagtgcgtccaaaggtggac

SEQ ID NO: 96743 - DNA, 369 bp, Homo sapiens
  misc_feature 1..369: note = chr7:155246375-155246744
  misc_feature 1..369: note = hyper
  source 1..369: mol_type = genomic DNA
tgggctcagcacaggcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagag

SEQ ID NO: 96744 - DNA, 622 bp, Homo sapiens
  misc_feature 1..622: note = chr7:155246858-155247480
  misc_feature 1..622: note = hyper
  source 1..622: mol_type = genomic DNA
cggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggct

SEQ ID NO: 96745 - DNA, 561 bp, Homo sapiens
  misc_feature 1..561: note = chr7:155247650-155248211
  misc_feature 1..561: note = hyper
  source 1..561: mol_type = genomic DNA
cggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 96746 - DNA, 1690 bp, Homo sapiens
  misc_feature 1..1690: note = chr7:155248614-155250304
  misc_feature 1..1690: note = hyper
  source 1..1690: mol_type = genomic DNA
ctctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcc

SEQ ID NO: 96747 - DNA, 936 bp, Homo sapiens
  misc_feature 1..936: note = chr7:155250323-155251259
  misc_feature 1..936: note = hyper
  source 1..936: mol_type = genomic DNA
cgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacc

SEQ ID NO: 96748 - DNA, 204 bp, Homo sapiens; identical to SEQ ID NO: 31658
  misc_feature 1..204: note = chr7:155251346-155251550
  misc_feature 1..204: note = hyper
  source 1..204: mol_type = genomic DNA

SEQ ID NO: 96749 - DNA, 194 bp, Homo sapiens
  misc_feature 1..194: note = chr7:155251661-155251855
  misc_feature 1..194: note = hyper
  source 1..194: mol_type = genomic DNA
cggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatct

SEQ ID NO: 96750 - DNA, 372 bp, Homo sapiens
  misc_feature 1..372: note = chr7:155251890-155252262
  misc_feature 1..372: note = hyper
  source 1..372: mol_type = genomic DNA
cgacattgtgtgaagctgacgccggcccgggcagcggccaggagtccagcggcaggactgattcgctagggggtacagacttcttaggaccgcagaagggaccttctttctttctctgtctctctctctccttcctctctccctgtctcccctctctgtcttccaccccgccttggcgcatctcttcccagcccctagcccatgtctcccccactgtagttttttttggtgggaacgtggtggctggaagatgggcccggaagtgcacactctcatccccttccctacgatcttccaactcaggccaggccggggacgcatgccccagcccaccccagacttgtcctaccatccggttatcccggctgtgct

SEQ ID NO: 96751 - DNA, 812 bp, Homo sapiens; identical to SEQ ID NO: 31661
  misc_feature 1..812: note = chr7:155252316-155253128
  misc_feature 1..812: note = hyper
  source 1..812: mol_type = genomic DNA

SEQ ID NO: 96752 - DNA, 551 bp, Homo sapiens
  misc_feature 1..551: note = chr7:155254848-155255399
  misc_feature 1..551: note = hyper
  source 1..551: mol_type = genomic DNA
cccacttacatcacacgcagtcctccctcaccaagtggtggaggtccgcgttgagcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggagg

SEQ ID NO: 96753 - DNA, 15 bp, Homo sapiens
  misc_feature 1..15: note = chr7:155256218-155256233
  misc_feature 1..15: note = hyper
  source 1..15: mol_type = genomic DNA
caccaagggcccaac

SEQ ID NO: 96754 - DNA, 151 bp, Homo sapiens; identical to SEQ ID NO: 31664
  misc_feature 1..151: note = chr7:155256268-155256419
  misc_feature 1..151: note = hyper
  source 1..151: mol_type = genomic DNA

SEQ ID NO: 96755 - DNA, 108 bp, Homo sapiens
  misc_feature 1..108: note = chr7:155257081-155257189
  misc_feature 1..108: note = hyper
  source 1..108: mol_type = genomic DNA
ctgagctgggagtcccgctggtctccctgaggactgagggtgaacttcgctctttgccttaaacctctttatttcattgcagtaatagttttacgttgtacataatag

SEQ ID NO: 96756 - DNA, 1008 bp, Homo sapiens; identical to SEQ ID NO: 31665
  misc_feature 1..1008: note = chr7:155257856-155258864
  misc_feature 1..1008: note = hyper
  source 1..1008: mol_type = genomic DNA

SEQ ID NO: 96757 - DNA, 164 bp, Homo sapiens; identical to SEQ ID NO: 735
  misc_feature 1..164: note = chr7:155258914-155259078
  misc_feature 1..164: note = hyper
  source 1..164: mol_type = genomic DNA

SEQ ID NO: 96758 - DNA, 504 bp, Homo sapiens; identical to SEQ ID NO: 736
  misc_feature 1..504: note = chr7:155259119-155259623
  misc_feature 1..504: note = hyper
  source 1..504: mol_type = genomic DNA

SEQ ID NO: 96759 - DNA, 12 bp, Homo sapiens
  misc_feature 1..12: note = chr7:155259833-155259845
  misc_feature 1..12: note = hyper
  source 1..12: mol_type = genomic DNA
cggggattcgcc

SEQ ID NO: 96760 - DNA, 112 bp, Homo sapiens; identical to SEQ ID NO: 738
  misc_feature 1..112: note = chr7:155259846-155259958
  misc_feature 1..112: note = hyper
  source 1..112: mol_type = genomic DNA

SEQ ID NO: 96761 - DNA, 853 bp, Homo sapiens
  misc_feature 1..853: note = chr7:155260038-155260891
  misc_feature 1..853: note = hyper
  source 1..853: mol_type = genomic DNA
cgccggcgggacggagagtggggtcccccggaccctgggtcgggcaggcctggcgctggcagctctgttgcacagatttgtgagcgatgctggtggccgcattgccgcgcggcgcgaaccccaagtagaccattcatgtttttattaataatctcaaacacttcattatatttatgctgcctgcccagagaaaataaaaggccattcttgaaatcgcctgaaatgtaataatattcattaaagcgcctcctaattatgtgatttaatcaagcgtggtgcgcccgcgctctcggctctcgctggaaaggctggcgatgacggttattattactgctgttgttagtggcctcgtgatagcagccggccagctcttcagtccaggcccagtttcctcagagagactcggggagccccactttgagggatggggttccccggaacgactccgaagtcccggagaccaggcgcggcccaggccctctgcccttctccagccccagccccagccccagccccagccccgggcaaactcttccaggccgagggcaggactttctccagacccttggggccctctgtgtcccctggggacgcccgacccggctttctaggagggggaactccgggtcctgagcccgggccccgccccgttggctgttccgccccctccagggctgagccccgcgcaatgcccgaagcagaaacaaagagtcgccgagatctgcctcctgggccgccttttcaccccctcagcctggaaggcgtcccagagaggccccacccccagcctccacggagacccaggagggaagaagagccgggacccggtagccctgaggggctgccgggcctg

SEQ ID NO: 96762 - DNA, 307 bp, Homo sapiens; identical to SEQ ID NO: 31673
  misc_feature 1..307: note = chr7:155261070-155261377
  misc_feature 1..307: note = hyper
  source 1..307: mol_type = genomic DNA

SEQ ID NO: 96763 - DNA, 238 bp, Homo sapiens
  misc_feature 1..238: note = chr7:155262357-155262595
  misc_feature 1..238: note = hyper
  source 1..238: mol_type = genomic DNA
gaggggatggggaggcgaaactctcccaggtgagcctctgcaccccccagcagtggcaccctccacagcccaggtgcggttttcagtagggcccttacaccttcttgcttttcccagccaatgaggcatccacgctgctgcttaggagtaggggaaaggatgtaatgcacgcgagaggcagtgtccacaccgtgagaaaaaagtgggacggtggcaggaggtgcgggagagtgggaca

SEQ ID NO: 96764 - DNA, 277 bp, Homo sapiens
  misc_feature 1..277: note = chr7:155264079-155264356
  misc_feature 1..277: note = hyper
  source 1..277: mol_type = genomic DNA
ttttatatgtagagacgggaacgcgccctgtggattcagagccccaaggaaacaaaaacagcacgtcagaggaagaatgtcatacaaacccgctggagtcacaaggcaaaacagcccccatacctaaacgcccggcgtgacaatggcctttgtgcctggcgccgtcggggggagctgggcgcctagcgggtggggcaggcggaagttggacacatttccacgcaggtgaggccatccatggggtgatgcgggtgttggggctcgctgctttcgctcc

SEQ ID NO: 96765 - DNA, 30 bp, Homo sapiens
  misc_feature 1..30: note = chr7:155275898-155275928
  misc_feature 1..30: note = hyper
  source 1..30: mol_type = genomic DNA
acccaaagtgtacagcgacttttctttctt

SEQ ID NO: 96766 - DNA, 139 bp, Homo sapiens
  misc_feature 1..139: note = chr7:155283645-155283784
  misc_feature 1..139: note = hyper
  source 1..139: mol_type = genomic DNA
cagcacccagcaagccggggctgcctaaaggcctgccacaggggctgggtttctggaatgttctttcatcccctgggagtcctgggctgctccgtccggccctccctccgtgagaaggggaagccgaggcttggatgag

SEQ ID NO: 96767 - DNA, 24 bp, Homo sapiens
  misc_feature 1..24: note = chr7:155300117-155300141
  misc_feature 1..24: note = hyper
  source 1..24: mol_type = genomic DNA
aaatggacctcctatcgaaggagc

SEQ ID NO: 96768 - DNA, 24 bp, Homo sapiens
  misc_feature 1..24: note = chr7:155300201-155300225
  misc_feature 1..24: note = hyper
  source 1..24: mol_type = genomic DNA
acagctccccgaaatgattaaacc

SEQ ID NO: 96769 - DNA, 30 bp, Homo sapiens
  misc_feature 1..30: note = chr7:155301399-155301429
  misc_feature 1..30: note = hyper
  source 1..30: mol_type = genomic DNA
agtcaagttactaaacgcatggtgagcact

SEQ ID NO: 96770 - DNA, 295 bp, Homo sapiens
  misc_feature 1..295: note = chr7:155301710-155302005
  misc_feature 1..295: note = hyper
  source 1..295: mol_type = genomic DNA
cctcaagcttgtagtcgttcattcgctcacagactttctccaaaagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttattacaatgtaacaacgacctgctttacatcattacggggctagcgtaaattccagttt

SEQ ID NO: 96771 - DNA, 588 bp, Homo sapiens
  misc_feature 1..588: note = chr7:155302308-155302896
  misc_feature 1..588: note = hyper
  source 1..588: mol_type = genomic DNA
aagtctggccctccccggggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacagg

SEQ ID NO: 96772 - DNA, 400 bp, Homo sapiens; identical to SEQ ID NO: 31678
  misc_feature 1..400: note = chr7:155302963-155303363
  misc_feature 1..400: note = hyper
  source 1..400: mol_type = genomic DNA

SEQ ID NO: 96773 - DNA, 30 bp, Homo sapiens
  misc_feature 1..30: note = chr7:155309803-155309833
  misc_feature 1..30: note = hypo
  source 1..30: mol_type = genomic DNA
tgaagccctaaaccccgggacctcagaatg

SEQ ID NO: 96774 - DNA, 30 bp, Homo sapiens
  misc_feature 1..30: note = chr7:155314707-155314737
  misc_feature 1..30: note = hypo
  source 1..30: mol_type = genomic DNA
cctagtgggcacaaccgaggttcctctaga

SEQ ID NO: 96775 - DNA, 745 bp, Homo sapiens; identical to SEQ ID NO: 31679
  misc_feature 1..745: note = chr7:155325796-155326541
  misc_feature 1..745: note = hyper
  source 1..745: mol_type = genomic DNA

SEQ ID NO: 96776 - DNA, 67 bp, Homo sapiens
  misc_feature 1..67: note = chr7:155326787-155326854
  misc_feature 1..67: note = hyper
  source 1..67: mol_type = genomic DNA
gtatgtgcactgcagcgggttaggggccccaaaacaggtaagcaggaaaagccgcctttcctttccc

SEQ ID NO: 96777 - DNA, 229 bp, Homo sapiens
  misc_feature 1..229: note = chr7:155363288-155363517
  misc_feature 1..229: note = hypo
  source 1..229: mol_type = genomic DNA
tccacagaacacctccgggtcccgggcactccgggccagcgcaggccccagcagcagggccagcagagccagaggcagcagcatgggccccatgccagctgtgccgccgcacaccggcctccttccaggcccctcacaggcccctccgcgagtgctgggcgtgcagcagacaaatggcatacaaaggtcctcgggccgcaccgccctagatacccgccctgccctgtgg

SEQ ID NO: 96778 - DNA, 103 bp, Homo sapiens
  misc_feature 1..103: note = chr7:155436120-155436223
  misc_feature 1..103: note = hypo
  source 1..103: mol_type = genomic DNA
gcgtgagccaccgcgcccggccagcattttattatacgtaccgttttatcatctcttcacccatccaccaatgcatctcctgtatggacgtcttgattgttaa

SEQ ID NO: 96779 - DNA, 71 bp, Homo sapiens
  misc_feature 1..71: note = chr7:155579858-155579929
  misc_feature 1..71: note = hyper
  source 1..71: mol_type = genomic DNA
ttgttttttgcggaacgtatgtcgtcaggcggtccttctgtccctgccccaaggtaagccccgaggcgtcc

SEQ ID NO: 96780 - DNA, 174 bp, Homo sapiens
  misc_feature 1..174: note = chr7:155580181-155580355
  misc_feature 1..174: note = hyper
  source 1..174: mol_type = genomic DNA
gggccgcccctgtctcgggccctgccgcgccgcccgcccgctgcaggccaggactgcgctctgtctgcccacggcccccgcctggcacacacgctggggacctttcctcagtgctgcctcgacatccgaaggggctgggacgcccgtccctggtgggagcgagcaccggggcgg

SEQ ID NO: 96781 - DNA, 156 bp, Homo sapiens
  misc_feature 1..156: note = chr7:155580726-155580882
  misc_feature 1..156: note = hypo
  source 1..156: mol_type = genomic DNA
ccctcgggcctggaccgtcaatgccggctccgctcacaccatctgtgtccacgcagagggtcgggccgtgggagccgcgagtgtctggcccacacttctgttcttaacctcgcaatgtattcaggtttccccaggcggagcgctcagcatatcgac

SEQ ID NO: 96782 - DNA, 635 bp, Homo sapiens
  misc_feature 1..635: note = chr7:155581242-155581877
  misc_feature 1..635: note = hypo
  source 1..635: mol_type = genomic DNA
cgaagtaacaaagcgacaatcggccttggtcctgcgagggcagggagggcagggagggcagggagggcagggagggcagggagggcagggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtcacagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccaggttgtgtgggtccccacgtggtcaccagcgtcctttcaggacaagagaaaactgagcaggaccagggcttccgcctgccgcattcatctgccccccttcggctgtgccaggtg

SEQ ID NO: 96783 - DNA, 151 bp, Homo sapiens
  misc_feature 1..151: note = chr7:155582218-155582369
  misc_feature 1..151: note = hypo
  source 1..151: mol_type = genomic DNA
ctcacacccgctgggcggcctttgcttcccggtgctggctgtgcccagacgcctgggcttgtgcgtgtttaacccgcccagagactggtgctgccgcatttgttcatcggtttgttttgttttgttttgttttgttttgttttgtttttgt

SEQ ID NO: 96784 - DNA, 156 bp, Homo sapiens; identical to SEQ ID NO: 31682
  misc_feature 1..156: note = chr7:155600567-155600723
  misc_feature 1..156: note = hyper
  source 1..156: mol_type = genomic DNA

SEQ ID NO: 96785 - DNA, 390 bp, Homo sapiens
  misc_feature 1..390: note = chr7:155601020-155601410
  misc_feature 1..390: note = hyper
  source 1..390: mol_type = genomic DNA
agccccccaccccaccgcagctccctcccctggggctgtgccgaagaagctttaaacagcttcccaggagggcagccagggagagggcggcagggtgaggatgacctggcccccagctctgtgagctgcgccacttgggcaggcatggaggaccccgggcagggagacccgggtccagccgggccgcgacgggaggtggctgcgcgagtgaggggcggaggccgagggttgctggagttggcgcccccgccccttgcgccctcctccggcccgggctccgcgcggcctcggctggcggcctctcctccgcccgcgctgggcgggattgtcgcaggcaaagccgggaagcccaggccggttattaattcattgggtcgtgtgccgcgaatc

SEQ ID NO: 96786 - DNA, 263 bp, Homo sapiens
  misc_feature 1..263: note = chr7:155601688-155601951
  misc_feature 1..263: note = hyper
  source 1..263: mol_type = genomic DNA
gagcgtctttcctggcggccccagagcgcacattaaatctatttagtgtagcggctcgggaccccactccaggcttcagatccggccctctggcctcctgccccttaggagccccctggccgccagcaccctcgcctggcacctaggcccgcgcggggagagcgtgtctgtctgcgctttcctctcccgggttaatattaaccggcagctcctgcgttccggaactgctccgaaagttccactggggacgatctcgccatggt

SEQ ID NO: 96787 - DNA, 325 bp, Homo sapiens; identical to SEQ ID NO: 31685
  misc_feature 1..325: note = chr7:155602802-155603127
  misc_feature 1..325: note = hyper
  source 1..325: mol_type = genomic DNA

SEQ ID NO: 96788 - DNA, 98 bp, Homo sapiens
  misc_feature 1..98: note = chr7:155604921-155605019
  misc_feature 1..98: note = hyper
  source 1..98: mol_type = genomic DNA
tcgctccggctcgcccgctcgctctctccctcgctggctgcctcgctctttctcttcctatataaccttgcccgccgcggctgcgggggactctccac

SEQ ID NO: 96789 - DNA, 43 bp, Homo sapiens
  misc_feature 1..43: note = chr7:155605334-155605377
  misc_feature 1..43: note = hyper
  source 1..43: mol_type = genomic DNA
taagataaaggtgggcgggagggaggagcgcatgtcttgtggt

SEQ ID NO: 96790 - DNA, 35 bp, Homo sapiens
  misc_feature 1..35: note = chr7:155623718-155623753
  misc_feature 1..35: note = hypo
  source 1..35: mol_type = genomic DNA
gagaaatcttgtttccgaagcgcctctgcgttccg

SEQ ID NO: 96791 - DNA, 30 bp, Homo sapiens
  misc_feature 1..30: note = chr7:155674904-155674934
  misc_feature 1..30: note = hypo
  source 1..30: mol_type = genomic DNA
gaggcggggcagaggcggagcccacggcgg

SEQ ID NO: 96792 - DNA, 50 bp, Homo sapiens
  misc_feature 1..50: note = chr7:155683057-155683107
  misc_feature 1..50: note = hypo
  source 1..50: mol_type = genomic DNA
gtgtttgggggacaacgccctccgttatttgccctcgcagctgttctagc

SEQ ID NO: 96793 - DNA, 85 bp, Homo sapiens
  misc_feature 1..85: note = chr7:155752508-155752593
  misc_feature 1..85: note = hypo
  source 1..85: mol_type = genomic DNA
tatagtttctgttttcggaggtgagtagctattatgtttcagtgaaagcctgactcagtgaagcggccagcgtgtcttccaatac

SEQ ID NO: 96794 - DNA, 105 bp, Homo sapiens; identical to SEQ ID NO: 41547
  misc_feature 1..105: note = chr7:155753582-155753687
  misc_feature 1..105: note = hypo
  source 1..105: mol_type = genomic DNA

SEQ ID NO: 96795 - DNA, 34 bp, Homo sapiens; identical to SEQ ID NO: 41548
  misc_feature 1..34: note = chr7:155786790-155786824
  misc_feature 1..34: note = hypo
  source 1..34: mol_type = genomic DNA

SEQ ID NO: 96796 - DNA, 35 bp, Homo sapiens
  misc_feature 1..35: note = chr7:155792417-155792452
  misc_feature 1..35: note = hypo
  source 1..35: mol_type = genomic DNA
gagccctaggtatggcgggtcgtgttcaaaaatag

SEQ ID NO: 96797 - DNA, 136 bp, Homo sapiens
  misc_feature 1..136: note = chr7:1557959-1558095
  misc_feature 1..136: note = hypo
  source 1..136: mol_type = genomic DNA
gtcgccatgtgattactgagttggaaccttcactccactccacctacccactcccgaactccagggatggggagctgaagatagggttaaatcacaacggccagtggtttaaccaagcatgcgtatgtcatgagac

SEQ ID NO: 96798 - DNA, 30 bp, Homo sapiens
  misc_feature 1..30: note = chr7:155838899-155838929
  misc_feature 1..30: note = hypo
  source 1..30: mol_type = genomic DNA
ccactagggagaaaccgacccgggatccag

SEQ ID NO: 96799 - DNA, 344 bp, Homo sapiens
  misc_feature 1..344: note = chr7:155854210-155854554
  misc_feature 1..344: note = hypo
  source 1..344: mol_type = genomic DNA
attaatctgtggctccgggacactcttgcttgccctgggatgagtaggggtttcctatggttccctgactgtggacatgagacctgttcccacttcccaccccaaccccatgtgaaaacatcctgatgatatggtcctcctggcccaccgtgattgttcagagaccgccgcgggtgcagagtgcaagggggtgtggtgggaagtgtaccagtggcctctagagctggaccatgcatggtcttttactgcaggaataacatgatccctggggttcactttcctgggccagaagcatggggctgacacacgctcagctctttgtgccaggacgcctgccctcctgt

SEQ ID NO: 96800 - DNA, 215 bp, Homo sapiens
  misc_feature 1..215: note = chr7:155871902-155872117
  misc_feature 1..215: note = hypo
  source 1..215: mol_type = genomic DNA
tgtttccctctggcccgcagcgttgcccatggtgaagacctggttgaaccaagaagccgtggaatcattaggatatcagagtgcagacctgcctgctcccccacactcaggcttcccacaggctccctggatgggcagcccctgctggaattcctccagagcctgaaacgttggccacattacaaagccgcgttctccatcgctgggcacctctg

SEQ ID NO: 96801 - DNA, 141 bp, Homo sapiens
  misc_feature 1..141: note = chr7:155898166-155898307
  misc_feature 1..141: note = hypo
  source 1..141: mol_type = genomic DNA
ttcgtcagagaagcacgaatgcgaaggccgaaagggaagcaagcctggggagctggaaacctgaataagacctgcggggccacatggaggcgaggggaagtcagaagcagtgagggtggagccccgcggagcctgtaagtc

SEQ ID NO: 96802 - DNA, 326 bp, Homo sapiens
  misc_feature 1..326: note = chr7:155898826-155899152
  misc_feature 1..326: note = hypo
  source 1..326: mol_type = genomic DNA
aaggagctatgtttccggccctctcctttcagcttggcttgtgggcggagcagccctggggctccctggtgtgagggtggctccgggctgcgcctgcagacaggctttctgggtccttgcagaaagggcaccggtccttgcagaaagggcccagcaggcagggcaccggtccggcgtaagctcactctcagctttcagttagatcgcagctcctggattgagctgtatacccaaacccagctatatgctctttacaagcacatacaataaagtgacagaaagggatccaaaaagtgtactgggtgcgtgcacggagggaagaggag

SEQ ID NO: 96803 - DNA, 30 bp, Homo sapiens
  misc_feature 1..30: note = chr7:155917143-155917173
  misc_feature 1..30: note = hypo
  source 1..30: mol_type = genomic DNA
gcgacaccggccagacggccagaaaggagg

SEQ ID NO: 96804 - DNA, 34 bp, Homo sapiens
  misc_feature 1..34: note = chr7:155919137-155919171
  misc_feature 1..34: note = hypo
  source 1..34: mol_type = genomic DNA
ctggggagccctctgcgaacgctgccagagacag

SEQ ID NO: 96805 - DNA, 204 bp, Homo sapiens
  misc_feature 1..204: note = chr7:155920367-155920571
  misc_feature 1..204: note = hypo
  source 1..204: mol_type = genomic DNA
gggtagccaaccccccgaaggaaaacacgatggaagtcttcatccttagaacaggaggacaacgggctcgggttgaagcagctgacccggtgctgggaatgagtgagaggaggcgcggcacctgccccggcccgcatggacgcaggcacattagatgccaagtagtagggagccctggttcacttcttacctggctcgctgcaa

SEQ ID NO: 96806 - DNA, 38 bp, Homo sapiens; identical to SEQ ID NO: 41553
  misc_feature 1..38: note = chr7:156012968-156013006
  misc_feature 1..38: note = hypo
  source 1..38: mol_type = genomic DNA

SEQ ID NO: 96807 - DNA, 266 bp, Homo sapiens
  misc_feature 1..266: note = chr7:156025663-156025929
  misc_feature 1..266: note = hypo
  source 1..266: mol_type = genomic DNA
aggtggagtggggaccgtagtgcccagtgtccacattagaaccctgctgttccgtgacccagaaccaggacaggagccacctgtggttcaggtgagggcaagagtccacggagcccggacaggagcggcagagcaggccgcacctcccgggcaccttccggggctgagcacccgaatgcaaatgcgcacccccctgtctgtcgcgggcggcgggcggggtcggggggagcagatgctgtcctctgacgaggcggctgttcttgctg

SEQ ID NO: 96808 - DNA, 30 bp, Homo sapiens
  misc_feature 1..30: note = chr7:156124519-156124549
  misc_feature 1..30: note = hypo
  source 1..30: mol_type = genomic DNA
ggatgactgataagtcgtaggattactaag

SEQ ID NO: 96809 - DNA, 50 bp, Homo sapiens
  misc_feature 1..50: note = chr7:156138347-156138397
  misc_feature 1..50: note = hypo
  source 1..50: mol_type = genomic DNA
ttccttgtttgccagcgagcggggaacagcggcctcgtgctctctcctgt

SEQ ID NO: 96810 - DNA, 197 bp, Homo sapiens
  misc_feature 1..197: note = chr7:156177617-156177814
  misc_feature 1..197: note = hypo
  source 1..197: mol_type = genomic DNA
cacgttttgaagggacgtgccagccgtgttgtgtactcattcgtctccactgctagcaaggtcctgggcacacaggcagcggtcagtaatgtttgtcgaaagaagaaaagttgcccttttgtgaattgcattttagcagtggaggcccctgtaggaacaagccaggtaacctcactgttccacgtcctgtcgggcta

SEQ ID NO: 96811 - DNA, 30 bp, Homo sapiens
  misc_feature 1..30: note = chr7:156240296-156240326
  misc_feature 1..30: note = hypo
  source 1..30: mol_type = genomic DNA
gagcagttgacttcccgtctttctgagcct

SEQ ID NO: 96812 - DNA, 30 bp, Homo sapiens
  misc_feature 1..30: note = chr7:156290677-156290707
  misc_feature 1..30: note = hypo
  source 1..30: mol_type = genomic DNA
tgctgccgatggctgcggtgtctgctgaca

SEQ ID NO: 96813 - DNA, 30 bp, Homo sapiens
  misc_feature 1..30: note = chr7:156397201-156397231
  misc_feature 1..30: note = hypo
  source 1..30: mol_type = genomic DNA
cctccaccaatgcaccggggcttcctcagc

SEQ ID NO: 96814 - DNA, 203 bp, Homo sapiens; identical to SEQ ID NO: 31687
  misc_feature 1..203: note = chr7:156409310-156409513
  misc_feature 1..203: note = hyper
  source 1..203: mol_type = genomic DNA

SEQ ID NO: 96815 - DNA, 108 bp, Homo sapiens; identical to SEQ ID NO: 31688
  misc_feature 1..108: note = chr7:156409727-156409835
  misc_feature 1..108: note = hyper
  source 1..108: mol_type = genomic DNA

SEQ ID NO: 96816 - DNA, 257 bp, Homo sapiens
  misc_feature 1..257: note = chr7:156432918-156433175
  misc_feature 1..257: note = hyper
  source 1..257: mol_type = genomic DNA
ccagaaaactgccctcgactaacagcgcagcgaaggggcggtgcgctcgagaccctggaacgggaacgaccacagccaccgcagggaaacaaccggggcccaggcccaggtgggcgggcggctgaggagcgtggctgcgcccacaaagccgccgggggctgcggactacagcgaagccggcgcggggctcggccctcactacacgaggcctgggcgcctgcacgcccccgtgcttcagcccgcggctcccgaacacc

SEQ ID NO: 96817 - DNA, 30 bp, Homo sapiens
  misc_feature 1..30: note = chr7:156507056-156507086
  misc_feature 1..30: note = hypo
  source 1..30: mol_type = genomic DNA
ggttttgccggagaacggctggtgaagaaa

SEQ ID NO: 96818 - DNA, 126 bp, Homo sapiens
  misc_feature 1..126: note = chr7:156701793-156701919
  misc_feature 1..126: note = hyper
  source 1..126: mol_type = genomic DNA
cgccggcgactcactgcgccaggccgggccaccgtgcagaacgcgcgcggatctcacaccccaccatgcggaacgcgcgcgggtcacacaccgcaccgtacggaacacaggcggatcatgattcgt

SEQ ID NO: 96819 - DNA, 105 bp, Homo sapiens; identical to SEQ ID NO: 41557
  misc_feature 1..105: note = chr7:156744694-156744799
  misc_feature 1..105: note = hypo
  source 1..105: mol_type = genomic DNA

SEQ ID NO: 96820 - DNA, 30 bp, Homo sapiens
  misc_feature 1..30: note = chr7:156778228-156778258
  misc_feature 1..30: note = hypo
  source 1..30: mol_type = genomic DNA
tgtgggaacagcagacggggcccctgggtg

SEQ ID NO: 96821 - DNA, 87 bp, Homo sapiens; identical to SEQ ID NO: 31690
  misc_feature 1..87: note = chr7:156794072-156794159
  misc_feature 1..87: note = hyper
  source 1..87: mol_type = genomic DNA

SEQ ID NO: 96822 - DNA, 26 bp, Homo sapiens
  misc_feature 1..26: note = chr7:156794459-156794485
  misc_feature 1..26: note = hyper
  source 1..26: mol_type = genomic DNA
gtaagccactgcgcccagcctgattt

SEQ ID NO: 96823 - DNA, 357 bp, Homo sapiens
  misc_feature 1..357: note = chr7:156794998-156795355
  misc_feature 1..357: note = hyper
  source 1..357: mol_type = genomic DNA
cacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 96824 - DNA, 235 bp, Homo sapiens; identical to SEQ ID NO: 745
  misc_feature 1..235: note = chr7:156795401-156795636
  misc_feature 1..235: note = hyper
  source 1..235: mol_type = genomic DNA

SEQ ID NO: 96825 - DNA, 205 bp, Homo sapiens; identical to SEQ ID NO: 31694
  misc_feature 1..205: note = chr7:156795899-156796104
  misc_feature 1..205: note = hyper
  source 1..205: mol_type = genomic DNA

SEQ ID NO: 96826 - DNA, 246 bp, Homo sapiens; identical to SEQ ID NO: 747
  misc_feature 1..246: note = chr7:156796494-156796740
  misc_feature 1..246: note = hyper
  source 1..246: mol_type = genomic DNA

SEQ ID NO: 96827 - DNA, 1430 bp, Homo sapiens; identical to SEQ ID NO: 31696
  misc_feature 1..1430: note = chr7:156797005-156798435
  misc_feature 1..1430: note = hyper
  source 1..1430: mol_type = genomic DNA

SEQ ID NO: 96828 - DNA, 621 bp, Homo sapiens; identical to SEQ ID NO: 750
  misc_feature 1..621: note = chr7:156798526-156799147
  misc_feature 1..621: note = hyper
  source 1..621: mol_type = genomic DNA

SEQ ID NO: 96829 - DNA, 220 bp, Homo sapiens; identical to SEQ ID NO: 31698
  misc_feature 1..220: note = chr7:156799290-156799510
  misc_feature 1..220: note = hyper
  source 1..220: mol_type = genomic DNA

SEQ ID NO: 96830 - DNA, 225 bp, Homo sapiens
  misc_feature 1..225: note = chr7:156800853-156801078
  misc_feature 1..225: note = hyper
  source 1..225: mol_type = genomic DNA
tgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgag

SEQ ID NO: 96831 - DNA, 469 bp, Homo sapiens; identical to SEQ ID NO: 31700
  misc_feature 1..469: note = chr7:156801403-156801872
  misc_feature 1..469: note = hyper
  source 1..469: mol_type = genomic DNA

SEQ ID NO: 96832 - DNA, 221 bp, Homo sapiens
  misc_feature 1..221: note = chr7:156801943-156802164
  misc_feature 1..221: note = hyper
  source 1..221: mol_type = genomic DNA
cgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccatttta

SEQ ID NO: 96833 - DNA, 124 bp, Homo sapiens
  misc_feature 1..124: note = chr7:156802413-156802537
  misc_feature 1..124: note = hyper
  source 1..124: mol_type = genomic DNA
ccagctggaaggtgccggcgcccagcttgatggggtcggcggggtgcgcggggtgcgcgccttgcacctgcgggtacgagtaggagagcgccgggtgctggcccgccagcgcagccgccgccgc

SEQ ID NO: 96834 - DNA, 74 bp, Homo sapiens
  misc_feature 1..74: note = chr7:156803722-156803796
  misc_feature 1..74: note = hyper
  source 1..74: mol_type = genomic DNA
ccctggagccagctgcgcgcgtcctctccggcctccttgtcggcgctggagtgggtccacgtctgccttgcgga

SEQ ID NO: 96835 - DNA, 655 bp, Homo sapiens
  misc_feature 1..655: note = chr7:156808858-156809513
  misc_feature 1..655: note = hyper
  source 1..655: mol_type = genomic DNA
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtggctgaaagagagagagagagagagagacctcctcttaggccacttcccagagctgtggcagtgggggagggggaattccccaggatggtgtttgtggtcaagttcacctctggcaaccctgcctaagctcttctcacaggtgcacgcattcaagtcctgaagagccctccccgcccccaacagtgttcatgtcccgggctgggggcccgcctgggaggggctctatatgc

SEQ ID NO: 96836 - DNA, 11 bp, Homo sapiens
  misc_feature 1..11: note = chr7:156809643-156809654
  misc_feature 1..11: note = hyper
  source 1..11: mol_type = genomic DNA
cgctgcttagc

SEQ ID NO: 96837 - DNA, 485 bp, Homo sapiens; identical to SEQ ID NO: 31702
  misc_feature 1..485: note = chr7:156810037-156810522
  misc_feature 1..485: note = hyper
  source 1..485: mol_type = genomic DNA

SEQ ID NO: 96838 - DNA, 204 bp, Homo sapiens; identical to SEQ ID NO: 754
  misc_feature 1..204: note = chr7:156810597-156810801
  misc_feature 1..204: note = hyper
  source 1..204: mol_type = genomic DNA

SEQ ID NO: 96839 - DNA, 724 bp, Homo sapiens
  misc_feature 1..724: note = chr7:156811302-156812026
  misc_feature 1..724: note = hyper
  source 1..724: mol_type = genomic DNA
cgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgaggttcgcagaggggctgacagcgtggccccccttaactccgagcaccacgacccggatgcacataactgtgtccggaaacttctctttctctgcaggtggagcagcgcctgtgcggctccgcgctatggctccaaggctccggccctggcgtctgggctcggtcggggacagtttccacgcgaggcggagcctagctggaggtcacagggcggtggagagcgagggcatgagggagggagctgggaaccgcgcagtgtccgcggccacgaatctctcctacgcgtccccatgaggcgacctaaggggaag

SEQ ID NO: 96840 - DNA, 37 bp, Homo sapiens; identical to SEQ ID NO: 31706
  misc_feature 1..37: note = chr7:156812242-156812279
  misc_feature 1..37: note = hyper
  source 1..37: mol_type = genomic DNA

SEQ ID NO: 96841 - DNA, 1038 bp, Homo sapiens; identical to SEQ ID NO: 31707
  misc_feature 1..1038: note = chr7:156812788-156813826
  misc_feature 1..1038: note = hyper
  source 1..1038: mol_type = genomic DNA

SEQ ID NO: 96842 - DNA, 244 bp, Homo sapiens; identical to SEQ ID NO: 757
  misc_feature 1..244: note = chr7:156813986-156814230
  misc_feature 1..244: note = hyper
  source 1..244: mol_type = genomic DNA

SEQ ID NO: 96843 - DNA, 30 bp, Homo sapiens
  misc_feature 1..30: note = chr7:156815392-156815422
  misc_feature 1..30: note = hyper
  source 1..30: mol_type = genomic DNA
agcttctattgtctacgtacgggttaaagg

SEQ ID NO: 96844 - DNA, 209 bp, Homo sapiens
  misc_feature 1..209: note = chr7:156832193-156832402
  misc_feature 1..209: note = hypo
  source 1..209: mol_type = genomic DNA
atgaaaccaaaacagaatgtcagctaaaccaggtcacattccccacggcgagtctgctcagatggccccgaccgagtaccaagacacatccttgaaacgacagaaatctgttctcacagttctggggctgcaagttggagatccaggtgtgggtagggcctgctccctccagacgttcttggggatcgtcccgccgcctctcccagctc

SEQ ID NO: 96845 - DNA, 500 bp, Homo sapiens
  misc_feature 1..500: note = chr7:156832680-156833180
  misc_feature 1..500: note = hypo
  source 1..500: mol_type = genomic DNA
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtttgggcatctgggagacgggaactccttcccgggaggaagaccgtgagggaggcgtggaagtggatgtgagccggtgtgcactgggctgcagtgcgcgctgctgggccggtccgggagcccacactgttgggtgctggctgctagaagcccacagcaggggcccgaggcccaccccctagcctcagggcacagcttcccctgtccagccaaggctgccttacccaagccctggtcctgcctgttccgtgccttctcccgcaaggcttcttcaacagcacaccgcgaaaacgtgcaggcatcgcccccagcacaagggtcgctgctagggaagc

SEQ ID NO: 96846 - DNA, 141 bp, Homo sapiens
  misc_feature 1..141: note = chr7:156871012-156871153
  misc_feature 1..141: note = hyper
  source 1..141: mol_type = genomic DNA
gggctcccctaaatccgaagctatcccctgccctcccttcctcgcgtggcttcccgggcgcgctctgcctgtctgcggggactccaggcgtccttgtgttttcagctcccggctcttgcccgcgcgtgtggcccggctggg

SEQ ID NO: 96847 - DNA, 70 bp, Homo sapiens
  misc_feature 1..70: note = chr7:156871282-156871352
  misc_feature 1..70: note = hyper
  source 1..70: mol_type = genomic DNA
cgagctccagaggcgggggatctgaacactggcctgtgaaccccgagaaaacccccggtttgcagaccag

SEQ ID NO: 96848 - DNA, 68 bp, Homo sapiens; identical to SEQ ID NO: 41560
  misc_feature 1..68: note = chr7:156880531-156880599
  misc_feature 1..68: note = hypo
  source 1..68: mol_type = genomic DNA

SEQ ID NO: 96849 - DNA, 411 bp, Homo sapiens
  misc_feature 1..411: note = chr7:156883232-156883643
  misc_feature 1..411: note = hypo
  source 1..411: mol_type = genomic DNA
cacctggggcagcctcgaggcggctggactcagcacgcaggcccccgggctcttgtgtggccgtagggacttgcccagggagtcagcctggctgaccagccctgcctcaccctcccccaggaccccaaggtcaggggcgcctggcctgggccctggacgtcattctgaggactcagtgccagccttgcagctagcaggggcaagaccagccaactgcgttttggggacacggtggccctgagaacagcatctcaggggacgcaggctgagacaggacaggagctgtgcagggtgggacaccgcaggtaagggcagggactgccaggatgagctgccttgcggctgacaccgtgactttcgggtggcacagaagctgtaggcatcagcggagagcagcgcaaagtggacagc

SEQ ID NO: 96850 - DNA, 31 bp, Homo sapiens
  misc_feature 1..31: note = chr7:156922797-156922828
  misc_feature 1..31: note = hypo
  source 1..31: mol_type = genomic DNA
agtcaccgcgcccggccggatgttatcttac

SEQ ID NO: 96851 - DNA, 47 bp, Homo sapiens
  misc_feature 1..47: note = chr7:156924103-156924150
  misc_feature 1..47: note = hypo
  source 1..47: mol_type = genomic DNA
cggagctctgatgcccgcagacagaagatgaacgtcccagctcaaga

SEQ ID NO: 96852 - DNA, 21 bp, Homo sapiens
  misc_feature 1..21: note = chr7:156929628-156929649
  misc_feature 1..21: note = hypo
  source 1..21: mol_type = genomic DNA
ttatttattttgagacggagt

SEQ ID NO: 96853 - DNA, 30 bp, Homo sapiens
  misc_feature 1..30: note = chr7:157074398-157074428
  misc_feature 1..30: note = hypo
  source 1..30: mol_type = genomic DNA
gggtggggacaaaggcggggaccaaaaagc

SEQ ID NO: 96854 - DNA, 219 bp, Homo sapiens
  misc_feature 1..219: note = chr7:157075184-157075403
  misc_feature 1..219: note = hypo
  source 1..219: mol_type = genomic DNA
cctcggtgcgttccccgggctgcgtgggccatggcggataacccgcctgaccccttccactcggctgtcggtacccacctgtcagccccacctgcgtgtccccctggaaggcagggcccgagtctcacccactctgcacgtcagggcctcacccagcagcaataaatgtttgttgaatgaacaaggaggctaatacagccggggcggggctgggggggt

SEQ ID NO: 96855 - DNA, 113 bp, Homo sapiens
  misc_feature 1..113: note = chr7:157082014-157082127
  misc_feature 1..113: note = hypo
  source 1..113: mol_type = genomic DNA
tggggtccctccccacgactgccatccgcaggggcacggggacaagagtgagagtagcctctgctgctgcttgcaaagccctggaaaaagccagaccccggcagagtcaagag

SEQ ID NO: 96856 - DNA, 212 bp, Homo sapiens
  misc_feature 1..212: note = chr7:157084410-157084622
  misc_feature 1..212: note = hypo
  source 1..212: mol_type = genomic DNA
caggccttcagagaccgcgcgcctggaggagcgtttggcatcactcaacactaaagtgcaaacgtgggctccaagagcaagtcaagggtgttaccagctgggctctgggagcaaagacaaaggccagtggcctcccacccgccgtggcaggacaagcagagtgtggtctccacgcaagaggctggagcctgcagacccgggagggccccggg

SEQ ID NO: 96857 - DNA, 291 bp, Homo sapiens
  misc_feature 1..291: note = chr7:157085343-157085634
  misc_feature 1..291: note = hypo
  source 1..291: mol_type = genomic DNA
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcaggctccaggacacagcctcaccctatcagggcagcgagggctggggcggacaggggagccgtagacagcccgtccctgggtgggcctggccttcccggccctgactcagcgtgaaggggcagacagggcgcggccgcccacggggattc

SEQ ID NO: 96858 - DNA, 221 bp, Homo sapiens; identical to SEQ ID NO: 41567
  misc_feature 1..221: note = chr7:157085926-157086147
  misc_feature 1..221: note = hypo
  source 1..221: mol_type = genomic DNA

SEQ ID NO: 96859 - DNA, 71 bp, Homo sapiens; identical to SEQ ID NO: 41568
  misc_feature 1..71: note = chr7:157099869-157099940
  misc_feature 1..71: note = hypo
  source 1..71: mol_type = genomic DNA

SEQ ID NO: 96860 - DNA, 27 bp, Homo sapiens
  misc_feature 1..27: note = chr7:157110643-157110670
  misc_feature 1..27: note = hypo
  source 1..27: mol_type = genomic DNA
ggcatgagccaccgcacccagcccact

SEQ ID NO: 96861 - DNA, 211 bp, Homo sapiens
  misc_feature 1..211: note = chr7:157129074-157129285
  misc_feature 1..211: note = hyper
  source 1..211: mol_type = genomic DNA
gtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccaccca

SEQ ID NO: 96862 - DNA, 49 bp, Homo sapiens; identical to SEQ ID NO: 31712
  misc_feature 1..49: note = chr7:157130967-157131016
  misc_feature 1..49: note = hyper
  source 1..49: mol_type = genomic DNA

SEQ ID NO: 96863 - DNA, 41 bp, Homo sapiens
  misc_feature 1..41: note = chr7:157147812-157147853
  misc_feature 1..41: note = hypo
  source 1..41: mol_type = genomic DNA
gccttgagcctttagcgttcccgtagtttcttttatttatt

SEQ ID NO: 96864 - DNA, 30 bp, Homo sapiens
  misc_feature 1..30: note = chr7:157151821-157151851
  misc_feature 1..30: note = hypo
  source 1..30: mol_type = genomic DNA
cacagaaggctctcacggtaaccttagtct

SEQ ID NO: 96865 - DNA, 59 bp, Homo sapiens
  misc_feature 1..59: note = chr7:157200748-157200807
  misc_feature 1..59: note = hypo
  source 1..59: mol_type = genomic DNA
ttctgcaggtgagcacgtggagttcccaaggggagaactggccccgggctaggtgaccc

SEQ ID NO: 96866 - DNA, 48 bp, Homo sapiens; identical to SEQ ID NO: 41570
  misc_feature 1..48: note = chr7:157217366-157217414
  misc_feature 1..48: note = hypo
  source 1..48: mol_type = genomic DNA

SEQ ID NO: 96867 - DNA, 102 bp, Homo sapiens
  misc_feature 1..102: note = chr7:157217837-157217939
  misc_feature 1..102: note = hypo
  source 1..102: mol_type = genomic DNA
aggggtgaaggccaccgctgttgcctgtgaagtagactcaggagcacggagccccctgtgagcccagagggccctggctgactggcacgtgggtcccaggca

SEQ ID NO: 96868 - DNA, 232 bp, Homo sapiens
  misc_feature 1..232: note = chr7:157218481-157218713
  misc_feature 1..232: note = hypo
  source 1..232: mol_type = genomic DNA
gaggctcaattcagccggatgtttgtgctcacgtgctcacagcggcactggccatggcagctggggagggagtggatcccgtgtgcgggtgcagagatggatgtgctccctgcgcagtggggctgcgttcagccctccagaggacgggctctgatgtgctgcccgtggacccgccctgtggacacggtgagacccgccctgtggacacggtgagacccgacagtcaggaaag

SEQ ID NO: 96869 - DNA, 153 bp, Homo sapiens
  misc_feature 1..153: note = chr7:157220472-157220625
  misc_feature 1..153: note = hypo
  source 1..153: mol_type = genomic DNA
tttgctttggggacccgcctgggtggacctgtcccggatctccgtccgggtctgcctgtggagtacctggcatctctgccgaggcctggggtgcccctgactggctccttgccaggggaggaggcctggggggacccccgggggctgctgagg

SEQ ID NO: 96870 - DNA, 58 bp, Homo sapiens
  misc_feature 1..58: note = chr7:157233964-157234022
  misc_feature 1..58: note = hypo
  source 1..58: mol_type = genomic DNA
ccctccactgtggaccgcagagtaatggccctgatgacgatcacgtctcagccccaga

SEQ ID NO: 96871 - DNA, 123 bp, Homo sapiens
  misc_feature 1..123: note = chr7:157235673-157235796
  misc_feature 1..123: note = hypo
  source 1..123: mol_type = genomic DNA
tgggtcccttgcattcgcaattcacaatggggttctctcccctgtgagactccagtgctgcagctgatctgccgggaggcggggctcaggctctaatgcttgcggcaccgccactcacctcct

SEQ ID NO: 96872 - DNA, 178 bp, Homo sapiens
  misc_feature 1..178: note = chr7:157239495-157239673
  misc_feature 1..178: note = hypo
  source 1..178: mol_type = genomic DNA
ccatgcccctaaccccgcacccaactccagccctcaacaacccctcattggctttctgtccccatgagttgtgggttctggggactttctggagaatgggatcatacagcatgggtgcctgcatgccgggggccctcctcatcctggctttaaggttcacctacgtcatagcatgtgc

SEQ ID NO: 96873 - DNA, 261 bp, Homo sapiens; identical to SEQ ID NO: 31061
  misc_feature 1..261: note = chr7:15725085-15725346
  misc_feature 1..261: note = hyper
  source 1..261: mol_type = genomic DNA

SEQ ID NO: 96874 - DNA, 261 bp, Homo sapiens; identical to SEQ ID NO: 41575
  misc_feature 1..261: note = chr7:157255061-157255322
  misc_feature 1..261: note = hypo
  source 1..261: mol_type = genomic DNA

SEQ ID NO: 96875 - DNA, 570 bp, Homo sapiens
  misc_feature 1..570: note = chr7:15725636-15726206
  misc_feature 1..570: note = hyper
  source 1..570: mol_type = genomic DNA
agttggagcacaggacgggcgggctgctccccaactctgggggccctccagagtcgggctggaggcagaggctgtgccgagccgcactcggtggggaagacatctgcgggaggtgccagttggtttgcagagcctggtgctgctgctgctgatggtggtgatggtggtggtggtggtggtggtggtggtgccccctgtgatgctggctggcaaacatgccctcttcgttggggtatcccgcgattatgcaagatgaggaagaagtagagagctcggggtaagacatatggtcagatcttccatggagggcgagagaggattgggagaacgggtgcaagccttgcgccgtggcgtgagggctgcgcaggcagccaaagagcgggtgttccatagcatgcaagtttcgggttccaggcagaagacttcacggcggttccaaaggccaccaccctctgtcactttttcactggaaaccgtgtgattttttttttaacctcccaaagcaatagcggtgcacttctgcagagctcggataatcccggtcctgagccccagcggccagtctccttt

SEQ ID NO: 96876 - DNA, 30 bp, Homo sapiens
  misc_feature 1..30: note = chr7:157261056-157261086
  misc_feature 1..30: note = hypo
  source 1..30: mol_type = genomic DNA
ctggaacgttgtctccgaggctcagcagcc

SEQ ID NO: 96877 - DNA, 944 bp, Homo sapiens
  misc_feature 1..944: note = chr7:157262527-157263471
  misc_feature 1..944: note = hypo
  source 1..944: mol_type = genomic DNA
agcccagcagtcacccggggtggggtcaactctggaaggcccctgtgtgttgactccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggagtctgtggg

SEQ ID NO: 96878 - DNA, 620 bp, Homo sapiens
  misc_feature 1..620: note = chr7:15726457-15727077
  misc_feature 1..620: note = hyper
  source 1..620: mol_type = genomic DNA
tggacggacgtagagcgtccacgcccgcccagcactgccggctgccaggactacaagcggcacgccaacgtctaagtcccgcccgggagggcagcagctctgccctccagactctggaggcctgggcgcggcgcacaccacccccaacctagcaccctgattcctacctactcactttcctctcggggaaacgtgacttgtcagtgtcatttgggaactgtcacctgcagaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggaggctcccttccccctctttcccggtcccgctcaatttcctag

SEQ ID NO: 96879 - DNA, 17 bp, Homo sapiens
  misc_feature 1..17: note = chr7:157271529-157271546
  misc_feature 1..17: note = hypo
  source 1..17: mol_type = genomic DNA
ggcgtgaaccaccgcgc

SEQ ID NO: 96880 - DNA, 30 bp, Homo sapiens
  misc_feature 1..30: note = chr7:157271776-157271806
  misc_feature 1..30: note = hypo
  source 1..30: mol_type = genomic DNA
tggtggaagaaaacccgtgtatcagtggac

SEQ ID NO: 96881 - DNA, 54 bp, Homo sapiens; identical to SEQ ID NO: 31064
  misc_feature 1..54: note = chr7:15727290-15727344
  misc_feature 1..54: note = hyper
  source 1..54: mol_type = genomic DNA

SEQ ID NO: 96882 - DNA, 92 bp, Homo sapiens
  misc_feature 1..92: note = chr7:157274739-157274831
  misc_feature 1..92: note = hypo
  source 1..92: mol_type = genomic DNA
cctgttgtattgtgtcgtgtgttgtgttgtgtgtgtgttgtgtgttgtgtcatgtatgtgatgtgtgttatgtgcgtcgtgtgtcgtgtcat

SEQ ID NO: 96883 - DNA, 53 bp, Homo sapiens
  misc_feature 1..53: note = chr7:157276004-157276057
  misc_feature 1..53: note = hypo
  source 1..53: mol_type = genomic DNA
ttgcttctactgccacggggctgtttttaattcccgagcgttcttttgggtgt

SEQ ID NO: 96884 - DNA, 158 bp, Homo sapiens
  misc_feature 1..158: note = chr7:157276262-157276420
  misc_feature 1..158: note = hypo
  source 1..158: mol_type = genomic DNA
ctcatgggccccttgcggacacccacttgggaacctcacggttcagatccagggacctgctccccgggagtccagcgtccttgcaggggcctgcgatgccttgtgcggcctgggccgtgctgcttggcgtctgcacgcaatggcgagggctcccggct

SEQ ID NO: 96885 - DNA, 256 bp, Homo sapiens
  misc_feature 1..256: note = chr7:157277538-157277794
  misc_feature 1..256: note = hypo
  source 1..256: mol_type = genomic DNA
acgtctccagcgtcccgatgttgtgacttgagcgcttgtgagctctgattgtggctgtcgtgttggagatgcagtccccggacgtgagacctgtgcctgggggtgcacagctgacccagccctgctggggtgtagcctccctctgagcagaagggtgggttcaccgggggctctctgctgagtccacacatgcagccaggcctctccttctcctgtgcaagtgtgtaggaagagaagaagccgctgagggtcagcc

SEQ ID NO: 96886 - DNA, 174 bp, Homo sapiens
  misc_feature 1..174: note = chr7:157280193-157280367
  misc_feature 1..174: note = hypo
  source 1..174: mol_type = genomic DNA
gagcccgagttcccacgcaggggagatgaagaccagggcgggcaggggcctggcccaggttctggagaagcaaggggtgcttctcggatatcacggtggatgagagtgacccagagtcgttaaccagagtgtctatgcggccgtgacgaggcgtggactcggctgtccccatca

SEQ ID NO: 96887 - DNA, 170 bp, Homo sapiens
  misc_feature 1..170: note = chr7:157280604-157280774
  misc_feature 1..170: note = hypo
  source 1..170: mol_type = genomic DNA
ggcacacgggagagccggggagggcacacgggagagccggggagggcacacgggagagccggggagggaacacgggagagccggggagagcacacgggagagccggggcggcacacgggagagcagatgaaggtaatacatgcagtggcccagctcgggggtgtggattc

SEQ ID NO: 96888 - DNA, 409 bp, Homo sapiens
  misc_feature 1..409: note = chr7:157291421-157291830
  misc_feature 1..409: note = hypo
  source 1..409: mol_type = genomic DNA
tgggcctggtgaagacgggcacaaaacagcagcagtgaaacacaaagtgaatcgaattagtcactactcaggcctggggcctcagctggaaatgaccttcagaattcaacggaggaggcccttcgtgggagacaaagaaggatggggcgtcattgtgggagctttaacgctgcacaaaggacgatcaggaggtggcaatgcatgtgtgacctgcgccgggcagggagggaggctctcaagaggcctctgcgcagggcggtgccctgtgtgcctctggaaatgaggcagaatttgtggtgacatcatgcccagtcttcctgccaacaaaagagtgtatcaggttggaagtgagttttccatttcataggagagtgggggtatggcaggagtccctcggaaatagtggagt

SEQ ID NO: 96889 - DNA, 230 bp, Homo sapiens
  misc_feature 1..230: note = chr7:157294091-157294321
  misc_feature 1..230: note = hypo
  source 1..230: mol_type = genomic DNA
tgggcagatgctctgcgtgcgggaggctgcgctttcagtcattatttggatttcgttttccacatgaaaatatttagagatccagctcttggaagccaaggagaaactggcttttaaggtaaaggaaggcaagtttgccgaggtgatgggaagacaccttgcaactgcgaaacctccaaatttaccggtagaacctggcacacagcttttgccgtcgtttggagaattac

SEQ ID NO: 96890 - DNA, 30 bp, Homo sapiens
  misc_feature 1..30: note = chr7:157314286-157314316
  misc_feature 1..30: note = hypo
  source 1..30: mol_type = genomic DNA
ggctggtgggagccgcgggccagagggtgg

SEQ ID NO: 96891 - DNA, 30 bp, Homo sapiens
  misc_feature 1..30: note = chr7:157318443-157318473
  misc_feature 1..30: note = hypo
  source 1..30: mol_type = genomic DNA
cagggaaaagagggccgtgtgcagtgtcgc

SEQ ID NO: 96892 - DNA, 227 bp, Homo sapiens
  misc_feature 1..227: note = chr7:157319475-157319702
  misc_feature 1..227: note = hypo
  source 1..227: mol_type = genomic DNA
caggcctcccaagaccgcttcacacttctgtgccgaccaggccaccagccagcgttgcctcttgcagaccactcggccgctagtggggtgcgcacagcagcaggctttctgtacccagagaggcggcagcaggagagccacagagagcacgggagcttctccacctcgcctggcccctcacgtgcggagcacgtcccctccagactgaagggcgcacatcttgggct

SEQ ID NO: 96893 - DNA, 30 bp, Homo sapiens
  misc_feature 1..30: note = chr7:157320033-157320063
  misc_feature 1..30: note = hypo
  source 1..30: mol_type = genomic DNA
tgagggttttttcttcgtgctctccctgat

SEQ ID NO: 96894 - DNA, 63 bp, Homo sapiens
  misc_feature 1..63: note = chr7:157320767-157320830
  misc_feature 1..63: note = hypo
  source 1..63: mol_type = genomic DNA
ttcagggttaggccccggaacctcacacatgagggctcagaacacccacgagaggtgggaatc

SEQ ID NO: 96895 - DNA, 30 bp, Homo sapiens
  misc_feature 1..30: note = chr7:157332948-157332978
  misc_feature 1..30: note = hypo
  source 1..30: mol_type = genomic DNA
aagagaaatgccaaacgtgccttgtgtgcc

SEQ ID NO: 96896 - DNA, 30 bp, Homo sapiens
  misc_feature 1..30: note = chr7:157334100-157334130
  misc_feature 1..30: note = hypo
  source 1..30: mol_type = genomic DNA
gcacccctccctccacggacagcctgccga

SEQ ID NO: 96897 - DNA, 71 bp, Homo sapiens
  misc_feature 1..71: note = chr7:157336122-157336193
  misc_feature 1..71: note = hypo
  source 1..71: mol_type = genomic DNA
gtccacgctggacagcgagtgggaacgccccttctcaggctgtcctgggacaaccacggggtgcccacata

SEQ ID NO: 96898 - DNA, 142 bp, Homo sapiens; identical to SEQ ID NO: 41584
  misc_feature 1..142: note = chr7:157337964-157338106
  misc_feature 1..142: note = hypo
  source 1..142: mol_type = genomic DNA

SEQ ID NO: 96899 - DNA, 83 bp, Homo sapiens; identical to SEQ ID NO: 41585
  misc_feature 1..83: note = chr7:157338308-157338391
  misc_feature 1..83: note = hypo
  source 1..83: mol_type = genomic DNA

SEQ ID NO: 96900 - DNA, 30 bp, Homo sapiens
  misc_feature 1..30: note = chr7:157340396-157340426
  misc_feature 1..30: note = hypo
  source 1..30: mol_type = genomic DNA
gcctccagacacacacgcctcagtgggtgt

SEQ ID NO: 96901 - DNA, 156 bp, Homo sapiens
  misc_feature 1..156: note = chr7:157341515-157341671
  misc_feature 1..156: note = hypo
  source 1..156: mol_type = genomic DNA
tcagagcagagcaatcggtgtgcggctcacattaaaccaggccctccccgtgctcctctcaggaacacggccgcagagaggcaccttgaatgggtctgcgtcccggaggagagactgacagtaccttcgtctggaccatgccgggtctctggtccc

SEQ ID NO: 96902 - DNA, 88 bp, Homo sapiens
  misc_feature 1..88: note = chr7:157346653-157346741
  misc_feature 1..88: note = hypo
  source 1..88: mol_type = genomic DNA
tacggccaggccgggcgccggatcctgcccgctctcgtgccctcctgggcatgggtgcggccaggccgggcgccggatcctgcccgct

SEQ ID NO: 96903 - DNA, 155 bp, Homo sapiens
  misc_feature 1..155: note = chr7:157346979-157347134
  misc_feature 1..155: note = hypo
  source 1..155: mol_type = genomic DNA
tgggtgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataa

SEQ ID NO: 96904 - DNA, 47 bp, Homo sapiens
  misc_feature 1..47: note = chr7:157347797-157347844
  misc_feature 1..47: note = hypo
  source 1..47: mol_type = genomic DNA
agacaccaggctctgcgtgctccgctggcacccgaatggccactggg

SEQ ID NO: 96905 - DNA, 30 bp, Homo sapiens
  misc_feature 1..30: note = chr7:157348767-157348797
  misc_feature 1..30: note = hypo
  source 1..30: mol_type = genomic DNA
tggcagagcaaaactcggctcaaggtaact

SEQ ID NO: 96906 - DNA, 76 bp, Homo sapiens
  misc_feature 1..76: note = chr7:157350791-157350867
  misc_feature 1..76: note = hypo
  source 1..76: mol_type = genomic DNA
gttaaaagggaaagacgaatacgatggctccacaattccgagtcctatctgtgtgtgaacacgtgcacattggtgc

SEQ ID NO: 96907 - DNA, 149 bp, Homo sapiens
  misc_feature 1..149: note = chr7:157352962-157353111
  misc_feature 1..149: note = hypo
  source 1..149: mol_type = genomic DNA
tacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcg

SEQ ID NO: 96908 - DNA, 48 bp, Homo sapiens
  misc_feature 1..48: note = chr7:157361605-157361653
  misc_feature 1..48: note = hyper
  source 1..48: mol_type = genomic DNA
tgttgagaaccatgtcgatcaggacgtaggtgccgctccggcctgcac

SEQ ID NO: 96909 - DNA, 39 bp, Homo sapiens
  misc_feature 1..39: note = chr7:157367437-157367476
  misc_feature 1..39: note = hypo
  source 1..39: mol_type = genomic DNA
tctcacctttcctgtcgctgaaatcggggtggctatttt

SEQ ID NO: 96910 - DNA, 319 bp, Homo sapiens
  misc_feature 1..319: note = chr7:157370470-157370789
  misc_feature 1..319: note = hypo
  source 1..319: mol_type = genomic DNA
atccacacgggcatgcggccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctgccctgggtggctctggtcggagtacctcatagatgtggtagagattggagccttcatccggccagtagtggtagcactgccggacgccgttctccgcgaggg

SEQ ID NO: 96911 - DNA, 30 bp, Homo sapiens
  misc_feature 1..30: note = chr7:157372062-157372092
  misc_feature 1..30: note = hypo
  source 1..30: mol_type = genomic DNA
aaaacatgtttcttacgccaggcttttcag

SEQ ID NO: 96912 - DNA, 30 bp, Homo sapiens
  misc_feature 1..30: note = chr7:157381230-157381260
  misc_feature 1..30: note = hypo
  source 1..30: mol_type = genomic DNA
gtggggccacgtccccgggaaggtgcagac

SEQ ID NO: 96913 - DNA, 378 bp, Homo sapiens
  misc_feature 1..378: note = chr7:157396375-157396753
  misc_feature 1..378: note = hypo
  source 1..378: mol_type = genomic DNA
gaacggcacccactacgaacctctcctaaaagccatgtcttctagtcaggaaactgtccagtcaccattgctggatgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaagggaaagcctggggcccctgtcccggcagtgcacttacgatggggctagcgttgatgtagtctgagtggctgtggctgttctccgccttcagcaggac

SEQ ID NO: 96914 - DNA, 35 bp, Homo sapiens
  misc_feature 1..35: note = chr7:157402619-157402654
  misc_feature 1..35: note = hypo
  source 1..35: mol_type = genomic DNA
aagcatgctagaggacgcggcggtatagtcattaa

SEQ ID NO: 96915 - DNA, 202 bp, Homo sapiens
  misc_feature 1..202: note = chr7:157403604-157403806
  misc_feature 1..202: note = hypo
  source 1..202: mol_type = genomic DNA
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccggcttccacactgg

SEQ ID NO: 96916 - DNA, 30 bp, Homo sapiens
  misc_feature 1..30: note = chr7:157404012-157404042
  misc_feature 1..30: note = hypo
  source 1..30: mol_type = genomic DNA
ttcccatacctgaagcgattttaacccaca

SEQ ID NO: 96917 - DNA, 198 bp, Homo sapiens
  misc_feature 1..198: note = chr7:157404368-157404566
  misc_feature 1..198: note = hypo
  source 1..198: mol_type = genomic DNA
acacgggagggagagcgcccgtgtgaagacgaagacagccgcggtcatgctggggacacgcggagggagcgcgcccgtgtgaagacgaagacagccgcagtcatgctggggacacgcggagggagagcgcccgtgtgaagacgaagacagccgcagtcatgctggggacacgcggagggagagcgcccgtgtgaagac

SEQ ID NO: 96918 - DNA, 175 bp, Homo sapiens
  misc_feature 1..175: note = chr7:157408585-157408760
  misc_feature 1..175: note = hypo
  source 1..175: mol_type = genomic DNA
ggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgcccaggagacggtgagcccggctg

SEQ ID NO: 96919 - DNA, 189 bp, Homo sapiens
  misc_feature 1..189: note = chr7:157409685-157409874
  misc_feature 1..189: note = hypo
  source 1..189: mol_type = genomic DNA
ttttcccaacacacacgcacaatctcaggtgagcccaagacagcctatgaggatggcactggggagtctggatttcagctctgacgggcgggctctaaaccccaaagttcttgtcggccaagtgggggggtttcttgtgaggaccagaggtggcacatccacgggcatgggggacgctggctcacgatg

SEQ ID NO: 96920 - DNA, 49 bp, Homo sapiens
  misc_feature 1..49: note = chr7:157414092-157414141
  misc_feature 1..49: note = hypo
  source 1..49: mol_type = genomic DNA
cctccctctgggccacgaacgagctgttgggctccgcctggtaggcgca

SEQ ID NO: 96921 - DNA, 101 bp, Homo sapiens; identical to SEQ ID NO: 41594
  misc_feature 1..101: note = chr7:157437497-157437598
  misc_feature 1..101: note = hypo
  source 1..101: mol_type = genomic DNA

SEQ ID NO: 96922 - DNA, 84 bp, Homo sapiens
  misc_feature 1..84: note = chr7:157443172-157443256
  misc_feature 1..84: note = hypo
  source 1..84: mol_type = genomic DNA
caaagctggagagttcgccctgcggcctggtttactcatcaggcctccgcgccagcacccgagccagagcgagaacggccagcc

SEQ ID NO: 96923 - DNA, 72 bp, Homo sapiens
  misc_feature 1..72: note = chr7:157446076-157446148
  misc_feature 1..72: note = hypo
  source 1..72: mol_type = genomic DNA
gctgctggatcaccacggaattggctgccttgtagctgtgatgagtcggaaggtcggcgactctgatgcgtt

SEQ ID NO: 96924 - DNA, 123 bp, Homo sapiens
  misc_feature 1..123: note = chr7:157448403-157448526
  misc_feature 1..123: note = hypo
  source 1..123: mol_type = genomic DNA
aggcagccagcaggacgtgctgcgctattgacagctgtcctaataacacccggacattcattatgtatggagtggcaatgcacggccacacacgcgtgatcactccagcgaggaccctggaaa

SEQ ID NO: 96925 - DNA, 30 bp, Homo sapiens
  misc_feature 1..30: note = chr7:157448928-157448958
  misc_feature 1..30: note = hypo
  source 1..30: mol_type = genomic DNA
gggtgcagccatcatcgcccagtccccgag

SEQ ID NO: 96926 - DNA, 231 bp, Homo sapiens
  misc_feature 1..231: note = chr7:157449174-157449405
  misc_feature 1..231: note = hypo
  source 1..231: mol_type = genomic DNA
gatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaaccccttctcctgctaagatccaaggttcaggcaggcgagagtttaccccagggcaggccagcgcaacatgacggtc

SEQ ID NO: 96927 - DNA, 106 bp, Homo sapiens
  misc_feature 1..106: note = chr7:157453759-157453865
  misc_feature 1..106: note = hypo
  source 1..106: mol_type = genomic DNA
tagagctggacaagccgacatcgcctcctccggcgggtggctcagtgcccagtggctcagtgctggtgcacggtgagggagacccagggttcggtgcctctcagcg

SEQ ID NO: 96928 - DNA, 125 bp, Homo sapiens
  misc_feature 1..125: note = chr7:157455446-157455571
  misc_feature 1..125: note = hypo
  source 1..125: mol_type = genomic DNA
gctctgcatccatgccgcgactgctttcggaatgtgcttttccagggcgagccttctttttggacatgggatgtacccgatgtctacaagcttgaagtaacattgccgaccgtgtgcttcttgtg

SEQ ID NO: 96929 - DNA, 30 bp, Homo sapiens; identical to SEQ ID NO: 41599
  misc_feature 1..30: note = chr7:157455840-157455870
  misc_feature 1..30: note = hypo
  source 1..30: mol_type = genomic DNA

SEQ ID NO: 96930 - DNA, 53 bp, Homo sapiens
  misc_feature 1..53: note = chr7:157457934-157457987
  misc_feature 1..53: note = hypo
  source 1..53: mol_type = genomic DNA
tctgtttatgatccgcgactatgcaccttcagccacagcggcccagtgtgtgc

SEQ ID NO: 96931 - DNA, 48 bp, Homo sapiens
  misc_feature 1..48: note = chr7:157462508-157462556
  misc_feature 1..48: note = hypo
  source 1..48: mol_type = genomic DNA
gcaccagccctttctcgagtccccacacaacctcgaggccgggctccg

SEQ ID NO: 96932 - DNA, 165 bp, Homo sapiens
  misc_feature 1..165: note = chr7:157464660-157464825
  misc_feature 1..165: note = hypo
  source 1..165: mol_type = genomic DNA
ccctggaggaaaacccgtgagcgagtcgtggagggagtgtgagggtttttggggagtgaactttgcagagggtgctgggagcagccggcccgaggacaccgctgactggggtacaggggccacgggtcgcacgtggggtgtcagctctgccgcctcacttggggt

SEQ ID NO: 96933 - DNA, 110 bp, Homo sapiens
  misc_feature 1..110: note = chr7:157467603-157467713
  misc_feature 1..110: note = hypo
  source 1..110: mol_type = genomic DNA
acgatgccctcctcccgagggacggtggccccaaggggagccgggagagcagaggctacaggcagggagtggggagacccagccttcaagcacagcgccccttgggtggg

SEQ ID NO: 96934 - DNA, 45 bp, Homo sapiens
  misc_feature 1..45: note = chr7:157468290-157468335
  misc_feature 1..45: note = hypo
  source 1..45: mol_type = genomic DNA
gggagcagctcatgccgaggaggaagtgtgcggaaacgggtaccc

SEQ ID NO: 96935 - DNA, 100 bp, Homo sapiens
  misc_feature 1..100: note = chr7:157476555-157476655
  misc_feature 1..100: note = hyper
  source 1..100: mol_type = genomic DNA
gtgaatgggggagcacgcccggccttggtcctggctgctacaagatgagaacaattagcaaacccctttccaccacctaatttcgcgtggtaacaaaatg

SEQ ID NO: 96936 - DNA, 103 bp, Homo sapiens
  misc_feature 1..103: note = chr7:157476871-157476974
  misc_feature 1..103: note = hyper
  source 1..103: mol_type = genomic DNA
gcctccttttgccttcggtgcagcggattagctggtgccgggactgagttaatggaaacgcgggttaaatgagaaaagacgcccggattttcctgcctggatg

SEQ ID NO: 96937 - DNA, 495 bp, Homo sapiens; identical to SEQ ID NO: 31715
  misc_feature 1..495: note = chr7:157476994-157477489
  misc_feature 1..495: note = hyper
  source 1..495: mol_type = genomic DNA

SEQ ID NO: 96938 - DNA, 110 bp, Homo sapiens; identical to SEQ ID NO: 31716
  misc_feature 1..110: note = chr7:157477710-157477820
  misc_feature 1..110: note = hyper
  source 1..110: mol_type = genomic DNA

SEQ ID NO: 96939 - DNA, 17 bp, Homo sapiens
  misc_feature 1..17: note = chr7:157481533-157481550
  misc_feature 1..17: note = hyper
  source 1..17: mol_type = genomic DNA
cgtccctcccccctcgc

SEQ ID NO: 96940 - DNA, 315 bp, Homo sapiens; identical to SEQ ID NO: 31718
  misc_feature 1..315: note = chr7:157481759-157482074
  misc_feature 1..315: note = hyper
  source 1..315: mol_type = genomic DNA

SEQ ID NO: 96941 - DNA, 308 bp, Homo sapiens
  misc_feature 1..308: note = chr7:157482200-157482508
  misc_feature 1..308: note = hyper
  source 1..308: mol_type = genomic DNA
cgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaac

SEQ ID NO: 96942 - DNA, 1977 bp, Homo sapiens
  misc_feature 1..1977: note = chr7:157482509-157484486
  misc_feature 1..1977: note = hyper
  source 1..1977: mol_type = genomic DNA
cctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctgg

SEQ ID NO: 96943 - DNA, 1095 bp, Homo sapiens
  misc_feature 1..1095: note = chr7:157484507-157485602
  misc_feature 1..1095: note = hyper
  source 1..1095: mol_type = genomic DNA
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcc

SEQ ID NO: 96944 - DNA, 433 bp, Homo sapiens; identical to SEQ ID NO: 31725
  misc_feature 1..433: note = chr7:157485649-157486082
  misc_feature 1..433: note = hyper
  source 1..433: mol_type = genomic DNA

SEQ ID NO: 96945 - DNA, 211 bp, Homo sapiens; identical to SEQ ID NO: 3189
  misc_feature 1..211: note = chr7:157486204-157486415
  misc_feature 1..211: note = hyper
  source 1..211: mol_type = genomic DNA

SEQ ID NO: 96946 - DNA, 128 bp, Homo sapiens; identical to SEQ ID NO: 31727
  misc_feature 1..128: note = chr7:157486475-157486603
  misc_feature 1..128: note = hyper
  source 1..128: mol_type = genomic DNA

SEQ ID NO: 96947 - DNA, 15 bp, Homo sapiens
  misc_feature 1..15: note = chr7:157486656-157486671
  misc_feature 1..15: note = hyper
  source 1..15: mol_type = genomic DNA
cgcagaccctgccgt

SEQ ID NO: 96948 - DNA, 30 bp, Homo sapiens
  misc_feature 1..30: note = chr7:157505944-157505974
  misc_feature 1..30: note = hypo
  source 1..30: mol_type = genomic DNA
tactcaacccaatgacgcatctttaattct

SEQ ID NO: 96949 - DNA, 54 bp, Homo sapiens
  misc_feature 1..54: note = chr7:157506246-157506300
  misc_feature 1..54: note = hypo
  source 1..54: mol_type = genomic DNA
ccatcagcaaagagacggtgtgacgcccggctccctccccgtcactgatacggc

SEQ ID NO: 96950 - DNA, 44 bp, Homo sapiens; identical to SEQ ID NO: 41600
  misc_feature 1..44: note = chr7:157511451-157511495
  misc_feature 1..44: note = hypo
  source 1..44: mol_type = genomic DNA

SEQ ID NO: 96951 - DNA, 152 bp, Homo sapiens; identical to SEQ ID NO: 41601
  misc_feature 1..152: note = chr7:157512238-157512390
  misc_feature 1..152: note = hypo
  source 1..152: mol_type = genomic DNA

SEQ ID NO: 96952 - DNA, 216 bp, Homo sapiens
  misc_feature 1..216: note = chr7:157527539-157527755
  misc_feature 1..216: note = hypo
  source 1..216: mol_type = genomic DNA
cacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagag

SEQ ID NO: 96953 - DNA, 30 bp, Homo sapiens; identical to SEQ ID NO: 41603
  misc_feature 1..30: note = chr7:157530181-157530211
  misc_feature 1..30: note = hypo
  source 1..30: mol_type = genomic DNA

SEQ ID NO: 96954 - DNA, 118 bp, Homo sapiens
  misc_feature 1..118: note = chr7:157536623-157536741
  misc_feature 1..118: note = hypo
  source 1..118: mol_type = genomic DNA
tgtgtcctctttgcacgttgcatgtgtcgtggtgggagctgtgaggcggtgccgtgacggggcgatgctgctgcaggagacgtgctccggggcacgactctgacgcagcttagaagag

SEQ ID NO: 96955 - DNA, 30 bp, Homo sapiens
  misc_feature 1..30: note = chr7:157544564-157544594
  misc_feature 1..30: note = hypo
  source 1..30: mol_type = genomic DNA
aaggacagagaccaccgtgaacacatctcc

SEQ ID NO: 96956 - DNA, 58 bp, Homo sapiens
  misc_feature 1..58: note = chr7:157546564-157546622
  misc_feature 1..58: note = hypo
  source 1..58: mol_type = genomic DNA
cacagcacccccatccgcggccatggctgctgtccaggcatcacgcccacacctgcca

SEQ ID NO: 96957 - DNA, 34 bp, Homo sapiens
  misc_feature 1..34: note = chr7:157550924-157550958
  misc_feature 1..34: note = hypo
  source 1..34: mol_type = genomic DNA
aaatatggatgatgacgagcgtggtgttgcccac

SEQ ID NO: 96958 - DNA, 103 bp, Homo sapiens; identical to SEQ ID NO: 41605
  misc_feature 1..103: note = chr7:157551220-157551323
  misc_feature 1..103: note = hypo
  source 1..103: mol_type = genomic DNA

SEQ ID NO: 96959 - DNA, 153 bp, Homo sapiens
  misc_feature 1..153: note = chr7:157552297-157552450
  misc_feature 1..153: note = hypo
  source 1..153: mol_type = genomic DNA
gtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggt

SEQ ID NO: 96960 - DNA, 151 bp, Homo sapiens
  misc_feature 1..151: note = chr7:157565500-157565651
  misc_feature 1..151: note = hypo
  source 1..151: mol_type = genomic DNA
cttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactggg

SEQ ID NO: 96961 - DNA, 134 bp, Homo sapiens
  misc_feature 1..134: note = chr7:157568187-157568321
  misc_feature 1..134: note = hypo
  source 1..134: mol_type = genomic DNA
cctgaatacaggactcgatgcctcgaggagaggagcgtggagcacgcccggggcacatggggacacagcagcgctgggaaggcttcgtcctcgggagccggcgctcacatgcagggagtcgcccaggacagcaa

SEQ ID NO: 96962 - DNA, 62 bp, Homo sapiens
  misc_feature 1..62: note = chr7:157578615-157578677
  misc_feature 1..62: note = hypo
  source 1..62: mol_type = genomic DNA
gcagggtgggagggccgggtggggatggctgcagggaccccctgggccggctctgggtgctg

SEQ ID NO: 96963 - DNA, 30 bp, Homo sapiens
  misc_feature 1..30: note = chr7:157581557-157581587
  misc_feature 1..30: note = hypo
  source 1..30: mol_type = genomic DNA
tgctatgctggaggccgctggaaccacctc

SEQ ID NO: 96964 - DNA, 341 bp, Homo sapiens; identical to SEQ ID NO: 41609
  misc_feature 1..341: note = chr7:157583900-157584241
  misc_feature 1..341: note = hypo
  source 1..341: mol_type = genomic DNA

SEQ ID NO: 96965 - DNA, 30 bp, Homo sapiens; identical to SEQ ID NO: 41610
  misc_feature 1..30: note = chr7:157584643-157584673
  misc_feature 1..30: note = hypo
  source 1..30: mol_type = genomic DNA

SEQ ID NO: 96966 - DNA, 84 bp, Homo sapiens
  misc_feature 1..84: note = chr7:157585079-157585163
  misc_feature 1..84: note = hypo
  source 1..84: mol_type = genomic DNA
ttgctgtggctctggcggacattagccagcagtggagagaagcccatctccacccccagggagctcagccgaggtctccgcgtc

SEQ ID NO: 96967 - DNA, 441 bp, Homo sapiens
  misc_feature 1..441: note = chr7:157588586-157589027
  misc_feature 1..441: note = hypo
  source 1..441: mol_type = genomic DNA
cacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacatttt

SEQ ID NO: 96968 - DNA, 35 bp, Homo sapiens
  misc_feature 1..35: note = chr7:157589600-157589635
  misc_feature 1..35: note = hypo
  source 1..35: mol_type = genomic DNA
caacactggggattacggttcgacaggagattttg

SEQ ID NO: 96969 - DNA, 30 bp, Homo sapiens; identical to SEQ ID NO: 41613
  misc_feature 1..30: note = chr7:157601854-157601884
  misc_feature 1..30: note = hypo
  source 1..30: mol_type = genomic DNA

SEQ ID NO: 96970 - DNA, 33 bp, Homo sapiens
  misc_feature 1..33: note = chr7:157603115-157603148
  misc_feature 1..33: note = hypo
  source 1..33: mol_type = genomic DNA
ggctctccacggggacggcggggctgctgggca

SEQ ID NO: 96971 - DNA, 349 bp, Homo sapiens
  misc_feature 1..349: note = chr7:157606439-157606788
  misc_feature 1..349: note = hypo
  source 1..349: mol_type = genomic DNA
gctgtctacacagcacgcattccttaccccggtggttttcatctggaccctgagtcagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacactgccgtgctgcgcaggtgaggcctg

SEQ ID NO: 96972 - DNA, 44 bp, Homo sapiens
  misc_feature 1..44: note = chr7:157607996-157608040
  misc_feature 1..44: note = hypo
  source 1..44: mol_type = genomic DNA
gcgccctcccatggccgtggcctcttcctcggtcctttgccctc

SEQ ID NO: 96973 - DNA, 30 bp, Homo sapiens
  misc_feature 1..30: note = chr7:157612336-157612366
  misc_feature 1..30: note = hypo
  source 1..30: mol_type = genomic DNA
acctccttttggcagcgcaggtgcattcag

SEQ ID NO: 96974 - DNA, 31 bp, Homo sapiens
  misc_feature 1..31: note = chr7:157613184-157613215
  misc_feature 1..31: note = hypo
  source 1..31: mol_type = genomic DNA
agcagatccaacacacgcattcttacacatg

SEQ ID NO: 96975 - DNA, 41 bp, Homo sapiens
  misc_feature 1..41: note = chr7:157624712-157624753
  misc_feature 1..41: note = hypo
  source 1..41: mol_type = genomic DNA
agcacctggcacctccgctaattctccggggtggaggcact

SEQ ID NO: 96976 - DNA, 30 bp, Homo sapiens
  misc_feature 1..30: note = chr7:157626674-157626704
  misc_feature 1..30: note = hypo
  source 1..30: mol_type = genomic DNA
gaaagaaggagctggcggatttctcctctg

SEQ ID NO: 96977 - DNA, 123 bp, Homo sapiens; identical to SEQ ID NO: 41615
  misc_feature 1..123: note = chr7:157633412-157633535
  misc_feature 1..123: note = hypo
  source 1..123: mol_type = genomic DNA

SEQ ID NO: 96978 - DNA, 30 bp, Homo sapiens; identical to SEQ ID NO: 41616
  misc_feature 1..30: note = chr7:157642058-157642088
  misc_feature 1..30: note = hypo
  source 1..30: mol_type = genomic DNA

SEQ ID NO: 96979 - DNA, 35 bp, Homo sapiens
  misc_feature 1..35: note = chr7:157645946-157645981
  misc_feature 1..35: note = hypo
  source 1..35: mol_type = genomic DNA
tcacatgatgacggccgagccgggcctgcaacgga

SEQ ID NO: 96980 - DNA, 30 bp, Homo sapiens; identical to SEQ ID NO: 41617
  misc_feature 1..30: note = chr7:157654407-157654437
  misc_feature 1..30: note = hypo
  source 1..30: mol_type = genomic DNA

SEQ ID NO: 96981 - DNA, 30 bp, Homo sapiens
  misc_feature 1..30: note = chr7:157655687-157655717
  misc_feature 1..30: note = hypo
  source 1..30: mol_type = genomic DNA
gggattcacgtcaggcggcacttggtgggc

SEQ ID NO: 96982 - DNA, 87 bp, Homo sapiens
  misc_feature 1..87: note = chr7:157656677-157656764
  misc_feature 1..87: note = hypo
  source 1..87: mol_type = genomic DNA
tacaggctccaaaaacgctctctgcatgtgtgattctggccaggaccaccctgcccgaagccacggctatgtcgaagctaattgtgc

SEQ ID NO: 96983 - DNA, 217 bp, Homo sapiens
  misc_feature 1..217: note = chr7:157659256-157659473
  misc_feature 1..217: note = hypo
  source 1..217: mol_type = genomic DNA
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccctggat

SEQ ID NO: 96984 - DNA, 80 bp, Homo sapiens
  misc_feature 1..80: note = chr7:157660078-157660158
  misc_feature 1..80: note = hypo
  source 1..80: mol_type = genomic DNA
ccaccctgtccctgacgccctggatacacggccacctggatacacggccaccaccccgcccctgacgctctggatacagg

SEQ ID NO: 96985 - DNA, 33 bp, Homo sapiens
  misc_feature 1..33: note = chr7:157690247-157690280
  misc_feature 1..33: note = hypo
  source 1..33: mol_type = genomic DNA
ccagtttccatcagtcgccggctgctctcctct

SEQ ID NO: 96986 - DNA, 30 bp, Homo sapiens
  misc_feature 1..30: note = chr7:157695195-157695225
  misc_feature 1..30: note = hypo
  source 1..30: mol_type = genomic DNA
cgtggggaccagccccgtggtggcctggag

SEQ ID NO: 96987 - DNA, 459 bp, Homo sapiens
  misc_feature 1..459: note = chr7:157702952-157703411
  misc_feature 1..459: note = hypo
  source 1..459: mol_type = genomic DNA
acgggtgcaggaccacgcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcatgtacgccgtgggaacgggtccaggatcacgcacgtacgccgtaggaacgggcgcagaatcacacacgtacaccgttctgcacagctggcggacgcttcctctttcccacatggtgtggtgtaacctgatcgtttgtatgcaaagcaaacccatgcacagctgactgtgtcaaaacacagccagaaagatgccatgcggcagggcacgtgtgtgtgtgtgt

SEQ ID NO: 96988 - DNA, 30 bp, Homo sapiens; identical to SEQ ID NO: 41622
  misc_feature 1..30: note = chr7:157718446-157718476
  misc_feature 1..30: note = hypo
  source 1..30: mol_type = genomic DNA

SEQ ID NO: 96989 - DNA, 49 bp, Homo sapiens
  misc_feature 1..49: note = chr7:157722602-157722651
  misc_feature 1..49: note = hypo
  source 1..49: mol_type = genomic DNA
gggccaggcatgaagcgaattcagtccacatcagcgggtccaagcctgg

SEQ ID NO: 96990 - DNA, 301 bp, Homo sapiens
  misc_feature 1..301: note = chr7:157776661-157776962
  misc_feature 1..301: note = hypo
  source 1..301: mol_type = genomic DNA
cggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccc

SEQ ID NO: 96991 - DNA, 71 bp, Homo sapiens
  misc_feature 1..71: note = chr7:157778447-157778518
  misc_feature 1..71: note = hypo
  source 1..71: mol_type = genomic DNA
cctgagggaggtgcacggaaaccatgcatccaaatccggagagcagggagaccagccggatagcccacctg

SEQ ID NO: 96992 - DNA, 35 bp, Homo sapiens
  misc_feature 1..35: note = chr7:157793339-157793374
  misc_feature 1..35: note = hypo
  source 1..35: mol_type = genomic DNA
gtgggggctggtgtccggccgcaggtggggtgcag

SEQ ID NO: 96993 - DNA, 77 bp, Homo sapiens
  misc_feature 1..77: note = chr7:157793825-157793902
  misc_feature 1..77: note = hypo
  source 1..77: mol_type = genomic DNA
aggtggggtgcaaggtggggctggggtttggccgcaggtctggtgcaacgtggggctggggtcgggccgcaggcggg

SEQ ID NO: 96994 - DNA, 145 bp, Homo sapiens
  misc_feature 1..145: note = chr7:157794503-157794648
  misc_feature 1..145: note = hypo
  source 1..145: mol_type = genomic DNA
tgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaag

SEQ ID NO: 96995 - DNA, 30 bp, Homo sapiens
  misc_feature 1..30: note = chr7:157795418-157795448
  misc_feature 1..30: note = hypo
  source 1..30: mol_type = genomic DNA
gcaggtcagctgcagcgagagaaatggact

SEQ ID NO: 96996 - DNA, 30 bp, Homo sapiens
  misc_feature 1..30: note = chr7:157853764-157853794
  misc_feature 1..30: note = hypo
  source 1..30: mol_type = genomic DNA
caaccctgagccaggcggctttgtccgtgt

SEQ ID NO: 96997 - DNA, 180 bp, Homo sapiens
  misc_feature 1..180: note = chr7:157877427-157877607
  misc_feature 1..180: note = hypo
  source 1..180: mol_type = genomic DNA
gatgcccatccacacagatgcccatacactccgacactcatccacacccacgatgcccatccacacggatgcccatacactcctacaatgcccatccacacccacgatgcccatccacatccttgatgcccatccacacccatgatgcccatccacatcctcgatgcccatccacaccca

SEQ ID NO: 96998 - DNA, 43 bp, Homo sapiens
  misc_feature 1..43: note = chr7:157886934-157886977
  misc_feature 1..43: note = hypo
  source 1..43: mol_type = genomic DNA
ccaggagcagcagaacgctcgccattcccgaaggaccagggcc

SEQ ID NO: 96999 - DNA, 30 bp, Homo sapiens
  misc_feature 1..30: note = chr7:157890829-157890859
  misc_feature 1..30: note = hypo
  source 1..30: mol_type = genomic DNA
atgagcacacacgcacgcaggcaccagaac

SEQ ID NO: 97000 - DNA, 235 bp, Homo sapiens
  misc_feature 1..235: note = chr7:157891284-157891519
  misc_feature 1..235: note = hypo
  source 1..235: mol_type = genomic DNA
aaaccagaggctccccgaggcacacgcctccctcgcccgccccggcctggcatctgccagtcccaccattttgctgagactctgtgaaggtgaatggggttgcttgggctcggggactggaagaagaaggacgtttatctcgtgaacgcgggacgctccttatgggagaggagtgggagacatgaagcaaagcgtgaccaccgaggagctggggagaaagcgagaaagcaaggaa

SEQ ID NO: 97001 - DNA, 193 bp, Homo sapiens
  misc_feature 1..193: note = chr7:157932110-157932303
  misc_feature 1..193: note = hypo
  source 1..193: mol_type = genomic DNA
gaacagaatgggagacgttctgcagaacctcagtcacccctggggcatccaagccgtcggagtcaggagggcacgggggggtgggaaaggaaccagaaacacctgaaagaaagcccacaagtctctcaaatctgggaaggattgtcactcagggactcaagacagtcactaagttccacgataataaaatgca

SEQ ID NO: 97002 - DNA, 66 bp, Homo sapiens
  misc_feature 1..66: note = chr7:157934593-157934659
  misc_feature 1..66: note = hypo
  source 1..66: mol_type = genomic DNA
tgtgacggacacgggcgttctgatcggagcgtgctgggcgttcactgccaccgatgtcccctgctg

SEQ ID NO: 97003 - DNA, 185 bp, Homo sapiens
  misc_feature 1..185: note = chr7:157955324-157955509
  misc_feature 1..185: note = hypo
  source 1..185: mol_type = genomic DNA
tcaccggccactgcacgtcacctgttgtcctccccgtcaccccaccttagataggccttccactgaacctgctttaaagctctttgaaaggagaccagatgtgaattatgaataagtgaaggaagagagtctctttttaaagcttttaccaggtaaacttttgtcatatgcgttcagcccgcagc

SEQ ID NO: 97004 - DNA, 158 bp, Homo sapiens
  misc_feature 1..158: note = chr7:157956509-157956667
  misc_feature 1..158: note = hypo
  source 1..158: mol_type = genomic DNA
attctctgtatatttcgtaggtgacgcctgtacggggttctcaattctctctgcatatttcataggtgatcagtattctctgtgtatttcataggtgatacctgcatggggttctcaattctctctgcgtatttcctatttgccgttttacatgaggc

SEQ ID NO: 97005 - DNA, 190 bp, Homo sapiens
  misc_feature 1..190: note = chr7:157958513-157958703
  misc_feature 1..190: note = hypo
  source 1..190: mol_type = genomic DNA
tttctcccctgggcccgccctgacgtggcttaactcaggtagcgacaccggaagccacggtcttggcagagcagtcacctcgaggccgacactgttcagctagtgcatggtgagcagcatgaaatccagacagggggcttcggaggatgtggcaaaccgccataaatatgggctacggtcacatgctggg

SEQ ID NO: 97006 - DNA, 63 bp, Homo sapiens
  misc_feature 1..63: note = chr7:157984975-157985038
  misc_feature 1..63: note = hypo
  source 1..63: mol_type = genomic DNA
aggaaaagccaaccccggcccggggaggaagtggaagggtcacctcagcggggggtctgtcct

SEQ ID NO: 97007 - DNA, 124 bp, Homo sapiens
  misc_feature 1..124: note = chr7:157987024-157987148
  misc_feature 1..124: note = hypo
  source 1..124: mol_type = genomic DNA
atgtccataaaagaacgggcatcaccattaaaaagatgggccagtctgggggcccttgctgtccggctctgctgcccacagacaagggcagggccctctgtgaacctgccgccctcagcaatgc

SEQ ID NO: 97008 - DNA, 87 bp, Homo sapiens
  misc_feature 1..87: note = chr7:158037639-158037726
  misc_feature 1..87: note = hypo
  source 1..87: mol_type = genomic DNA
agcgacaggcctgagcgaggccagcagttcgaagcccctgctccctggctgtgtcatgtggacaagtgacgtcgtcttgaggatggc

SEQ ID NO: 97009 - DNA, 30 bp, Homo sapiens
  misc_feature 1..30: note = chr7:158039764-158039794
  misc_feature 1..30: note = hypo
  source 1..30: mol_type = genomic DNA
aaaccatccctggcacgggctgcctcaagg

SEQ ID NO: 97010 - DNA, 266 bp, Homo sapiens
  misc_feature 1..266: note = chr7:158040050-158040316
  misc_feature 1..266: note = hypo
  source 1..266: mol_type = genomic DNA
gagggcgctcttgaccgtgtctgcgtgtctaagcaaaggatacaggggcgcaaagggaaggagtggccaggggtgcccgtcccaggtgtgctcttcttcacggcgcccctgcttccccaccacgcccatgtccacggctcgtgggcagctgggcactgggccactcagacaccgtcctaaacactccacacaggtaacttgctccctctccagccacacagcaaacacagcaaaggggacttgggtgtctgcggtttttttgtttg

SEQ ID NO: 97011 - DNA, 92 bp, Homo sapiens
  misc_feature 1..92: note = chr7:158046523-158046615
  misc_feature 1..92: note = hypo
  source 1..92: mol_type = genomic DNA
ggcatccatatttatcgagcagaggaagcatccctgtaactgcacggcggcacagagccactgcccacggcacgacccgccctccatctcta

SEQ ID NO: 97012 - DNA, 30 bp, Homo sapiens
  misc_feature 1..30: note = chr7:158054306-158054336
  misc_feature 1..30: note = hypo
  source 1..30: mol_type = genomic DNA
actccatagagcacacgaagaggataaaac

SEQ ID NO: 97013 - DNA, 176 bp, Homo sapiens
  misc_feature 1..176: note = chr7:158059198-158059374
  misc_feature 1..176: note = hypo
  source 1..176: mol_type = genomic DNA
cagtgaggctggggacggtgtctgctgcggtgtgatgtctggcagaaagagccggggccagtgtggctgtgagcatcaggcctgaattccgtgaactgaggaacagcctgacagagggacccagcagcagcggcctcaggacaggcacaacggccacttcccggcttaacctgggc

SEQ ID NO: 97014 - DNA, 277 bp, Homo sapiens
  misc_feature 1..277: note = chr7:158059722-158059999
  misc_feature 1..277: note = hypo
  source 1..277: mol_type = genomic DNA
gtgcctcatctgcagcgtcgtctccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttc

SEQ ID NO: 97015 - DNA, 153 bp, Homo sapiens
  misc_feature 1..153: note = chr7:158065251-158065404
  misc_feature 1..153: note = hypo
  source 1..153: mol_type = genomic DNA
ccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctca

SEQ ID NO: 97016 - DNA, 120 bp, Homo sapiens
  misc_feature 1..120: note = chr7:158066949-158067069
  misc_feature 1..120: note = hypo
  source 1..120: mol_type = genomic DNA
cggggagccgcagacacagggggagacgcagacacaggaggagacacacaaggagccgcagccacagggggagccgcagacgcgggagagccacagacacagggggagccgcagacacag

SEQ ID NO: 97017 - DNA, 44 bp, Homo sapiens
  misc_feature 1..44: note = chr7:158075807-158075851
  misc_feature 1..44: note = hypo
  source 1..44: mol_type = genomic DNA
gatgtcaggggaagacgcattcgacaacacgcatgaaaaaaaac

SEQ ID NO: 97018 - DNA, 30 bp, Homo sapiens
  misc_feature 1..30: note = chr7:158103351-158103381
  misc_feature 1..30: note = hypo
  source 1..30: mol_type = genomic DNA
gggcgagccctgagccggacagagcgcaag

SEQ ID NO: 97019 - DNA, 103 bp, Homo sapiens
  misc_feature 1..103: note = chr7:158113168-158113271
  misc_feature 1..103: note = hypo
  source 1..103: mol_type = genomic DNA
gagcagctgtgatggcgcccccatcgcccgcatcctcagcagcgccaggtggcgtccgtgttcccgcgtcctcggcagcgccgggtggcgtccgtgttcccac

SEQ ID NO: 97020 - DNA, 47 bp, Homo sapiens
  misc_feature 1..47: note = chr7:158144245-158144292
  misc_feature 1..47: note = hypo
  source 1..47: mol_type = genomic DNA
gcgtttcttactacacgaaacatggttacctacgagtgaaatggcag

SEQ ID NO: 97021 - DNA, 30 bp, Homo sapiens
  misc_feature 1..30: note = chr7:158167123-158167153
  misc_feature 1..30: note = hypo
  source 1..30: mol_type = genomic DNA
cctcaatatcaacagcgcagaaactccact

SEQ ID NO: 97022 - DNA, 145 bp, Homo sapiens
  misc_feature 1..145: note = chr7:158187594-158187739
  misc_feature 1..145: note = hypo
  source 1..145: mol_type = genomic DNA
ccaggctgtgcaggccgcatctctgcaacgcgtcagccagagaaagccgggggcaccccagccagcactcaggaggccctgcccgtccacacgacacctgggccaaccagccctttctgctgtaaaacttcggctcctctacctg

SEQ ID NO: 97023 - DNA, 45 bp, Homo sapiens
  misc_feature 1..45: note = chr7:158188532-158188577
  misc_feature 1..45: note = hypo
  source 1..45: mol_type = genomic DNA
ggatcccaccagccccgaattcgggcagagcgccatggagggccc

SEQ ID NO: 97024 - DNA, 30 bp, Homo sapiens
  misc_feature 1..30: note = chr7:158207406-158207436
  misc_feature 1..30: note = hypo
  source 1..30: mol_type = genomic DNA
atgtggctcattcttcgaggctccactgaa

SEQ ID NO: 97025 - DNA, 33 bp, Homo sapiens
  misc_feature 1..33: note = chr7:158246475-158246508
  misc_feature 1..33: note = hypo
  source 1..33: mol_type = genomic DNA
ccatgtgcagggaaccgacggagacacttagaa

SEQ ID NO: 97026 - DNA, 96 bp, Homo sapiens
  misc_feature 1..96: note = chr7:158249132-158249228
  misc_feature 1..96: note = hypo
  source 1..96: mol_type = genomic DNA
gagaacataatggcacggacgccatcggcaatggccccccattgctctgcagagaacataacggcacggatgccatcggccatggccccccatcgc

SEQ ID NO: 97027 - DNA, 47 bp, Homo sapiens
  misc_feature 1..47: note = chr7:158277680-158277727
  misc_feature 1..47: note = hypo
  source 1..47: mol_type = genomic DNA
ggcacccctcccagccgctgttgctgtggccccggccgccagcgtcc

SEQ ID NO: 97028 - DNA, 205 bp, Homo sapiens
  misc_feature 1..205: note = chr7:158282122-158282327
  misc_feature 1..205: note = hypo
  source 1..205: mol_type = genomic DNA
agcgagactctgtctcaaaaaaattttttaaaaaaggatgaaaaacttgccgaaggacagagcaaaacaaaatcagaaagcaagggttggtgcgagcgatgggcgcccagaacccgggcaacctcttctccccacccaccgaggccgcagcccatggctccggggttccatccgcctcctctcggcagcgcgccccgggcggccc

SEQ ID NO: 97029 - DNA, 32 bp, Homo sapiens
  misc_feature 1..32: note = chr7:158282841-158282873
  misc_feature 1..32: note = hypo
  source 1..32: mol_type = genomic DNA
gctcaccgcacgcaccgcgtccctggaagcaa

SEQ ID NO: 97030 - DNA, 48 bp, Homo sapiens
  misc_feature 1..48: note = chr7:158283188-158283236
  misc_feature 1..48: note = hypo
  source 1..48: mol_type = genomic DNA
gctggcaaaggttggcgttcggctccacgtccacgcctgtcttaaaca

SEQ ID NO: 97031 - DNA, 436 bp, Homo sapiens; identical to SEQ ID NO: 41640
  misc_feature 1..436: note = chr7:158301251-158301687
  misc_feature 1..436: note = hypo
  source 1..436: mol_type = genomic DNA

SEQ ID NO: 97032 - DNA, 30 bp, Homo sapiens
  misc_feature 1..30: note = chr7:158319411-158319441
  misc_feature 1..30: note = hypo
  source 1..30: mol_type = genomic DNA
gtgaggacacagacacgcacagatggacaa

SEQ ID NO: 97033 - DNA, 30 bp, Homo sapiens; identical to SEQ ID NO: 41641
  misc_feature 1..30: note = chr7:158332352-158332382
  misc_feature 1..30: note = hypo
  source 1..30: mol_type = genomic DNA

SEQ ID NO: 97034 - DNA, 291 bp, Homo sapiens
  misc_feature 1..291: note = chr7:158349456-158349747
  misc_feature 1..291: note = hypo
  source 1..291: mol_type = genomic DNA
tgctcccacgcaggtcgctcccacgcaggtcaggcggctcccgcgcaggtcgctcccacgcaggtcaggcagctcccgcgcaggtcagacagctcccgggcaggtcaggcggctcccgtgaaggtcagggggctcccgtgcaggtcgctcccacgcaggtcaggcggctcccgcgcaggtcactcccacgcaggtcaggtggctcccgcacaggtcaggcggctcccacgcaggtcgctcccacgcaggtcgctcccacgcaggtcagagggctcccgcgcaggtcactcc

SEQ ID NO: 97035 - DNA, 30 bp, Homo sapiens
  misc_feature 1..30: note = chr7:158355894-158355924
  misc_feature 1..30: note = hypo
  source 1..30: mol_type = genomic DNA
cacaagtttgcagctcgagaccttgtccag

SEQ ID NO: 97036 - DNA, 421 bp, Homo sapiens
  misc_feature 1..421: note = chr7:158379278-158379699
  misc_feature 1..421: note = hyper
  source 1..421: mol_type = genomic DNA
caggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtcctctgatttcggcggcgctgcccgcgggggggtgcgggggacgcaggtagaagcgggtgcagcgggacatccgaggcccggcccctcgcggcacacgcggcggaacacgagcggggggcgcacccacgccggaccagggccgcgcgctccagggccaggggagtgccgagtggcggggctcggggcgtgaggcccaggagccggggtagaggcaggaggcggcgccggggaggaaactgaggcaggggcgcgagacctgctccgagcccccagtgag

SEQ ID NO: 97037 - DNA, 117 bp, Homo sapiens
  misc_feature 1..117: note = chr7:158380279-158380396
  misc_feature 1..117: note = hyper
  source 1..117: mol_type = genomic DNA
ggacggacgaaggggcggcaggcaggacgcgtggcggcagcagcagcagtagcagcagcagcagcgggagcggcggccccatccccgcggcctggccggcggcgctcagtccatggc

SEQ ID NO: 97038 - DNA, 401 bp, Homo sapiens
  misc_feature 1..401: note = chr7:158380813-158381214
  misc_feature 1..401: note = hyper
  source 1..401: mol_type = genomic DNA
cctgccgccgctccccgcccggcccggtgctgggggtcgcactgtccctggggacggcgggggcctaagccgcgcccttggcccggacgggaaggcccgaacctactctgctggggacctgggcaggcggcctctacccgcggggccccgcgcgcgtcgaattaacgccttccaaccgtttctttaatttaaacgtaacgggccacttgcgcatcggggcgcgcggaggtggacccagtcgacctcccctgcagcgcgggcggcgcccaggctcggtcccaggaaagctcccggagggcccagggcgtgggctggggccaggcgggctctggggcagagcagggtgaggcctgttgcgggcctggtctcctcgccgccgtcccgcccggggtcctggggga

SEQ ID NO: 97039 - DNA, 30 bp, Homo sapiens
  misc_feature 1..30: note = chr7:158450990-158451020
  misc_feature 1..30: note = hypo
  source 1..30: mol_type = genomic DNA
ttcctacttttctaccgtaccaaaaaacag

SEQ ID NO: 97040 - DNA, 30 bp, Homo sapiens
  misc_feature 1..30: note = chr7:158522269-158522299
  misc_feature 1..30: note = hypo
  source 1..30: mol_type = genomic DNA
gtgaggatgtgctggcggggaggagcaagt

SEQ ID NO: 97041 - DNA, 240 bp, Homo sapiens; identical to SEQ ID NO: 41643
  misc_feature 1..240: note = chr7:158550099-158550339
  misc_feature 1..240: note = hypo
  source 1..240: mol_type = genomic DNA

SEQ ID NO: 97042 - DNA, 30 bp, Homo sapiens; identical to SEQ ID NO: 41644
  misc_feature 1..30: note = chr7:158564374-158564404
  misc_feature 1..30: note = hypo
  source 1..30: mol_type = genomic DNA

SEQ ID NO: 97043 - DNA, 18 bp, Homo sapiens
  misc_feature 1..18: note = chr7:158594958-158594976
  misc_feature 1..18: note = hypo
  source 1..18: mol_type = genomic DNA
tccatgtcctatgcacga

SEQ ID NO: 97044 - DNA, 277 bp, Homo sapiens
  misc_feature 1..277: note = chr7:158766828-158767105
  misc_feature 1..277: note = hypo
  source 1..277: mol_type = genomic DNA
ctgtcctcccagggccgatgccagcgcccgccctccgcgttcccggcattgacagaatgtccaggcgcgcagggcccgtgggtggggcctgggcacccggccctgccctcgcgcaccctccagacccgccacttcttagatagagagcggccgcctccccgccctcctttcagccactcgctccgcgcagtcagctctgctgactcttccggaggattctggaaggttccagagggtgtgccgccgaggccctgcgagagggcgttccctggggaga

SEQ ID NO: 97045 - DNA, 139 bp, Homo sapiens
  misc_feature 1..139: note = chr7:158788416-158788555
  misc_feature 1..139: note = hypo
  source 1..139: mol_type = genomic DNA
atcccacgtcctcctcggctattcccctgctgctgaccacctgtcccagcctcacctgaaagcacatcccgtcctcccatcctcagtcccaggagcatcacttgctgagggattgtcacggccgcgaggcttcagcccg

SEQ ID NO: 97046 - DNA, 30 bp, Homo sapiens
  misc_feature 1..30: note = chr7:158815031-158815061
  misc_feature 1..30: note = hypo
  source 1..30: mol_type = genomic DNA
atcctcacagcatggcgactggagggtctt

SEQ ID NO: 97047 - DNA, 30 bp, Homo sapiens
  misc_feature 1..30: note = chr7:158817049-158817079
  misc_feature 1..30: note = hypo
  source 1..30: mol_type = genomic DNA
gagctcggccaggcccgaggttgagctgtg

SEQ ID NO: 97048 - DNA, 356 bp, Homo sapiens
  misc_feature 1..356: note = chr7:158823309-158823665
  misc_feature 1..356: note = hyper
  source 1..356: mol_type = genomic DNA
gatgaccgaggtctccgtttgcaggaaggactgggcgcgggagccgcggtggaactgcagggcgccctccgagccgttgcgggagaaggaggaaccgcagaccctgtaatcccggctcgcggacggggtcgggcaccggcttcgccattttcgcttcagctcgcactgcacctgggaggtgagggcagcgggaacgcccgtgagcctgggcaggtgcgggcggctgctatgggaagcgcggcccgcgagcctccagctctccctcccgcctgctcccgtatctgtgttgccagcagatggacagaaacagaaacggccttgggggcagaggctggagggagcgggaactggacggc

SEQ ID NO: 97049 - DNA, 93 bp, Homo sapiens
  misc_feature 1..93: note = chr7:158857187-158857280
  misc_feature 1..93: note = hypo
  source 1..93: mol_type = genomic DNA
actgtggtctcaagtcggggcggccagctgggtgctgggctgaaggtggcagcagccacccgctgtcgggtggggcttcgaggttgtcagcag

SEQ ID NO: 97050 - DNA, 77 bp, Homo sapiens
  misc_feature 1..77: note = chr7:158868410-158868487
  misc_feature 1..77: note = hypo
  source 1..77: mol_type = genomic DNA
cagggccagcacccacggacccactgcatcagtgagtagcccagggccggcacccacggacccgctgcatcagtgag

SEQ ID NO: 97051 - DNA, 203 bp, Homo sapiens
  misc_feature 1..203: note = chr7:158933031-158933234
  misc_feature 1..203: note = hypo
  source 1..203: mol_type = genomic DNA
tcagcctgtagattccggttcacatcgctgatagcatctttattctggtaacttacttctatttacatccctggcatttgagccacgcatatttcaaagagtacagaaaaacaaaagagtggccaggctgaggccccggcatgctgctgcttctctcctgaagggcagtgtcttgttaccaagtacttcgtgcaagtcaaaaa

SEQ ID NO: 97052 - DNA, 569 bp, Homo sapiens
  misc_feature 1..569: note = chr7:158936522-158937091
  misc_feature 1..569: note = hyper
  source 1..569: mol_type = genomic DNA
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccgcttcagtctccaagaggaaagcaagaaacaaggctcgggtttttttctttcttttttctttcctttttttttaaggttcacagagggaataattcagaactccatgtgcgaaggcacttaatcaacaaacttatgagcagttagttcctccagtgcccttgggaaaaagcaactatttccaaaaggaaactttatttaaccgacgccacgtccccccgacactaaaactaaccagtaagtacagggagggaccgagaggcatctgcggccaacgccaaccccgatctccccgtgaaacgcgcagcccgcgcaggcgcccgcagctcccagctcc

SEQ ID NO: 97053 - DNA, 173 bp, Homo sapiens; identical to SEQ ID NO: 31733
  misc_feature 1..173: note = chr7:158937202-158937375
  misc_feature 1..173: note = hyper
  source 1..173: mol_type = genomic DNA

SEQ ID NO: 97054 - DNA, 34 bp, Homo sapiens
  misc_feature 1..34: note = chr7:158937576-158937610
  misc_feature 1..34: note = hyper
  source 1..34: mol_type = genomic DNA
cgcagctgtagccgagcgcccgagcgcgggggcc

SEQ ID NO: 97055 - DNA, 384 bp, Homo sapiens
  misc_feature 1..384: note = chr7:158937611-158937995
  misc_feature 1..384: note = hyper
  source 1..384: mol_type = genomic DNA
ccccctccgtcccggcagctggagcgcgctcaatgcacgcccgtcccccacgcgccccgccgctccgccccccgcccctgtccccgccccgcgctgccccaatcctcgtctccctcctcccccgagaacccccgctccgcgcccctcctcaccgccccccacttccccttccgctgcgccccgcgccctctcctcgcccctgggctctctgtccccgccgcgcgcgctccctctggtctcctcgacccccccagcctctctctccgttctcctcccctcttccctggcccacgcccccctcccggccgcgcctccccgatctgtgggcggaggggctgggaagcggggtgctcagtgcgcgcccggctccgagtagagagaact

SEQ ID NO: 97056 - DNA, 223 bp, Homo sapiens
  misc_feature 1..223: note = chr7:158938210-158938433
  misc_feature 1..223: note = hyper
  source 1..223: mol_type = genomic DNA
tttggtggggatccccgcagcctcaaagaggacatcaggtcgaacagaaagctggagaaaaacgcagacgggggtataggtgggtcccagcctcagctgggtggcgggttttgtgtcctgcgtttgcaaaacgggggtcattctctccccgcaaacgcggcggcgggtggggaacgctgggcggggactcacgcggtgccactggggccgccccgccgcgccc

SEQ ID NO: 97057 - DNA, 108 bp, Homo sapiens
  misc_feature 1..108: note = chr7:158948149-158948257
  misc_feature 1..108: note = hypo
  source 1..108: mol_type = genomic DNA
tttcataagcaccaccggcatgttgacagttgcgtggagttcagagtccatggaccctggggaccatgacgcccccgtgtgcaggtgacaacacgcctgctgaaggcc

SEQ ID NO: 97058 - DNA, 30 bp, Homo sapiens
  misc_feature 1..30: note = chr7:158950620-158950650
  misc_feature 1..30: note = hypo
  source 1..30: mol_type = genomic DNA
gcctggggctggccacggcgacatgaatgg

SEQ ID NO: 97059 - DNA, 549 bp, Homo sapiens
  misc_feature 1..549: note = chr7:158963388-158963937
  misc_feature 1..549: note = hypo
  source 1..549: mol_type = genomic DNA
gctcactaatggggccgctgcgagaatcgcgtgagcagaaacacggatgatcatggctcactgacggggcaactctgaggatcacgtgagcagaaacacacaaataatcacagaatcactgacggggccactgtgaggatcgcgtgagcagaaacacacagataaccaaggcctgaccaacggggctgctgggaggatcccgtgagcagaaacacggacgatcacagcatcactatcgagacggctctgaggatcctgtgagcaggacactggtgtgttatgctttaaagcttttccttgatcttggtgatttcacgtcttaggaaacctccctcactaatcagccggccccgtgggcaatgcagcttctcctgaaaagcaaacacttcaactttcaggcttcgtggccactgacccgcttctggccaggggcagcctcctccctacccctcgtgtaacggactacgggactggacatctgtcacgatgccatttgagacggaaagggcactgggccagtgtctggaactggcccgcacgcctcaggtc

SEQ ID NO: 97060 - DNA, 43 bp, Homo sapiens
  misc_feature 1..43: note = chr7:159023728-159023771
  misc_feature 1..43: note = hypo
  source 1..43: mol_type = genomic DNA
gggccataaagaggccgtggccggaggacggagcgggggcgtt

SEQ ID NO: 97061 - DNA, 17 bp, Homo sapiens
  misc_feature 1..17: note = chr7:1596347-1596364
  misc_feature 1..17: note = hypo
  source 1..17: mol_type = genomic DNA
atttgttttctgggccg

SEQ ID NO: 97062 - DNA, 854 bp, Homo sapiens
  misc_feature 1..854: note = chr7:1598548-1599402
  misc_feature 1..854: note = hypo
  source 1..854: mol_type = genomic DNA
cggctgagccagatgcgccagctcgggaaccgtggaccaagtgtactggtctggggatgtcaggagcagggcctggtccccagggaggggcagtcgggaggttgaccgctctgccacctgctcacagggctcgccggctgatcgaggcctcacccggtgctggtgtcacagcctctgcgcccggtcacaggaggcggcagggccggctgggcctgatttttctggcgggggcgggacactgaccaagcccattgcaggacagacctgtctgcccagatccaggcgacggggccctctgaccattgttcactgcgtccaggtgcccagagctgtggggaggctgagaagccgcccagccagtcccacaccctggccctggcacagccacctcctcctgctctcatgagaaacccggctgagggcccatgagctgttgcctggttccaggccggctgccctgctagtgcccaccccgaccccctgcctgcccgtctctctgcagatgcggacaggcatggtgtacccccctgcctgcctccttcactgctgggtggaactcggggcgcccaggagccgcctcctcagggctggctcatttgatgtcccaggctgagctgcacactagggggatgaggtgaccggtgggcacccatctcagacacccggcttcccaggtcccgcggccctcccctgggggccctggccagcagttcaccaaggcagcagccccgggtgtgagcagggggtgacagggatggggctccacatcctcccggctctgcttctgggattcccccggctcctgtccacgggcacggcctcctgagagccgcgtggggcgggcaggcagcatg

SEQ ID NO: 97063 - DNA, 316 bp, Homo sapiens
  misc_feature 1..316: note = chr7:1600538-1600854
  misc_feature 1..316: note = hypo
  source 1..316: mol_type = genomic DNA
tgggtacagctggcacggaccacaccctccaccttcccccctgcccggattttgggacccacatctgtccacgtgccacccctgcctcctgccatcccagcgggtgtgagcctggaccaatctccctgtccggtggatttcagacgtgggaccacaagtgggctggggtcccgatgccccttcacgagtgacgcagcccctgcctccccttctttggccccctcacccctgaaaagtcccattcgggagcctgagggtgtcgggacacggatcgccaccaagctctgcccctgcccacgcacgcctgctacccggg

SEQ ID NO: 97064 - DNA, 789 bp, Homo sapiens
  misc_feature 1..789: note = chr7:1607231-1608020
  misc_feature 1..789: note = hypo
  source 1..789: mol_type = genomic DNA
agttcctccctccaccggggagggaggtgagacttgagtccctgagtgggtgtctgggtgttcacgtgtcctgctgagcagcgcggggcggctgcctccaggtcaccacacctggcacacccggatcacctccctcagcgccttcagcccctccatgcttttgtccttcacggccacggcgaggaggactgctctgtttccagcttcttgagacacaaacgctaccaggttctttgcaaagacatggatgagaggctggtaaaggaaggagaagaaaccattttaactgcaagaaacctggttttttcctcaatgctttcatgaagtatcccttaggaacccaggcaggcttcccacaccaccattaaccgccacataagtccatgcaactgtgactcagagttctggcagcactcagaacactccagtcacgggcacactgctaaagaccatcactccattcattttcccagcgccttccgcagccccgcctcttctggctctctctcatctaaaagaacccaggaaagagaagcctgcagaagcgagtgctgtcgaatctcacgtgtgatctccacagagcacagcacagccagccgcctgctcacgtaatgtaccatggcaggggaggcggctcgaatgacaaaactgctgcttctgcttgtctgctggataaaatgcctgcgggctggacaaagcatccactgagggcaagcagggcgccttgagacccacaaatgcccggaaaatgctatcgctgtaggggtatttgtccgccagatgccccat

SEQ ID NO: 97065 - DNA, 78 bp, Homo sapiens
  misc_feature 1..78: note = chr7:1615015-1615093
  misc_feature 1..78: note = hypo
  source 1..78: mol_type = genomic DNA
tgaactgaagtatttcgtttaacaccacacagtaaacacaaaggaaacccaccgttgctgggccgccttccatcatgg

SEQ ID NO: 97066 - DNA, 36 bp, Homo sapiens
  misc_feature 1..36: note = chr7:1620503-1620539
  misc_feature 1..36: note = hypo
  source 1..36: mol_type = genomic DNA
tagagaaaagggaaacgagaccgggcagccaggttc

SEQ ID NO: 97067 - DNA, 40 bp, Homo sapiens
  misc_feature 1..40: note = chr7:1621494-1621534
  misc_feature 1..40: note = hypo
  source 1..40: mol_type = genomic DNA
ccccaatcccctcaccgtcttttgccgtcagccctctgcc

SEQ ID NO: 97068 - DNA, 123 bp, Homo sapiens
  misc_feature 1..123: note = chr7:1624765-1624888
  misc_feature 1..123: note = hypo
  source 1..123: mol_type = genomic DNA
tggtgaaccccaacacgaggacacaggcagtgccctctcaggaccactgtgggtgccaccaggcacgacttcctaaacacccacagagcaaaaacctggaaattcagccgaggcactgggacc

SEQ ID NO: 97069 - DNA, 15 bp, Homo sapiens
  misc_feature 1..15: note = chr7:1625802-1625817
  misc_feature 1..15: note = hypo
  source 1..15: mol_type = genomic DNA
tcctgggagtcagcc

SEQ ID NO: 97070 - DNA, 30 bp, Homo sapiens
  misc_feature 1..30: note = chr7:1640689-1640719
  misc_feature 1..30: note = hypo
  source 1..30: mol_type = genomic DNA
gggtgctgtggccagcgctgtgggggatag

SEQ ID NO: 97071 - DNA, 308 bp, Homo sapiens
  misc_feature 1..308: note = chr7:1641670-1641978
  misc_feature 1..308: note = hypo
  source 1..308: mol_type = genomic DNA
cagcctcagccctcccggtgccaagattcttcaacgtcctcgggatgcacctccgcactgtggggccatctgggtcagcccggacgcaccggcctctgtctgggtcccagtcttctcaccgccaggcgggcaggtcagcagaccaggcaggaccgagcccgtcgcccggggctcttgttgtctgtgccatttcggtgccttttgtccttgcttcccgccgctccttgaggatgtttaccggctgctggggccgtgccttccaggtgaggcctcggtcattccaggtgcagcctcggatcagggatgac

SEQ ID NO: 97072 - DNA, 92 bp, Homo sapiens
  misc_feature 1..92: note = chr7:16437156-16437248
  misc_feature 1..92: note = hypo
  source 1..92: mol_type = genomic DNA
acaacatgtgattgacgaaatgtgatgtgaccaatttgactgacatatgagacgtgacagattactgacgtgtgacacgtgacacgtgacca

SEQ ID NO: 97073 - DNA, 191 bp, Homo sapiens
  misc_feature 1..191: note = chr7:16460326-16460517
  misc_feature 1..191: note = hyper
  source 1..191: mol_type = genomic DNA
gcagagccccaggaccgcgagactatccgcacagcttctcctcaggccccacagctagaaccccaaatcgcctagtcccaacccatgcactctctaatcggcgccacacgacgggccttccccacaacctcatctgcttggggacgtaaagggctctgtgggggagctgcagctttcgtgcccatctgtta

SEQ ID NO: 97074 - DNA, 408 bp, Homo sapiens
  misc_feature 1..408: note = chr7:16460890-16461298
  misc_feature 1..408: note = hyper
  source 1..408: mol_type = genomic DNA
actcaggcaaggacccggctccgccggcctggcgctgcccggcggcccggcctccatggctgcgggcggaacggcgagccccgctagcctcgggccgatgcgaccccgcgctgctcccaccctcggccggggtcgcggggcgaagggcagaccacggagagggacgcagagcgcgcaagcagaaggcgcccccctcagccgtcggagccccgctgttgctgccccgcaggggacgatcccgacagctacggcagcagctgaggctgccgatctgccctcgcggctcggctgcggcctccgcacccggtcccagcgcctgcgggagggctgacttgcccgctctgcgcttcccccgggcaggcccagctgtcgccgcaagtggaaatgtcagaacgccctacatatcta

SEQ ID NO: 97075 - DNA, 189 bp, Homo sapiens
  misc_feature 1..189: note = chr7:16531866-16532055
  misc_feature 1..189: note = hypo
  source 1..189: mol_type = genomic DNA
atgggataacgtagacggcttaagcttttgtgaattttgccgataggcattttaaaattctggatcatgataatacaacacgctgtatcagatgactttcatcctgaggctctttatgcctaacaggacaacgacaaattaatatacagtatatatttcttccacgtagtctcacgaagcctgtacata

SEQ ID NO: 97076 - DNA, 30 bp, Homo sapiens
  misc_feature 1..30: note = chr7:1654887-1654917
  misc_feature 1..30: note = hypo
  source 1..30: mol_type = genomic DNA
atgattgaagttggacgaaaggattttcta

SEQ ID NO: 97077 - DNA, 63 bp, Homo sapiens
  misc_feature 1..63: note = chr7:16566510-16566573
  misc_feature 1..63: note = hypo
  source 1..63: mol_type = genomic DNA
tctcttcggtgccaccggcgggcgaggccggattaatcaccgctgcttcggccgcccatgtgt

SEQ ID NO: 97078 - DNA, 30 bp, Homo sapiens
  misc_feature 1..30: note = chr7:1659704-1659734
  misc_feature 1..30: note = hypo
  source 1..30: mol_type = genomic DNA
gcaccctggagcctccgacggggcggccac

SEQ ID NO: 97079 - DNA, 47 bp, Homo sapiens
  misc_feature 1..47: note = chr7:16793964-16794011
  misc_feature 1..47: note = hyper
  source 1..47: mol_type = genomic DNA
tccgctttcccaccccgtacccttctgccgctcgctcctgacatcca

SEQ ID NO: 97080 - DNA, 136 bp, Homo sapiens
  misc_feature 1..136: note = chr7:1680137-1680273
  misc_feature 1..136: note = hypo
  source 1..136: mol_type = genomic DNA
ccttggagccactggcgttggaagcaccgtttcctgccgtgtctcggaagggggcgctgtggcacgtggcagcagagccagcgcgctgcagccctctctgagccccgggtggtccacccctcggcccctgctgggg

SEQ ID NO: 97081 - DNA, 50 bp, Homo sapiens
  misc_feature 1..50: note = chr7:1681189-1681239
  misc_feature 1..50: note = hypo
  source 1..50: mol_type = genomic DNA
gctacccccttctcccgccccccagctctttccatcgcattgccatggtt

SEQ ID NO: 97082 - DNA, 227 bp, Homo sapiens
  misc_feature 1..227: note = chr7:16844142-16844369
  misc_feature 1..227: note = hypo
  source 1..227: mol_type = genomic DNA
ataatatattccaagcgggcaatccgagctgaggtgtcatagtggagaagcctatggggctttgctttagcccgtgggaaagaaagctttagatggtgactgagacgaaaatccctggaccctgtcccaggcttgaaaaatcctaggattcacctactcttggaaattttgtttcgcaaaagagaaagcatttctctgaactaactcgggaacgtcacactgtgcca

SEQ ID NO: 97083 - DNA, 100 bp, Homo sapiens; identical to SEQ ID NO: 41092
  misc_feature 1..100: note = chr7:1684968-1685068
  misc_feature 1..100: note = hypo
  source 1..100: mol_type = genomic DNA

SEQ ID NO: 97084 - DNA, 151 bp, Homo sapiens
  misc_feature 1..151: note = chr7:1688950-1689101
  misc_feature 1..151: note = hypo
  source 1..151: mol_type = genomic DNA
cctccctggatctcacgtcctcatttggcaaacagggatagtcgtgatccctcccttagggccggtgcttggaaagaatgaacgaacatgggtaaggtgtgcctggtgagcgctgtctgggctgaaggaggagtttgagaaggcggcttta

SEQ ID NO: 97085 - DNA, 279 bp, Homo sapiens
  misc_feature 1..279: note = chr7:1690421-1690700
  misc_feature 1..279: note = hypo
  source 1..279: mol_type = genomic DNA
acgcaggggaaggcccgctgcaggagaaggggaactgaagtaggggccggggctgggccagtccacttggcaaggacgtggcttgcagggggtgctgagaccttggccttttgccaaagcaccccgctccctggagccacttgcccacccctcccccaggctggttcggccccagccaggtaggtccaaagtcctgtgctgccggagtggagtctaataagcccctcctggcaaggggctcaccaccaaggcaccccacgatgacggctcaggaagtgg

SEQ ID NO: 97086 - DNA, 30 bp, Homo sapiens
  misc_feature 1..30: note = chr7:1690977-1691007
  misc_feature 1..30: note = hypo
  source 1..30: mol_type = genomic DNA
ccagagaatcttgcacggtgaagcgggcgg

SEQ ID NO: 97087 - DNA, 242 bp, Homo sapiens
  misc_feature 1..242: note = chr7:1693830-1694072
  misc_feature 1..242: note = hypo
  source 1..242: mol_type = genomic DNA
ggagaccagcccccacgcagaccccgccctgcctgcccatccagctcctggagccagcgggcgtctgcgccccagtgtttggctgcagtgagtcaggccttggggagcaatgcgccatgctcagctctgggagcgggccagggcactggtcctggggctaaggcccagcgtgtacaggctgtttgctgagggcgtgctttgaggaagagcatacccgggttccaaagcgcctacagtgaaca

SEQ ID NO: 97088 - DNA, 106 bp, Homo sapiens
  misc_feature 1..106: note = chr7:1694880-1694986
  misc_feature 1..106: note = hypo
  source 1..106: mol_type = genomic DNA
ctagagtgactcacacgaacgcagatggcggagcctaccccacgcctgggcctcgcggtacagcctgtggctccggggctacacacccgcacggcaggtgactgca

SEQ ID NO: 97089 - DNA, 1035 bp, Homo sapiens
  misc_feature 1..1035: note = chr7:1704118-1705153
  misc_feature 1..1035: note = hyper
  source 1..1035: mol_type = genomic DNA
cggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcg

SEQ ID NO: 97090 - DNA, 307 bp, Homo sapiens
  misc_feature 1..307: note = chr7:1705386-1705693
  misc_feature 1..307: note = hyper
  source 1..307: mol_type = genomic DNA
aatgtgctacaacctcggcgctgccgcggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtccagccgggcgggctccgggaggggccggcagggcgggagggggaggagggctgtctggagccagcgagcccggaggaggaagagg

SEQ ID NO: 97091 - DNA, 538 bp, Homo sapiens
  misc_feature 1..538: note = chr7:1706195-1706733
  misc_feature 1..538: note = hyper
  source 1..538: mol_type = genomic DNA
ctagggctagggaggcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggagggagtgggctgtgggtgcctcgacttcgcaaagccggcgtgggggggcgcagcgccccgccccgcgccgcttgaacctccggagggggtgttacgggacccccgcccccaccccagccggtggctgggctctgccgaccgctgcggagctcccgggaaggacccgctcgcggctattaataggcgtcggtgaccctagcctctcccggtccgggaagctggcgcggcggggctgggctgggctgggctgccgagtggggcgggaccccggggcccagagcggacccccagctctcctggtccctcttccgccgctcttccctccctgccgcctgctttcctcc

SEQ ID NO: 97092 - DNA, 370 bp, Homo sapiens
  misc_feature 1..370: note = chr7:1706939-1707309
  misc_feature 1..370: note = hyper
  source 1..370: mol_type = genomic DNA
cttcctcccaacccacggcgagcgcaacacattcgcccgcccctgcggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcctgcctcggtgtctgcagagcccagccctcaggcagcgtggggatctttgt

SEQ ID NO: 97093 - DNA, 502 bp, Homo sapiens
  misc_feature 1..502: note = chr7:1709060-1709562
  misc_feature 1..502: note = hyper
  source 1..502: mol_type = genomic DNA
ggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggac

SEQ ID NO: 97094 - DNA, 306 bp, Homo sapiens; identical to SEQ ID NO: 31010
  misc_feature 1..306: note = chr7:1709617-1709923
  misc_feature 1..306: note = hyper
  source 1..306: mol_type = genomic DNA

SEQ ID NO: 97095 - DNA, 289 bp, Homo sapiens; identical to SEQ ID NO: 8844
  misc_feature 1..289: note = chr7:1709955-1710244
  misc_feature 1..289: note = hyper
  source 1..289: mol_type = genomic DNA

SEQ ID NO: 97096 - DNA, 46 bp, Homo sapiens; identical to SEQ ID NO: 31012
  misc_feature 1..46: note = chr7:1710324-1710370
  misc_feature 1..46: note = hyper
  source 1..46: mol_type = genomic DNA

SEQ ID NO: 97097 - DNA, 76 bp, Homo sapiens
  misc_feature 1..76: note = chr7:1712668-1712744
  misc_feature 1..76: note = hypo
  source 1..76: mol_type = genomic DNA
agcggatggtggcaccgccgcggacattggatacatttgtcatctctccagcgcccccccccgctctttccttttt

SEQ ID NO: 97098 - DNA, 193 bp, Homo sapiens
  misc_feature 1..193: note = chr7:171314-171507
  misc_feature 1..193: note = hypo
  source 1..193: mol_type = genomic DNA
acagacaaggaaaaccgccgttacgggcactgctgccatctcgcaatttacataaagtctcagctctgtgcgtgggacagcagcgtttgaagctgtccccatcaagggcctgtacaaccacctccttcacagttaggggttggccgtcctgaggctgcccgaccccctcccggctccccgaccccctcccggc

SEQ ID NO: 97099 - DNA, 50 bp, Homo sapiens; identical to SEQ ID NO: 41096
  misc_feature 1..50: note = chr7:1714947-1714997
  misc_feature 1..50: note = hypo
  source 1..50: mol_type = genomic DNA

SEQ ID NO: 97100 - DNA, 178 bp, Homo sapiens
  misc_feature 1..178: note = chr7:1717985-1718163
  misc_feature 1..178: note = hypo
  source 1..178: mol_type = genomic DNA
tcagagcagctctcccgccccaccctgcggccctgcatgtcagttgtgggtaaggcccgcgccactgggaatcttcacacagcccggagggaggtgctgtgtgcccatttcacagaccagaaggccgaggcatggagtggggaagtaacatggtccaggctcacggctcacatgtgcc

SEQ ID NO: 97101 - DNA, 158 bp, Homo sapiens
  misc_feature 1..158: note = chr7:1719538-1719696
  misc_feature 1..158: note = hypo
  source 1..158: mol_type = genomic DNA
ccagatcaccatcctcgaggaaaggagagggcagggacagagatggaacggggagcagaagggggcgcgtgtgcccctgagcgctcctgtgtgcaggtgcacagttcattaaacatgaccatgaagtcgggacatgggagttacgcattagaagtgtt

SEQ ID NO: 97102 - DNA, 206 bp, Homo sapiens; identical to SEQ ID NO: 41098
  misc_feature 1..206: note = chr7:1731744-1731950
  misc_feature 1..206: note = hypo
  source 1..206: mol_type = genomic DNA

SEQ ID NO: 97103 - DNA, 278 bp, Homo sapiens
  misc_feature 1..278: note = chr7:1733166-1733444
  misc_feature 1..278: note = hypo
  source 1..278: mol_type = genomic DNA
gcaagaacacatacacgcctgtggacgtagccttgctgggtgtgtgcacatctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaaccccagagcaggtgtctgggagaccctgatcagtgctgacagacacggggtgcgggacacgtgggat

SEQ ID NO: 97104 - DNA, 30 bp, Homo sapiens
  misc_feature 1..30: note = chr7:17339561-17339591
  misc_feature 1..30: note = hyper
  source 1..30: mol_type = genomic DNA
tgggagtggatgcaacggacaggatacggt

SEQ ID NO: 97105 - DNA, 30 bp, Homo sapiens
  misc_feature 1..30: note = chr7:173466-173496
  misc_feature 1..30: note = hypo
  source 1..30: mol_type = genomic DNA
gctgcctgcctgcagcgggagctaacgggg

SEQ ID NO: 97106 - DNA, 366 bp, Homo sapiens
  misc_feature 1..366: note = chr7:1734686-1735052
  misc_feature 1..366: note = hypo
  source 1..366: mol_type = genomic DNA
cctcactttgagttacgctgcagacggctccggatgcacgtggctgtgccaggcagcagacgtggccgacaggcacatggtgggacctgctctgtggctccagagctcatgcgcagcccgctggggctgtgagggttctgtccatccaccaggaaggccaccaggaccctgctcctgcctgagaaccccaggaagtagtagcgtgccaggtgcgtggccggcctcccagcccttcccagcaccagctgcgtcctcctcctccagggctgcagctcagggctcaggtgtccgcgtcgagggcactccctaaagggcaggagcaggaccattggcacaagcctgggcgagtctcgctgggaggcagga

SEQ ID NO: 97107 - DNA, 34 bp, Homo sapiens
  misc_feature 1..34: note = chr7:17413242-17413276
  misc_feature 1..34: note = hypo
  source 1..34: mol_type = genomic DNA
gtgagccgccgcgcccaaccgcaaagtgcacttt

SEQ ID NO: 97108 - DNA, 174 bp, Homo sapiens
  misc_feature 1..174: note = chr7:1744404-1744578
  misc_feature 1..174: note = hypo
  source 1..174: mol_type = genomic DNA
ggacttgagtggcaacgtcacctgtctgctgagggcctgcctgctgtatgctggggtgtgggctgggcaggccccacaccaagggtcagccctgtccaccagggctcgaggtcagcttagagcctcatggagctcccggctggagagaaggcagccgtgcgtgtccccgtcaga

SEQ ID NO: 97109 - DNA, 558 bp, Homo sapiens
  misc_feature 1..558: note = chr7:1775495-1776053
  misc_feature 1..558: note = hypo
  source 1..558: mol_type = genomic DNA
cacaaccctgggaggcggacaccgtgatgatctctgtttgacagatgaggggactgaggctaagagaggttaagtgacatgcccaaggtcacacagcaggcgcacggcagagccaacaccatctcctggcccacgatggttctgtgtcccctgacgcagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagcagtaaacatgatctatcggcaaaacattggaacgatgaaaagttatcgatctatagctttccaaccatctccccgcctcccccacacgtctggccctccgcccacctttccccctggagctggaaacttcgctccatcagcagaatcctcagtccagccccggccccggccccacaccagccctggcctcttgtctggtttaaatgatcgagacgaggaacaa

SEQ ID NO: 97110 - DNA, 30 bp, Homo sapiens
  misc_feature 1..30: note = chr7:1777547-1777577
  misc_feature 1..30: note = hypo
  source 1..30: mol_type = genomic DNA
gtgaatagggtatgccggccaccccttcca

SEQ ID NO: 97111 - DNA, 51 bp, Homo sapiens
  misc_feature 1..51: note = chr7:1779654-1779705
  misc_feature 1..51: note = hypo
  source 1..51: mol_type = genomic DNA
gagccacaggggacccgtggccaccctgttggacagcgcaagtacagaacc

SEQ ID NO: 97112 - DNA, 192 bp, Homo sapiens
  misc_feature 1..192: note = chr7:1783194-1783386
  misc_feature 1..192: note = hypo
  source 1..192: mol_type = genomic DNA
ccagagggggcacagcgtgccagggacacagggcgggcgagctcagaccgagacctggcagacacgagtccccggacaggccagaatacctcccggtgcctccctcccagagggctggagaggagcccgcgccccggaaggattctgtgttgagggctgcggaccctgcggtgagtgcgcagggtagctcct

SEQ ID NO: 97113 - DNA, 231 bp, Homo sapiens
  misc_feature 1..231: note = chr7:1784226-1784457
  misc_feature 1..231: note = hypo
  source 1..231: mol_type = genomic DNA
gtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtg

SEQ ID NO: 97114 - DNA, 237 bp, Homo sapiens
  misc_feature 1..237: note = chr7:1784690-1784927
  misc_feature 1..237: note = hypo
  source 1..237: mol_type = genomic DNA
ggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcct

SEQ ID NO: 97115 - DNA, 506 bp, Homo sapiens
  misc_feature 1..506: note = chr7:1786393-1786899
  misc_feature 1..506: note = hypo
  source 1..506: mol_type = genomic DNA
caccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggcc

SEQ ID NO: 97116 - DNA, 282 bp, Homo sapiens
  misc_feature 1..282: note = chr7:1787137-1787419
  misc_feature 1..282: note = hypo
  source 1..282: mol_type = genomic DNA
acataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccag

SEQ ID NO: 97117 - DNA, 30 bp, Homo sapiens
  misc_feature 1..30: note = chr7:1790379-1790409
  misc_feature 1..30: note = hypo
  source 1..30: mol_type = genomic DNA
ctggttatccattgccgtgatcatgctgcc

SEQ ID NO: 97118 - DNA, 73 bp, Homo sapiens
  misc_feature 1..73: note = chr7:1795137-1795210
  misc_feature 1..73: note = hypo
  source 1..73: mol_type = genomic DNA
gcttttaataagtgccgtcaccttcagctgtgcccagtgtccttaagtccaaagtgttcgtgattcttccttt

SEQ ID NO: 97119 - DNA, 30 bp, Homo sapiens
  misc_feature 1..30: note = chr7:1797456-1797486
  misc_feature 1..30: note = hypo
  source 1..30: mol_type = genomic DNA
tataaatagcaccaccgtgtcaacgtgtaa

SEQ ID NO: 97120 - DNA, 30 bp, Homo sapiens
  misc_feature 1..30: note = chr7:1798877-1798907
  misc_feature 1..30: note = hypo
  source 1..30: mol_type = genomic DNA
ccaggccccccagcacgccaggagctgctg

SEQ ID NO: 97121 - DNA, 91 bp, Homo sapiens
  misc_feature 1..91: note = chr7:1800821-1800912
  misc_feature 1..91: note = hypo
  source 1..91: mol_type = genomic DNA
agccaaaaatagaaacgactgaagcgtccaccaacaggggaaggaccgaattacaatatgaccagagactaaacgccggcagcggtgaaga

SEQ ID NO: 97122 - DNA, 90 bp, Homo sapiens
  misc_feature 1..90: note = chr7:18125972-18126062
  misc_feature 1..90: note = hyper
  source 1..90: mol_type = genomic DNA
gagccacggggggcgcgagagggcgaggcagcggcctggcttctccccagcaccgttctctgtcacggccgccgcctgaccatcaccccg

SEQ ID NO: 97123 - DNA, 143 bp, Homo sapiens
  misc_feature 1..143: note = chr7:18126082-18126225
  misc_feature 1..143: note = hyper
  source 1..143: mol_type = genomic DNA
cgcttcagaaatcccaagtcgtcttaggttccctggtccttcccctgggggggaaaaaaaacgctggtgcagcccagagcccttttccgctccaccccgggatgtcctcgctgccctcccgcctcccgcgcgtccttcccagc

SEQ ID NO: 97124 - DNA, 15 bp, Homo sapiens
  misc_feature 1..15: note = chr7:18126443-18126458
  misc_feature 1..15: note = hyper
  source 1..15: mol_type = genomic DNA
ttttagcaaattctc

SEQ ID NO: 97125 - DNA, 578 bp, Homo sapiens
  misc_feature 1..578: note = chr7:18126465-18127043
  misc_feature 1..578: note = hyper
  source 1..578: mol_type = genomic DNA
cgccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggt

SEQ ID NO: 97126 - DNA, 30 bp, Homo sapiens
  misc_feature 1..30: note = chr7:1819163-1819193
  misc_feature 1..30: note = hypo
  source 1..30: mol_type = genomic DNA
gtatacacagtcgtgcgccgcgtagaaaca

SEQ ID NO: 97127 - DNA, 79 bp, Homo sapiens
  misc_feature 1..79: note = chr7:1838908-1838987
  misc_feature 1..79: note = hypo
  source 1..79: mol_type = genomic DNA
gaggacatggaggaccggcattcccaaacactgcttatgagagtgacgccagtcactagaaatctgtttggcagtgtct

SEQ ID NO: 97128 - DNA, 49 bp, Homo sapiens
  misc_feature 1..49: note = chr7:1849747-1849796
  misc_feature 1..49: note = hypo
  source 1..49: mol_type = genomic DNA
gccaggactgtcaggcgccagctccctcggtgaacgtgacaaggcccct

SEQ ID NO: 97129 - DNA, 51 bp, Homo sapiens
  misc_feature 1..51: note = chr7:186628-186679
  misc_feature 1..51: note = hypo
  source 1..51: mol_type = genomic DNA
aggattagaattgcacgcggcgcagcatctggcgcccgctggacgctcagt

SEQ ID NO: 97130 - DNA, 40 bp, Homo sapiens
  misc_feature 1..40: note = chr7:1879361-1879401
  misc_feature 1..40: note = hypo
  source 1..40: mol_type = genomic DNA
ttagaacatcccccccgcctccccccggctcccagggcaa

SEQ ID NO: 97131 - DNA, 30 bp, Homo sapiens
  misc_feature 1..30: note = chr7:1883040-1883070
  misc_feature 1..30: note = hypo
  source 1..30: mol_type = genomic DNA
gaaggggcccaggtgcggtgtagacctcct

SEQ ID NO: 97132 - DNA, 30 bp, Homo sapiens
  misc_feature 1..30: note = chr7:1888859-1888889
  misc_feature 1..30: note = hypo
  source 1..30: mol_type = genomic DNA
gcggcacttgggaagcgctgctctgtggga

SEQ ID NO: 97133 - DNA, 30 bp, Homo sapiens
  misc_feature 1..30: note = chr7:1913796-1913826
  misc_feature 1..30: note = hypo
  source 1..30: mol_type = genomic DNA
gcagacagtggctggcgccagaggtcagtg

SEQ ID NO: 97134 - DNA, 86 bp, Homo sapiens
  misc_feature 1..86: note = chr7:19145808-19145894
  misc_feature 1..86: note = hyper
  source 1..86: mol_type = genomic DNA
aatccccccattccccgttcccaatctattacatttcaaaggaggagaaagaactggaaaaccccgtttcctttgagaaacgcgtc

SEQ ID NO: 97135 - DNA, 154 bp, Homo sapiens; identical to SEQ ID NO: 634
  misc_feature 1..154: note = chr7:19146031-19146185
  misc_feature 1..154: note = hyper
  source 1..154: mol_type = genomic DNA

SEQ ID NO: 97136 - DNA, 345 bp, Homo sapiens; identical to SEQ ID NO: 635
  misc_feature 1..345: note = chr7:19146237-19146582
  misc_feature 1..345: note = hyper
  source 1..345: mol_type = genomic DNA

SEQ ID NO: 97137 - DNA, 974 bp, Homo sapiens
  misc_feature 1..974: note = chr7:19146925-19147899
  misc_feature 1..974: note = hyper
  source 1..974: mol_type = genomic DNA
cttctaaacccaatacgcttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttccctacccccaaccccgtttgctgtcttag

SEQ ID NO: 97138 - DNA, 68 bp, Homo sapiens
  misc_feature 1..68: note = chr7:19152223-19152291
  misc_feature 1..68: note = hyper
  source 1..68: mol_type = genomic DNA
cgcgagccgggcccgccacccacgcaggggagaccgtgcccgtgcccctctcccgcgcctgccgcagg

SEQ ID NO: 97139 - DNA, 99 bp, Homo sapiens
  misc_feature 1..99: note = chr7:19155963-19156062
  misc_feature 1..99: note = hyper
  source 1..99: mol_type = genomic DNA
acaaaaattgaaagccgaaagaaagggtggcgctgacaaaacggtccttacccgtgaccctgggtgtctctgtctcccctcctgtcacgcacactcacg

SEQ ID NO: 97140 - skipped

SEQ ID NO: 97141 - DNA, 341 bp, Homo sapiens
  misc_feature 1..341: note = chr7:19156303-19156644
  misc_feature 1..341: note = hyper
  source 1..341: mol_type = genomic DNA
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactg

SEQ ID NO: 97142 - DNA, 42 bp, Homo sapiens
  misc_feature 1..42: note = chr7:19156704-19156746
  misc_feature 1..42: note = hyper
  source 1..42: mol_type = genomic DNA
gcccgcagacttcttgccgcgcttgccctgggccgggctgcc

SEQ ID NO: 97143 - DNA, 138 bp, Homo sapiens; identical to SEQ ID NO: 640
  misc_feature 1..138: note = chr7:19157055-19157193
  misc_feature 1..138: note = hyper
  source 1..138: mol_type = genomic DNA

SEQ ID NO: 97144 - DNA, 69 bp, Homo sapiens; identical to SEQ ID NO: 641
  misc_feature 1..69: note = chr7:19157194-19157263
  misc_feature 1..69: note = hyper
  source 1..69: mol_type = genomic DNA

SEQ ID NO: 97145 - DNA, 303 bp, Homo sapiens; identical to SEQ ID NO: 642
  misc_feature 1..303: note = chr7:19157264-19157567
  misc_feature 1..303: note = hyper
  source 1..303: mol_type = genomic DNA

SEQ ID NO: 97146 - DNA, 466 bp, Homo sapiens
  misc_feature 1..466: note = chr7:19157633-19158099
  misc_feature 1..466: note = hyper
  source 1..466: mol_type = genomic DNA
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatccaaaggactacgcctcggaaggtgctcgaaagaggcagaagttcactcttcggtggaaggaaacccagtccatgggaaaggcagc

SEQ ID NO: 97147 - DNA, 90 bp, Homo sapiens
  misc_feature 1..90: note = chr7:191827-191917
  misc_feature 1..90: note = hyper
  source 1..90: mol_type = genomic DNA
cacacacacatgcgcacacacacgcacacgcctgcactcacacacccccgtcggccccaagcaggaaggcgcccccggcacaccagcccc

SEQ ID NO: 97148 - DNA, 99 bp, Homo sapiens
  misc_feature 1..99: note = chr7:19183647-19183746
  misc_feature 1..99: note = hyper
  source 1..99: mol_type = genomic DNA
actttagatgcaaagcgtagatttgcactctggctaaggcactgaatgaacaccactgtggccctgggacaaggagctgtggtccgtctgggatcaact

SEQ ID NO: 97149 - DNA, 368 bp, Homo sapiens; identical to SEQ ID NO: 31082
  misc_feature 1..368: note = chr7:19184058-19184426
  misc_feature 1..368: note = hyper
  source 1..368: mol_type = genomic DNA

SEQ ID NO: 97150 - DNA, 321 bp, Homo sapiens
  misc_feature 1..321: note = chr7:19184564-19184885
  misc_feature 1..321: note = hyper
  source 1..321: mol_type = genomic DNA
cgatccgggacagccttttctcgtaagcaaacgtgggcaccttcctccgcagctggtcaaaggcctcgttgaggttgaacatccgcttcctttcgcggatgttggcggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctgggtcttccctctcggagcgcaagggctgggtcccccaaggagaccccgggtg

SEQ ID NO: 97151 - DNA, 66 bp, Homo sapiens
  misc_feature 1..66: note = chr7:19184960-19185026
  misc_feature 1..66: note = hyper
  source 1..66: mol_type = genomic DNA
cgcagctctccggataggccgccatcgcttcggcttggccctgcctctcatcggttttccgcaggg

SEQ ID NO: 97152 - DNA, 184 bp, Homo sapiens
  misc_feature 1..184: note = chr7:192430-192614
  misc_feature 1..184: note = hyper
  source 1..184: mol_type = genomic DNA
gaggaggaaggagagcgggagcgcagccggcccgggcccagccgtgactcgtggggcggcggctccgccaatctgtgggcgctgacgcggggggcggctccgcggcgctcgatatctgcccgcccgggacgcggggcgccgagaggctcggccaggcgggagctgcgctcggggcggccgctgc

SEQ ID NO: 97153 - DNA, 125 bp, Homo sapiens
  misc_feature 1..125: note = chr7:192976-193101
  misc_feature 1..125: note = hyper
  source 1..125: mol_type = genomic DNA
tccggagaggccgagcggggacgggcccgagatggcgcggggacccagcgctccggcggcgggcgccctgcacgcggcccgggcccggggacagccccggagctggtagccgcccggcaccgatg

SEQ ID NO: 97154 - DNA, 104 bp, Homo sapiens
  misc_feature 1..104: note = chr7:1931869-1931973
  misc_feature 1..104: note = hypo
  source 1..104: mol_type = genomic DNA
tgcggcccaagggtgcgggaggctgcacggcccaggctcgtacaagtcattctaggaagttcccgcaaagacaacactgcccaccagcacgttcctcagcatgc

SEQ ID NO: 97155 - DNA, 96 bp, Homo sapiens
  misc_feature 1..96: note = chr7:193612-193708
  misc_feature 1..96: note = hyper
  source 1..96: mol_type = genomic DNA
gctgctgcgagaccccggcccgcgtcggtccgagtcgccccccggccccggcggagacgcctccctcctggccaggctgttcgagcacccgcttta

SEQ ID NO: 97156 - DNA, 39 bp, Homo sapiens
  misc_feature 1..39: note = chr7:193984-194023
  misc_feature 1..39: note = hyper
  source 1..39: mol_type = genomic DNA
cttgggaggggctgccggctggtccgggagctgtgccct

SEQ ID NO: 97157 - DNA, 150 bp, Homo sapiens
  misc_feature 1..150: note = chr7:1962361-1962511
  misc_feature 1..150: note = hypo
  source 1..150: mol_type = genomic DNA
caccagccaggtctgcggtgagctgcacggtttctgcagatgctctttggcaaacttgggggttctcggcttctcctggtttgccgagtttccccatgaacgtgtgttgggcctcgctgactgcatttgtgcatccgttggtttggccat

SEQ ID NO: 97158 - DNA, 52 bp, Homo sapiens
  misc_feature 1..52: note = chr7:1970869-1970921
  misc_feature 1..52: note = hypo
  source 1..52: mol_type = genomic DNA
caactcctcaccccacgcacggtcacaggagcgagggcgcgtcgtggggtcc

SEQ ID NO: 97159 - DNA, 30 bp, Homo sapiens
  misc_feature 1..30: note = chr7:19813245-19813275
  misc_feature 1..30: note = hyper
  source 1..30: mol_type = genomic DNA
atgcctacgtcaacgcgggctcattctgag

SEQ ID NO: 97160 - DNA, 30 bp, Homo sapiens; identical to SEQ ID NO: 41114
  misc_feature 1..30: note = chr7:2024812-2024842
  misc_feature 1..30: note = hypo
  source 1..30: mol_type = genomic DNA

SEQ ID NO: 97161 - DNA, 35 bp, Homo sapiens
  misc_feature 1..35: note = chr7:2037950-2037985
  misc_feature 1..35: note = hypo
  source 1..35: mol_type = genomic DNA
tcaagatgccagctccgaggcgtccgtgcctctgt

SEQ ID NO: 97162 - DNA, 132 bp, Homo sapiens
  misc_feature 1..132: note = chr7:2056554-2056686
  misc_feature 1..132: note = hypo
  source 1..132: mol_type = genomic DNA
ttgtcagtaccaacgcgcggacgccgcgcaaggccggggcgggggacttcccttggtaaacaagctgtaattgtctcttttattgatcagtaaatctctgagagcttctcttcgtgacggctctcttcagcc

SEQ ID NO: 97163 - DNA, 24 bp, Homo sapiens
  misc_feature 1..24: note = chr7:20710238-20710262
  misc_feature 1..24: note = hypo
  source 1..24: mol_type = genomic DNA
aagaagcaagctggccgggtgcgg

SEQ ID NO: 97164 - DNA, 44 bp, Homo sapiens
  misc_feature 1..44: note = chr7:20719837-20719881
  misc_feature 1..44: note = hypo
  source 1..44: mol_type = genomic DNA
tatgctgttagaaatcgggatagtggtgacccttggtataggtg

SEQ ID NO: 97165 - DNA, 139 bp, Homo sapiens; identical to SEQ ID NO: 41210
  misc_feature 1..139: note = chr7:20720174-20720313
  misc_feature 1..139: note = hypo
  source 1..139: mol_type = genomic DNA

SEQ ID NO: 97166 - DNA, 30 bp, Homo sapiens
  misc_feature 1..30: note = chr7:20756837-20756867
  misc_feature 1..30: note = hypo
  source 1..30: mol_type = genomic DNA
gtgtgttagtcagctcgggcttccataaca

SEQ ID NO: 97167 - DNA, 16 bp, Homo sapiens
  misc_feature 1..16: note = chr7:20757821-20757837
  misc_feature 1..16: note = hypo
  source 1..16: mol_type = genomic DNA
gcgcctggcccaaata

SEQ ID NO: 97168 - DNA, 324 bp, Homo sapiens
  misc_feature 1..324: note = chr7:20816252-20816576
  misc_feature 1..324: note = hyper
  source 1..324: mol_type = genomic DNA
cgcttcccagctttccggaccccggagagagggggtgggggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttccttccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 97169 - DNA, 83 bp, Homo sapiens; identical to SEQ ID NO: 31085
  misc_feature 1..83: note = chr7:20817170-20817253
  misc_feature 1..83: note = hyper
  source 1..83: mol_type = genomic DNA

SEQ ID NO: 97170 - DNA, 420 bp, Homo sapiens
  misc_feature 1..420: note = chr7:20817537-20817957
  misc_feature 1..420: note = hyper
  source 1..420: mol_type = genomic DNA
gaggccctaggatggcgcagggcagcgggctggtgcgggaaaactacagagcaagcgagggagggaagcgaaggcaggggaatccctcaccccgtccggcccgagtgtcttttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactctt

SEQ ID NO: 97171 - DNA, 309 bp, Homo sapiens
  misc_feature 1..309: note = chr7:20817982-20818291
  misc_feature 1..309: note = hyper
  source 1..309: mol_type = genomic DNA
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagcccca

SEQ ID NO: 97172 - DNA, 145 bp, Homo sapiens
  misc_feature 1..145: note = chr7:20823186-20823331
  misc_feature 1..145: note = hyper
  source 1..145: mol_type = genomic DNA
tgctgaaacttgcatcggttccacctcagggaacaaagaaaaagaggcagactgacattgggagatctaaactctacaaactctgggtctcgggctgccaaaagtcacccccaccaagccccgacagcctgagtaggacgtccgg

SEQ ID NO: 97173 - DNA, 497 bp, Homo sapiens; identical to SEQ ID NO: 646
  misc_feature 1..497: note = chr7:20823382-20823879
  misc_feature 1..497: note = hyper
  source 1..497: mol_type = genomic DNA

SEQ ID NO: 97174 - DNA, 225 bp, Homo sapiens
  misc_feature 1..225: note = chr7:20823919-20824144
  misc_feature 1..225: note = hyper
  source 1..225: mol_type = genomic DNA
cgttgcggtgcccgggctcggggggctgcagcagctctggggagtggcagggcgggctgcccgcggcgctgtgctcgctgtcggtgtcgctgcccttcttgccgccgctgcccgagcccgccgagccgccgccgccgccgccgccactgtgcgtcttcacgtgcttgctgaggtggtcgctgcgcatgaagcgcttgttgcaaactggacaggcgaagcgcttct

SEQ ID NO: 97175 - DNA, 345 bp, Homo sapiens; identical to SEQ ID NO: 31091
  misc_feature 1..345: note = chr7:20824475-20824820
  misc_feature 1..345: note = hyper
  source 1..345: mol_type = genomic DNA

SEQ ID NO: 97176 - DNA, 425 bp, Homo sapiens
  misc_feature 1..425: note = chr7:20824835-20825260
  misc_feature 1..425: note = hyper
  source 1..425: mol_type = genomic DNA
cgccatgcccacccgcgggtagatgccctgcagcccgtccacagaggtgtgcaccttggagatgaacaccggctggtgggagccgtcctgcgagtgcgcggaggagccgccgccgccgcccccgccgccgccgccgctgcccccggaaactccgggggcctggaaaacagagtagtcgttggcgaagggcgagctggaggcggcggctgcggcggcggcggcggcggctgcggcgctgctggaggtgagggagaaggcgctggagccaggcgagccgccgcagctgaacgagtcggacaccagggccgcggcagccgcggctgctgccgcggccgccgcagccgccgaggacgagccgccgttcctggaggccccggacacgccgaagcttgagagactggaacccactacgttgcagctggcgg

SEQ ID NO: 97177 - DNA, 339 bp, Homo sapiens
  misc_feature 1..339: note = chr7:20826499-20826838
  misc_feature 1..339: note = hyper
  source 1..339: mol_type = genomic DNA
tacaatgatcagttccgcccattccaccacaattgtagctccctctccggctttgaagtgccgcggaggcgcggccagccaatctgcggcctcgccgggccgcgcggcgcgcgcgccgtgaggtcatcggcgccgccgcctgccgccgtggtggaagggggagtgggagcggagggggcgggggcggctgcgtgtgttacaaagcgcaaagcgcgcgctcgcgtgtatgagtgtgtgtgtaacaatgtaactgtgtgcgagtgtgaccaggcgtaggagaggacagtgcggagactggagggaggggggatgggggtgtgacaccgtaacagtgacagt

SEQ ID NO: 97178 - DNA, 155 bp, Homo sapiens
  misc_feature 1..155: note = chr7:20827308-20827463
  misc_feature 1..155: note = hyper
  source 1..155: mol_type = genomic DNA
taacttggtaaacagcgtcactacatttttgaagaagatctttaaacccaccttttctttcccggctctccaacgaaatagtagaaaggttgagaggctaagggttatttttagggatgcgttgggacgtggatgcgcgcctgcgcgcccatgag

SEQ ID NO: 97179 - DNA, 34 bp, Homo sapiens
  misc_feature 1..34: note = chr7:20827523-20827557
  misc_feature 1..34: note = hyper
  source 1..34: mol_type = genomic DNA
attctgctttagaagtgcacgtctcactctaggg

SEQ ID NO: 97180 - DNA, 111 bp, Homo sapiens
  misc_feature 1..111: note = chr7:20828484-20828595
  misc_feature 1..111: note = hyper
  source 1..111: mol_type = genomic DNA
tttctccctgcaagccgctctgaatgattttagcgtgttgagaaggcgtgacaggccagcccagaaggaggaaggggtgggggaaggagggtactccgtttaacaaataaa

SEQ ID NO: 97181 - DNA, 779 bp, Homo sapiens
  misc_feature 1..779: note = chr7:20830608-20831387
  misc_feature 1..779: note = hyper
  source 1..779: mol_type = genomic DNA
tctcggtttctagagcgttggcagggacatgcagctctggaagctgaccggcgggtgcccgcgggagacagagcgaacgcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaaacaaaaacaaaaaacaaaccaaaaccaaaacaaacaaaaaaaaaaaacctggctaggcgtggacctgtgaattcctgaggggtgccccttagcagtccatttctctttcgtgtggttttactaagaagttacctaacatttcctgggaagagaggtaatacaagcccctcgctggtggcagattgttgagccgtaggtgggaagagatcagtcggccagagcccagagagggctgtattttcctgattggaaaatgggaacttccacgctgaacaatagcctctattagtgaggttatttggttccaaactgtccggccacatttatagccgagtccttacttttctggtagtgcttaattggatgcatttgttgaccacaacgaagcaatagtgactcttgatctactggcacaggagcttcttggtgatgaaaagcgttgccttgatgac

SEQ ID NO: 97182 - DNA, 454 bp, Homo sapiens
  misc_feature 1..454: note = chr7:20833089-20833543
  misc_feature 1..454: note = hyper
  source 1..454: mol_type = genomic DNA
tgctttagaatcattcgactctgagtccaggaaaagcagggggtgtggtggcagtgggggtggctagggaggggtgtatatgagtgggggagccgatttcatctcggatcgcaggaagagaacttgctcaaaagaatttttccccagcaaaagtggtataatttacagcgcaacttaataatccgaggggcaatgcaaaagccctttgcgttgtaaaccgcttctaattacctgccagagcaattagctgactatcacgaagaaattagatcgctcaatgtagcataaataatgcgaataattttgtaagaagaatggaaagcgagacctggtgtttctttataaggaaataacacctcgtactgtaagagccctccatgaacacatattaatgtctaggcatgcatggcaatgagtccgagcaggagccctctggctgcggttcagcactttt

SEQ ID NO: 97183 - DNA, 84 bp, Homo sapiens
  misc_feature 1..84: note = chr7:20834292-20834376
  misc_feature 1..84: note = hyper
  source 1..84: mol_type = genomic DNA
caactccaccgctttcctgtgccgcccaagggaaatgggtctctcttgagcccgtctttctctagtaaacgaggtgggtcatac

SEQ ID NO: 97184 - DNA, 54 bp, Homo sapiens
  misc_feature 1..54: note = chr7:20834576-20834630
  misc_feature 1..54: note = hyper
  source 1..54: mol_type = genomic DNA
cgaaagctttggccccgctcatttttgaaacatttttcacgactgagttcaggg

SEQ ID NO: 97185 - DNA, 30 bp, Homo sapiens; identical to SEQ ID NO: 8910
  misc_feature 1..30: note = chr7:20836099-20836129
  misc_feature 1..30: note = hyper
  source 1..30: mol_type = genomic DNA

SEQ ID NO: 97186 - DNA, 218 bp, Homo sapiens
  misc_feature 1..218: note = chr7:20836779-20836997
  misc_feature 1..218: note = hyper
  source 1..218: mol_type = genomic DNA
aaggaaattacaagccgatgctgattgacttttgaaaggcctggcacgtcccagtctatataataactcagttggaggaagaacctcgaggaccgagtgtctccagatcacttaatgcatcggcatccaccacgctcggctcatgggcagggcccccgaggctgccaccaacccacggagccttgaggagctgcgcttccccgcgatggtccaacgaa

SEQ ID NO: 97187 - DNA, 50 bp, Homo sapiens; identical to SEQ ID NO: 8912
  misc_feature 1..50: note = chr7:20838460-20838510
  misc_feature 1..50: note = hyper
  source 1..50: mol_type = genomic DNA

SEQ ID NO: 97188 - DNA, 30 bp, Homo sapiens
  misc_feature 1..30: note = chr7:208441-208471
  misc_feature 1..30: note = hypo
  source 1..30: mol_type = genomic DNA
gtaagcacacctggccgtcccttctaggag

SEQ ID NO: 97189 - DNA, 30 bp, Homo sapiens
  misc_feature 1..30: note = chr7:20930367-20930397
  misc_feature 1..30: note = hypo
  source 1..30: mol_type = genomic DNA
tccttaatcttgcatcggtgatttattcaa

SEQ ID NO: 97190 - DNA, 30 bp, Homo sapiens
  misc_feature 1..30: note = chr7:21006501-21006531
  misc_feature 1..30: note = hypo
  source 1..30: mol_type = genomic DNA
aaactcttagaaactcggatgttctaatca

SEQ ID NO: 97191 - DNA, 114 bp, Homo sapiens
  misc_feature 1..114: note = chr7:2110154-2110268
  misc_feature 1..114: note = hypo
  source 1..114: mol_type = genomic DNA
gaagagaggccacaccggggagggtgcgagtccgcggagggagggcccatccctactcagacagcccaggcaggcgcagagcggaacggcgctggaacacgggagctgcacacg

SEQ ID NO: 97192 - DNA, 30 bp, Homo sapiens
  misc_feature 1..30: note = chr7:2120265-2120295
  misc_feature 1..30: note = hypo
  source 1..30: mol_type = genomic DNA
agcgctgggctctgacgccaagtccatccc

SEQ ID NO: 97193 - DNA, 280 bp, Homo sapiens
  misc_feature 1..280: note = chr7:21370232-21370512
  misc_feature 1..280: note = hypo
  source 1..280: mol_type = genomic DNA
gcactgctcccccaccggcggacaactcgcccggcccatggcggaggcccccagggcggcaggcaaggtgcaggtggcccggcagccctagccaaccccgcacaaacgaacccaatgttcccatggccagccctgcgagttctggctacgcctttggccaggtgctcatgggaccccgggacacagccgggagtgaggctgaggctgtggtggaggctccaggcctgagagggggtcctgcctggccgtgcaagtgtggaggtagcgcagtagctccctc

SEQ ID NO: 97194 - DNA, 30 bp, Homo sapiens
  misc_feature 1..30: note = chr7:21400528-21400558
  misc_feature 1..30: note = hypo
  source 1..30: mol_type = genomic DNA
gtgcacagtggctcacgcctgcaatcctag

SEQ ID NO: 97195 - DNA, 121 bp, Homo sapiens
  misc_feature 1..121: note = chr7:21582520-21582641
  misc_feature 1..121: note = hyper
  source 1..121: mol_type = genomic DNA
tcgggacctagagcccgagggcctctcccctcggccttggccttggcgtatactgggcggtggcgcggtgcgctcactccgcccccagcgggctggggcggggacaccgtcccccgggaaa

SEQ ID NO: 97196 - DNA, 487 bp, Homo sapiens
  misc_feature 1..487: note = chr7:21582791-21583278
  misc_feature 1..487: note = hyper
  source 1..487: mol_type = genomic DNA
cgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagt

SEQ ID NO: 97197 - DNA, 149 bp, Homo sapiens
  misc_feature 1..149: note = chr7:21583303-21583452
  misc_feature 1..149: note = hyper
  source 1..149: mol_type = genomic DNA
cgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgtt

SEQ ID NO: 97198 - DNA, 103 bp, Homo sapiens
  misc_feature 1..103: note = chr7:2163294-2163397
  misc_feature 1..103: note = hypo
  source 1..103: mol_type = genomic DNA
tgcgataccaggaagcgagtcggaggcaattaagcctgtttcagagtgcacttcgcaggcggcgctgaatcgatagatcctccggcggcgtggtgctgcaggt

SEQ ID NO: 97199 - DNA, 57 bp, Homo sapiens
  misc_feature 1..57: note = chr7:21690874-21690931
  misc_feature 1..57: note = hypo
  source 1..57: mol_type = genomic DNA
taggtagggcaaatacgaacttagatataggcagaaagcaagcggtatggtttgaga

SEQ ID NO: 97200 - DNA, 30 bp, Homo sapiens
  misc_feature 1..30: note = chr7:2197210-2197240
  misc_feature 1..30: note = hypo
  source 1..30: mol_type = genomic DNA
agggcagacacctcccgagaagccctggga

SEQ ID NO: 97201 - DNA, 317 bp, Homo sapiens
  misc_feature 1..317: note = chr7:2206439-2206756
  misc_feature 1..317: note = hypo
  source 1..317: mol_type = genomic DNA
catcatcatgccaggcgaacccagtgacaagggcctcaaacagaagaggcccagggaagggcagcccatgggcctgagaagcaccactacacacctgggcggcgcactccgctcacaaagcactcttccaggaagggccccgggctgctggagactgaaccggaatctgcctaactggtggaatccccttttacaaagaagtgcctgtagctcacggggctagaacccaggaaggccccaggtgagctcgaaaccctaaagcaaccccgctgtggacagtggcatcgcagataggagagtgccggtgaaacagtaag

SEQ ID NO: 97202 - DNA, 120 bp, Homo sapiens
  misc_feature 1..120: note = chr7:2208724-2208844
  misc_feature 1..120: note = hypo
  source 1..120: mol_type = genomic DNA
ttcacaggaggcaaacgatccgtgacaggacaagcgtgggatggcctcctgtgtggcagaaaggacattcgggacctatgacgcaaacgcaggcggctacacattcgcctgcaggactgc

SEQ ID NO: 97203 - DNA, 165 bp, Homo sapiens
  misc_feature 1..165: note = chr7:2232891-2233056
  misc_feature 1..165: note = hypo
  source 1..165: mol_type = genomic DNA
acttgcccaagcaaccggggtgagacaagggccacccagctccgacagccaccacgtcctggagagaaagcgtccccgcccagaggacggtccttgtcctagaacagcaaggccctccaactcttggtcctcaaagcccttccccgcctccgcacccagcaccac

SEQ ID NO: 97204 - DNA, 178 bp, Homo sapiens
  misc_feature 1..178: note = chr7:2233292-2233470
  misc_feature 1..178: note = hypo
  source 1..178: mol_type = genomic DNA
taccaaggggtaacacggccgcgggtaactccagattcctccggaaaacctcactgtgcactgccaaggctccagccagagcaggtgctgagccgcgatccgggagacgccagtctcaccctaggctctcttccacaaccaccctcaggcaaggccacaccgtcgcccaactgtccca

SEQ ID NO: 97205 - DNA, 154 bp, Homo sapiens; identical to SEQ ID NO: 41122
  misc_feature 1..154: note = chr7:2238153-2238307
  misc_feature 1..154: note = hypo
  source 1..154: mol_type = genomic DNA

SEQ ID NO: 97206 - DNA, 95 bp, Homo sapiens
  misc_feature 1..95: note = chr7:22539833-22539928
  misc_feature 1..95: note = hyper
  source 1..95: mol_type = genomic DNA
gcctgctgcaggccccgcctccttgtcagttgcgcgtccagcgccacctgctggcgccccgcgtccgcagggttcgggaacgtccttggaggcta

SEQ ID NO: 97207 - DNA, 28 bp, Homo sapiens
  misc_feature 1..28: note = chr7:22540572-22540600
  misc_feature 1..28: note = hypo
  source 1..28: mol_type = genomic DNA
gcgtgagccaccgcgcccagccacctta

SEQ ID NO: 97208 - DNA, 657 bp, Homo sapiens
  misc_feature 1..657: note = chr7:22589295-22589952
  misc_feature 1..657: note = hyper
  source 1..657: mol_type = genomic DNA
agcctcaaactatctcgacggtcaggcccctttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaaggcacctgggtgggacataggagaaggaaatctccaccccaaccccccaaaacaccgcccagaagtgggcggtgaggcccagtg

SEQ ID NO: 97209 - DNA, 230 bp, Homo sapiens
  misc_feature 1..230: note = chr7:2265011-2265241
  misc_feature 1..230: note = hypo
  source 1..230: mol_type = genomic DNA
gtctgggccgaccctcgccccgcctgaacccacctcgtagttcctggcactggtgctggctgctctctccagctccactcgagccctcttgtgactcagctccatctgcattttctcccgctccacctggatgaggtgggacttcgaacggatctgctctgctctttcctccagctgagcaggtcgcacccaaagaaaaacagaatcctcagtgacggcatcaaaccagg

SEQ ID NO: 97210 - DNA, 85 bp, Homo sapiens; identical to SEQ ID NO: 41123
  misc_feature 1..85: note = chr7:2265530-2265615
  misc_feature 1..85: note = hypo
  source 1..85: mol_type = genomic DNA

SEQ ID NO: 97211 - DNA, 30 bp, Homo sapiens
  misc_feature 1..30: note = chr7:22893577-22893607
  misc_feature 1..30: note = hyper
  source 1..30: mol_type = genomic DNA
tcctctgaccttcaacgaggtaaagagaca

SEQ ID NO: 97212 - DNA, 173 bp, Homo sapiens; identical to SEQ ID NO: 41212
  misc_feature 1..173: note = chr7:22981026-22981199
  misc_feature 1..173: note = hypo
  source 1..173: mol_type = genomic DNA

SEQ ID NO: 97213 - DNA, 16 bp, Homo sapiens
  misc_feature 1..16: note = chr7:2300787-2300803
  misc_feature 1..16: note = hypo
  source 1..16: mol_type = genomic DNA
ctgggcacagaggctc

SEQ ID NO: 97214 - DNA, 30 bp, Homo sapiens
  misc_feature 1..30: note = chr7:23009058-23009088
  misc_feature 1..30: note = hypo
  source 1..30: mol_type = genomic DNA
acaggcatgagccaacgtctggccatcctg

SEQ ID NO: 97215 - DNA, 53 bp, Homo sapiens
  misc_feature 1..53: note = chr7:23053027-23053080
  misc_feature 1..53: note = hyper
  source 1..53: mol_type = genomic DNA
ttgtggccaccagaccggacggacagtggcggcctcgccgaagtagagggcgc

SEQ ID NO: 97216 - DNA, 16 bp, Homo sapiens
  misc_feature 1..16: note = chr7:23129478-23129494
  misc_feature 1..16: note = hypo
  source 1..16: mol_type = genomic DNA
ccgtctcaaaaaaaaa

SEQ ID NO: 97217 - DNA, 30 bp, Homo sapiens; identical to SEQ ID NO: 41213
  misc_feature 1..30: note = chr7:23220685-23220715
  misc_feature 1..30: note = hypo
  source 1..30: mol_type = genomic DNA

SEQ ID NO: 97218 - DNA, 78 bp, Homo sapiens
  misc_feature 1..78: note = chr7:23223070-23223148
  misc_feature 1..78: note = hypo
  source 1..78: mol_type = genomic DNA
ctaaggtgatactcccgcttccgtctttcaaagtgctgggattacaggcgtgagcgaccgcggcgggcctcatctaac

SEQ ID NO: 97219 - DNA, 145 bp, Homo sapiens
  misc_feature 1..145: note = chr7:23287206-23287351
  misc_feature 1..145: note = hyper
  source 1..145: mol_type = genomic DNA
agcagtgtgcagattcgcgagaggaagagagctgagccgctgtaaccctgggcctgggattgcggggacgggacgggtgggaagcggccaaaggcgcagcggcttctggtcagagccgcagaggcctgagacgtgggccgcgccc

SEQ ID NO: 97220 - DNA, 122 bp, Homo sapiens
  misc_feature 1..122: note = chr7:23287532-23287654
  misc_feature 1..122: note = hyper
  source 1..122: mol_type = genomic DNA
ggcactgtgatggtcccgcttcccacacgaggccacgggccacagagtgggcaaggaactcgccccaagccacacagcgggtaagttgaggaggcagccttccatcccgacctctgtccttc

SEQ ID NO: 97221 - DNA, 30 bp, Homo sapiens
  misc_feature 1..30: note = chr7:23340392-23340422
  misc_feature 1..30: note = hypo
  source 1..30: mol_type = genomic DNA
ctctgggtgcatacacgtctatctgcttgg

SEQ ID NO: 97222 - DNA, 79 bp, Homo sapiens
  misc_feature 1..79: note = chr7:2349353-2349432
  misc_feature 1..79: note = hypo
  source 1..79: mol_type = genomic DNA
gagactccatctcaaaaaaaaaaaagtataaactttaagtgacagcgcaatgaattctgaccaacgtattcacacagag

SEQ ID NO: 97223 - DNA, 1745 bp, Homo sapiens
  misc_feature 1..1745: note = chr7:23508102-23509847
  misc_feature 1..1745: note = hyper
  source 1..1745: mol_type = genomic DNA
ttgcctttttgggaccgagtgctcaacttctatgggtttcccgtgcagttctattttacctgcggacacacaagaagtgagacggtcggccgagttcagcggctctccctgcccgaagacccgcacagcccaagcggcgacacaaatggcctcctgaggccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtctgaattgattaaaagggaagccgaaaggcacggggctcccatggggaccccaacgcagccttccccctgggcgtcctgctccgcccggcaccgtccctcgccctggcggagccatacccggaggccgcagccccgcgccagggcccggagagcggcgggcggccggtgcgtggcggcgactcccttccaggcgaccagccgcccccgcccacctgcccctatcgctcgtcggaccaggggaggtggaacggggaaaccgggcacacactctctcctcccacagggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcacgcgcctgggcccgggcggggcgccgggggagcgcgcctcccccagccccgcgccccccttagccagcgccggggctttcttgacagcgcgttcgccctcacccagcaaaccccggccggggaagcagagccgcgggccggagtgggagccggagctgaggagagccccggcccccacgcgcgtgggtgtgggcgctcaggcctcacccccgctcccccagcgcgccgggcctggggcccgcggagccacccggtgggcctgggcgggcggtgcagggctggggcgagagcccgggtggggccaggcccgggcccacctgaaagcgcctcgatggccttgagggcccagctctcgtccgggcagtccacgaacgcgtagccagtcttcaccaggaagggtcccgacaccgggatcttggcgtccttgaagatactttctaggtccgagggggcggcgttctcgctgaggtttccgatatacagtttgttcattgtgaagagtggttgtttaaaaaaaaataacgagaaaaaacgaaaaattaaaaccacccacggtgatggatggatccagctggttttgttcccctcgtcttctcgcctttaaaataca

SEQ ID NO: 97224 - DNA, 183 bp, Homo sapiens
  misc_feature 1..183: note = chr7:23510841-23511024
  misc_feature 1..183: note = hyper
  source 1..183: mol_type = genomic DNA
ggggcggcccggccccggagtggtgggggatgggatcccgcagcgtcctgggcgggtgtctgggcgacacctcctccgcctccgcctgcgctcgcggtggctctcggcttcgcgtttgccattggttgcgcgattcagaaaaggctccaggataaatgaggccgggggcgggcttggccactg

SEQ ID NO: 97225 - DNA, 951 bp, Homo sapiens
  misc_feature 1..951: note = chr7:23513474-23514425
  misc_feature 1..951: note = hyper
  source 1..951: mol_type = genomic DNA
ataaaaatggtgccccgggagagaagatggggttgtttcctttttcctctggctctgccccgagaaagagggcgggatcctcacggctcacagtggggagggtctttcgtcggccgccggctcgcctcggagggcctggaccactggaccgcccttccccggggccctgccgcgggaccgcgggcttctggctcctcctggggctgcgtccgtatgcgcggagcgtgtggccgggccgtcgccgcgccaccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctggatttccatcttttgtggcgcgaaaataaccctttgctccctcgttggttttgttgaggttgaggggtgggactgtgttcccctctgctcgctctcgtttttcctgccctttaacagctcgcccccagccccaacccccaaggaagaaagagggaggtaacgctgaggaagggtggaaagcagttctgcgtccgtgggtggagcccgccccttggctgaccgcatggtgcccgcacggtcccttcccttcccccagcgtccagcgcccggaggttctggatttgcgccatgctcagcag

SEQ ID NO: 97226 - DNA, 136 bp, Homo sapiens
  misc_feature 1..136: note = chr7:23514666-23514802
  misc_feature 1..136: note = hyper
  source 1..136: mol_type = genomic DNA
actatgctgagaccacgttttcgttgaagctgccctaagaccaatgaagctgagaccgaccttcaaggattaacgatttctgtagctgaaatgttctaatttcactgacgtttggtggagacggtgagaaaaaata

SEQ ID NO: 97227 - DNA, 33 bp, Homo sapiens
  misc_feature 1..33: note = chr7:23525018-23525051
  misc_feature 1..33: note = hypo
  source 1..33: mol_type = genomic DNA
aatcttttatgaaaacgtattgttggccgggca

SEQ ID NO: 97228 - DNA, 30 bp, Homo sapiens
  misc_feature 1..30: note = chr7:23553199-23553229
  misc_feature 1..30: note = hypo
  source 1..30: mol_type = genomic DNA
gcactccagcctaggcgacaagagtgttag

SEQ ID NO: 97229 - DNA, 30 bp, Homo sapiens; identical to SEQ ID NO: 41215
  misc_feature 1..30: note = chr7:23568103-23568133
  misc_feature 1..30: note = hypo
  source 1..30: mol_type = genomic DNA

SEQ ID NO: 97230 - DNA, 138 bp, Homo sapiens
  misc_feature 1..138: note = chr7:23569163-23569301
  misc_feature 1..138: note = hypo
  source 1..138: mol_type = genomic DNA
gccactgcgcccggccagaaacgattttaaaaagggcatctccagacaagcttctcgcattgttctaattctttaaccaattacaaataaagacaattatctcatcctataaaaactaaaagacgaaaaataaaaaga

SEQ ID NO: 97231 - DNA, 34 bp, Homo sapiens
  misc_feature 1..34: note = chr7:23578823-23578857
  misc_feature 1..34: note = hypo
  source 1..34: mol_type = genomic DNA
tagatttttaaagctgaggcggagagtagtaaag

SEQ ID NO: 97232 - DNA, 125 bp, Homo sapiens
  misc_feature 1..125: note = chr7:23719533-23719658
  misc_feature 1..125: note = hyper
  source 1..125: mol_type = genomic DNA
atttacaagaagactcgccggtccagggaagggagaggggaataggtgcaaggtttgtggagggcggcaaactgcactccatgtggcgcgaggctgcgcttgcggagatccgggttctggtgcct

SEQ ID NO: 97233 - DNA, 123 bp, Homo sapiens
  misc_feature 1..123: note = chr7:23749706-23749829
  misc_feature 1..123: note = hypo
  source 1..123: mol_type = genomic DNA
gtcggcagcagccagcgtcaggcggctcccgcacgcttcttcctaggcggcaggccgtggctgccacgtgactcccgctaacaccggatgatggcgcagcgctgtgcacgcaggcgcagtgtg

SEQ ID NO: 97234 - DNA, 120 bp, Homo sapiens; identical to SEQ ID NO: 41219
  misc_feature 1..120: note = chr7:24099277-24099397
  misc_feature 1..120: note = hypo
  source 1..120: mol_type = genomic DNA

SEQ ID NO: 97235 - DNA, 83 bp, Homo sapiens; identical to SEQ ID NO: 41126
  misc_feature 1..83: note = chr7:2420313-2420396
  misc_feature 1..83: note = hypo
  source 1..83: mol_type = genomic DNA

SEQ ID NO: 97236 - DNA, 30 bp, Homo sapiens
  misc_feature 1..30: note = chr7:24323498-24323528
  misc_feature 1..30: note = hyper
  source 1..30: mol_type = genomic DNA
aaggaaagcagggatcgggcactgcccgag

SEQ ID NO: 97237 - DNA, 60 bp, Homo sapiens
  misc_feature 1..60: note = chr7:24324091-24324151
  misc_feature 1..60: note = hyper
  source 1..60: mol_type = genomic DNA
ccctctgattgtccacggcccttctcccgggcccttcccgctgggcggttcttctgagtt

SEQ ID NO: 97238 - DNA, 161 bp, Homo sapiens
  misc_feature 1..161: note = chr7:2436226-2436387
  misc_feature 1..161: note = hypo
  source 1..161: mol_type = genomic DNA
caaactccaactgaccgtaaccctatccgtcctgcgggagaaggtcctttctgctctgggcttctgcagggatgtaacctcatccctaaaataggagtgatggctgggagtgtggctcacacctgtaatcccatgggaggctgaggcgggaggctttcagt

SEQ ID NO: 97239 - DNA, 21 bp, Homo sapiens
  misc_feature 1..21: note = chr7:24580785-24580806
  misc_feature 1..21: note = hypo
  source 1..21: mol_type = genomic DNA
ccttcgcgcccagccacaatc

SEQ ID NO: 97240 - DNA, 61 bp, Homo sapiens
  misc_feature 1..61: note = chr7:24749659-24749720
  misc_feature 1..61: note = hypo
  source 1..61: mol_type = genomic DNA
tccctaagatccaaccgaggtgagtcctgccgagtggactgggcctcggcggcatcacctc

SEQ ID NO: 97241 - DNA, 224 bp, Homo sapiens; identical to SEQ ID NO: 41221
  misc_feature 1..224: note = chr7:24761204-24761428
  misc_feature 1..224: note = hypo
  source 1..224: mol_type = genomic DNA

SEQ ID NO: 97242 - DNA, 180 bp, Homo sapiens
  misc_feature 1..180: note = chr7:24771552-24771732
  misc_feature 1..180: note = hypo
  source 1..180: mol_type = genomic DNA
ttaccaccctgaattcggcctaaaaatacctccacctgccaataccaggagaccagcataaagaggtactgccagcccctcccatcccagaccttgggatgccccggtttattgtgaccagttacacctgccctggaaggagaaacacagcaaaaagagaatcagcgacaggaccagaat

SEQ ID NO: 97243 - DNA, 30 bp, Homo sapiens
  misc_feature 1..30: note = chr7:2477693-2477723
  misc_feature 1..30: note = hypo
  source 1..30: mol_type = genomic DNA
aagcaaagtgggtggcgtgtgcattttgtg

SEQ ID NO: 97244 - DNA, 705 bp, Homo sapiens
  misc_feature 1..705: note = chr7:24796332-24797037
  misc_feature 1..705: note = hyper
  source 1..705: mol_type = genomic DNA
ccctcggggtgcagacggcaagcggctctggaaagggtcagaggtcctcaaatggagaccaaaggaagccacgcgggcagctcttgagagccattccagcgcatgccaggcacaccgagtggggcttggcctcctccccaagctaggagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccc

SEQ ID NO: 97245 - DNA, 543 bp, Homo sapiens; identical to SEQ ID NO: 31118
  misc_feature 1..543: note = chr7:24797067-24797610
  misc_feature 1..543: note = hyper
  source 1..543: mol_type = genomic DNA

SEQ ID NO: 97246 - DNA, 30 bp, Homo sapiens; identical to SEQ ID NO: 41222
  misc_feature 1..30: note = chr7:24799881-24799911
  misc_feature 1..30: note = hypo
  source 1..30: mol_type = genomic DNA

SEQ ID NO: 97247 - DNA, 157 bp, Homo sapiens
  misc_feature 1..157: note = chr7:2480354-2480511
  misc_feature 1..157: note = hypo
  source 1..157: mol_type = genomic DNA
caagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttacca

SEQ ID NO: 97248 - DNA, 30 bp, Homo sapiens
  misc_feature 1..30: note = chr7:2480719-2480749
  misc_feature 1..30: note = hypo
  source 1..30: mol_type = genomic DNA
ctgggtcagcaggggcggctgggcttgact

SEQ ID NO: 97249 - DNA, 30 bp, Homo sapiens; identical to SEQ ID NO: 41223
  misc_feature 1..30: note = chr7:24845483-24845513
  misc_feature 1..30: note = hypo
  source 1..30: mol_type = genomic DNA

SEQ ID NO: 97250 - DNA, 37 bp, Homo sapiens
  misc_feature 1..37: note = chr7:2499681-2499718
  misc_feature 1..37: note = hypo
  source 1..37: mol_type = genomic DNA
gggttggccgtgcctcggacaccggcctctgcagctt

SEQ ID NO: 97251 - DNA, 124 bp, Homo sapiens
  misc_feature 1..124: note = chr7:25100258-25100382
  misc_feature 1..124: note = hypo
  source 1..124: mol_type = genomic DNA
gcccccaggaggctgcgctgtgtggtgtggcagggagccaccgaccatgaaggctcaggccaccaggagaatggtgagactgtcacctcagagagaacgagttgtcagtcgctcattaggtcaa

SEQ ID NO: 97252 - DNA, 42 bp, Homo sapiens
  misc_feature 1..42: note = chr7:25132402-25132444
  misc_feature 1..42: note = hypo
  source 1..42: mol_type = genomic DNA
ttttctatcttctcccgggatttagaaattacttccggccgg

SEQ ID NO: 97253 - DNA, 31 bp, Homo sapiens
  misc_feature 1..31: note = chr7:25133418-25133449
  misc_feature 1..31: note = hypo
  source 1..31: mol_type = genomic DNA
tgcaaatctttaggccgggcgcggtggctca

SEQ ID NO: 97254 - DNA, 47 bp, Homo sapiens
  misc_feature 1..47: note = chr7:2515514-2515561
  misc_feature 1..47: note = hypo
  source 1..47: mol_type = genomic DNA
cagcccaaggcccagcgaggggagggcggtgccgctgacctgtcctc

SEQ ID NO: 97255 - DNA, 120 bp, Homo sapiens
  misc_feature 1..120: note = chr7:25165828-25165948
  misc_feature 1..120: note = hypo
  source 1..120: mol_type = genomic DNA
tacaataaattattgttgagtgtagtcaccctgttgtattactagaccttattcattcttcttcagtggcgccatttaatgtctcagccccccaagtagctgggactacgggagcaaacc

SEQ ID NO: 97256 - DNA, 197 bp, Homo sapiens
  misc_feature 1..197: note = chr7:25335888-25336085
  misc_feature 1..197: note = hypo
  source 1..197: mol_type = genomic DNA
cacttatgtatatggcgggtgctcagctctgtcctgcttgagatgggcaggagttttctagaaagagcctctcaaggggaaaggagaaattgggaaaaggtcatgagttggttctatgagcagttcaataagcagggatacctagttttgggaagggcttgcatttctgctgtgcgtgtgtccgtgcatggccatat

SEQ ID NO: 97257 - DNA, 164 bp, Homo sapiens
  misc_feature 1..164: note = chr7:2544463-2544627
  misc_feature 1..164: note = hypo
  source 1..164: mol_type = genomic DNA
gcctcctgggggctgcgggagaggcagcagagccagcccgctcaacagcagggccacaattgcctgtggcccctggggagtgacaccccccccccccccccccggctccacagaggcgaggatgggaagaggcggaggaaccggctgtgcgggacacctgagcc

SEQ ID NO: 97258 - DNA, 190 bp, Homo sapiens; identical to SEQ ID NO: 41224
  misc_feature 1..190: note = chr7:25495487-25495677
  misc_feature 1..190: note = hypo
  source 1..190: mol_type = genomic DNA

SEQ ID NO: 97259 - DNA, 33 bp, Homo sapiens
  misc_feature 1..33: note = chr7:2551467-2551500
  misc_feature 1..33: note = hyper
  source 1..33: mol_type = genomic DNA
ctcctcccagccccccgccgtgggctcccccgg

SEQ ID NO: 97260 - DNA, 84 bp, Homo sapiens; identical to SEQ ID NO: 41225
  misc_feature 1..84: note = chr7:25530809-25530893
  misc_feature 1..84: note = hypo
  source 1..84: mol_type = genomic DNA

SEQ ID NO: 97261 - DNA, 30 bp, Homo sapiens
  misc_feature 1..30: note = chr7:25569127-25569157
  misc_feature 1..30: note = hypo
  source 1..30: mol_type = genomic DNA
gggaccccaagcatgcgtggcacaggatgg

SEQ ID NO: 97262 - DNA, 10 bp, Homo sapiens
  misc_feature 1..10: note = chr7:2558415-2558425
  misc_feature 1..10: note = hyper
  source 1..10: mol_type = genomic DNA
ttccggagga

SEQ ID NO: 97263 - DNA, 20 bp, Homo sapiens
  misc_feature 1..20: note = chr7:25603450-25603470
  misc_feature 1..20: note = hypo
  source 1..20: mol_type = genomic DNA
gatttgggccaggtgcggtg

SEQ ID NO: 97264 - DNA, 89 bp, Homo sapiens
  misc_feature 1..89: note = chr7:2560970-2561059
  misc_feature 1..89: note = hyper
  source 1..89: mol_type = genomic DNA
gggggcggcgggggccgtgggttttgtttggcggccgggccgttaggattcccagcgccgggcggctctcacgccggccccttgggcaa

SEQ ID NO: 97265 - DNA, 438 bp, Homo sapiens
  misc_feature 1..438: note = chr7:2564642-2565080
  misc_feature 1..438: note = hypo
  source 1..438: mol_type = genomic DNA
gggcgggggcggggccgccctggaaggggctgggctgcgggagggtccacaggcccaagccccgagctagggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaactgctcggccgcccacagccgccaggcgctgtcctgcaagatggccgtggagtatgaccgcttcatcgagtccggcaggaagtgagtgtggccccgggggacccccatctccctgcccgagcctggcagcgcccgccccggcatgccctcccccgatggccctgccttgtcctcaggtggttctgccacgtggacgatgacaactacgt

SEQ ID NO: 97266 - DNA, 617 bp, Homo sapiens
  misc_feature 1..617: note = chr7:2566041-2566658
  misc_feature 1..617: note = hypo
  source 1..617: mol_type = genomic DNA
aggtgcaccatcctccgggccccgccaggactccgagagcacaggaagggacgtgtggctgccgagaggggcgcagtggggtggggcactgttctaaacagggaggccaggcagcactccactgtcagccagggggggtcactcctgccatgagctcaaagctgtttatggcgggttgttttcctgccgtctcttctcttcactgtgatgcgcctactgtgcgtattttgtccacgctggcaatgcagccagccccagctggtccccagtttgggaccttattcctggggtgtgcagggcaggtgtccttccaggtccaagggaggccagggcagggccgttgcctcactcagggctgtgtggccagcctggggcggggcccagggatgtcgggcccctcccggcatcactccgcccgctccccacaggtgacgctgagctacggtatgtttgaaaacaagcggaacgccgtccacgtgaaggggcccttctcggtggaggccgacccatccaggtaaggaaaccccggcccagatgggcttgcgtagggtggcctaggggcgtcagggggcctcgtggagctgcagcagggtctctctaagcggcatgactctaca

SEQ ID NO: 97267 - DNA, 44 bp, Homo sapiens
  misc_feature 1..44: note = chr7:2566895-2566939
  misc_feature 1..44: note = hypo
  source 1..44: mol_type = genomic DNA
ccagggaccctgttgcgctgccctggcctcggcattcgaggctc

SEQ ID NO: 97268 - DNA, 186 bp, Homo sapiens; identical to SEQ ID NO: 41226
  misc_feature 1..186: note = chr7:25802276-25802462
  misc_feature 1..186: note = hypo
  source 1..186: mol_type = genomic DNA

SEQ ID NO: 97269 - DNA, 297 bp, Homo sapiens; identical to SEQ ID NO: 31119
  misc_feature 1..297: note = chr7:25891946-25892243
  misc_feature 1..297: note = hyper
  source 1..297: mol_type = genomic DNA

SEQ ID NO: 97270 - DNA, 384 bp, Homo sapiens
  misc_feature 1..384: note = chr7:25896230-25896614
  misc_feature 1..384: note = hyper
  source 1..384: mol_type = genomic DNA
ctgcagatgaaggtacggctgggatgtgaagctaatttagtgtgtgctttacaaggaatgcacaaatcaacacagcgctcaaattaaatctcttcttgaggggcttaagtatcttcttcaggaagagtaaagcatgtcttctagttctacttccttcccggttagccagctgctggagagccccctcagtaaattccttccagatcgacctcagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgctgcctcaaccctgag

SEQ ID NO: 97271 - DNA, 264 bp, Homo sapiens
  misc_feature 1..264: note = chr7:25896674-25896938
  misc_feature 1..264: note = hyper
  source 1..264: mol_type = genomic DNA
gcgcgcacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 97272 - DNA, 32 bp, Homo sapiens
  misc_feature 1..32: note = chr7:25902106-25902138
  misc_feature 1..32: note = hyper
  source 1..32: mol_type = genomic DNA
atgtaaatgagaaaccgcgagcatctcccccc

SEQ ID NO: 97273 - DNA, 304 bp, Homo sapiens; identical to SEQ ID NO: 31122
  misc_feature 1..304: note = chr7:25902345-25902649
  misc_feature 1..304: note = hyper
  source 1..304: mol_type = genomic DNA

SEQ ID NO: 97274 - DNA, 218 bp, Homo sapiens
  misc_feature 1..218: note = chr7:25990010-25990228
  misc_feature 1..218: note = hyper
  source 1..218: mol_type = genomic DNA
ggcgggggcgctgcacgaggacgaatattcggagctgaaagagttaaacggtggggaacaaatacaggcccgggaaaagcccctaagatgggacgacccaagaaagacccgctttgcggggcctcccctgagacccccttccccagccattcccagtactctattcccggtcttccagccgcccgcgcccagccccgggaactcgggtcgaagtcgtc

SEQ ID NO: 97275 - DNA, 30 bp, Homo sapiens
  misc_feature 1..30: note = chr7:2612457-2612487
  misc_feature 1..30: note = hypo
  source 1..30: mol_type = genomic DNA
atgagccaccgtgcccggcctctctcttta

SEQ ID NO: 97276 - DNA, 63 bp, Homo sapiens
  misc_feature 1..63: note = chr7:26192685-26192748
  misc_feature 1..63: note = hyper
  source 1..63: mol_type = genomic DNA
gaggtaggtgcagagcgggaagcgagcgaagtgcggcgtctacgccgccgggagcccccgagg

SEQ ID NO: 97277 - DNA, 40 bp, Homo sapiens
  misc_feature 1..40: note = chr7:26217186-26217226
  misc_feature 1..40: note = hypo
  source 1..40: mol_type = genomic DNA
aggctcagcaatggagggagaccgtcgaaaggagggaagg

SEQ ID NO: 97278 - DNA, 17 bp, Homo sapiens
  misc_feature 1..17: note = chr7:26222458-26222475
  misc_feature 1..17: note = hypo
  source 1..17: mol_type = genomic DNA
gctggagtgtggcagcg

SEQ ID NO: 97279 - DNA, 120 bp, Homo sapiens
  misc_feature 1..120: note = chr7:26283695-26283815
  misc_feature 1..120: note = hypo
  source 1..120: mol_type = genomic DNA
agctcctcagcctccagtcgcctctctgtgcatgcacctcggtcactggtctcgactaatggtttctccgggagcccagttaacagggaaaaattcgcatggcctctcggtttcttcggt

SEQ ID NO: 97280 - DNA, 781 bp, Homo sapiens
  misc_feature 1..781: note = chr7:26415774-26416555
  misc_feature 1..781: note = hyper
  source 1..781: mol_type = genomic DNA
gccgcctgttggttgcggcgcctccgcggcccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctgcagacggcccgcgaggccccttcccgcgctacggtgacgattctggctgctggggaaaagagcaataagcagaaagccctcgtgcagaggggatccgggcggtgcacttggtgtgggaggctgccttaaacgccgatgaccctcccggcctccgcgtgtcccggcttccagggccccgccaggctggagagcgcgcgtggagagggccttgccgcctgggggttggttgaggggcggccgcgccggggccggggctggactccaggctttgttctgcagacgctcgcgcccggccggaggaggggctacaccgtgctgccccggccccatggggcccggcccccgagggtccccgcgagcggacgcggtggggccgggcaaactctacgtgccctaaattttgtcatctgcacacgcatcgcacacattagttaacccctttcccttctaggcccccgagaacctaacctg

SEQ ID NO: 97281 - DNA, 37 bp, Homo sapiens
  misc_feature 1..37: note = chr7:26437864-26437901
  misc_feature 1..37: note = hyper
  source 1..37: mol_type = genomic DNA
agggcgcagcacacccgccgcccgcttgcaggcgaga

SEQ ID NO: 97282 - DNA, 30 bp, Homo sapiens
  misc_feature 1..30: note = chr7:26439820-26439850
  misc_feature 1..30: note = hypo
  source 1..30: mol_type = genomic DNA
gcgtggggaagtccccgagtgtgcattgat

SEQ ID NO: 97283 - DNA, 23 bp, Homo sapiens
  misc_feature 1..23: note = chr7:26513167-26513190
  misc_feature 1..23: note = hypo
  source 1..23: mol_type = genomic DNA
agttttgatattggtcgggggca

SEQ ID NO: 97284 - DNA, 55 bp, Homo sapiens
  misc_feature 1..55: note = chr7:2652597-2652652
  misc_feature 1..55: note = hypo
  source 1..55: mol_type = genomic DNA
ctaccacttcagggtcgacgttggtggcaggtgttgttcacggtgtactgattgt

SEQ ID NO: 97285 - DNA, 81 bp, Homo sapiens
  misc_feature 1..81: note = chr7:26555405-26555486
  misc_feature 1..81: note = hypo
  source 1..81: mol_type = genomic DNA
gctgtctcaaggcaccgagggtgctggtcaaaggactcaagatttgtggttcccacagcttcagggcgtccccaggaaatc

SEQ ID NO: 97286 - DNA, 35 bp, Homo sapiens
  misc_feature 1..35: note = chr7:2658370-2658405
  misc_feature 1..35: note = hypo
  source 1..35: mol_type = genomic DNA
gctgtttgcaatccacgtgacggctgagaaatctg

SEQ ID NO: 97287 - DNA, 165 bp, Homo sapiens
  misc_feature 1..165: note = chr7:26652551-26652716
  misc_feature 1..165: note = hypo
  source 1..165: mol_type = genomic DNA
ttggcaatgctaccccggccgcatgatgcagaaatgggagccaaagctgggacaaggtagagaggagggaaggagccccagtgcctgcagaaagagcagagggttggaagactactgtcggctagctcaggccacgccaactgacacatacggagtgtccactgc

SEQ ID NO: 97288 - DNA, 35 bp, Homo sapiens; identical to SEQ ID NO: 41231
  misc_feature 1..35: note = chr7:26762298-26762333
  misc_feature 1..35: note = hypo
  source 1..35: mol_type = genomic DNA

SEQ ID NO: 97289 - DNA, 463 bp, Homo sapiens
  misc_feature 1..463: note = chr7:2686448-2686911
  misc_feature 1..463: note = hypo
  source 1..463: mol_type = genomic DNA
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggtgagcgcggtggggcggggacggagggcggggccagagggggcggcccgagggggcggggctggagtggggtgtgtgtgggtgggcggggctacatctcacgggcccgccctctccagcgccggcatcgcagtgggattctacggcaacggggagaccagtgatggcatccatagggccacctactcgctccgccacgccaaccgcacggtggccggggtccaggaccgcgtgagtggccgcggagttggggcc

SEQ ID NO: 97290 - DNA, 30 bp, Homo sapiens
  misc_feature 1..30: note = chr7:26979426-26979456
  misc_feature 1..30: note = hypo
  source 1..30: mol_type = genomic DNA
tagaggccctctttacgtcctctactcatc

SEQ ID NO: 97291 - DNA, 62 bp, Homo sapiens
  misc_feature 1..62: note = chr7:2700087-2700149
  misc_feature 1..62: note = hypo
  source 1..62: mol_type = genomic DNA
acgtgccggcgagcacgtgagcttctcccgctggccccacggtggtgcgggtgcctgcttgg

SEQ ID NO: 97292 - DNA, 44 bp, Homo sapiens
  misc_feature 1..44: note = chr7:27128016-27128060
  misc_feature 1..44: note = hyper
  source 1..44: mol_type = genomic DNA
ttgccgcagcctagccggccgggggcaggcgctggtgccccccg

SEQ ID NO: 97293 - DNA, 505 bp, Homo sapiens; identical to SEQ ID NO: 651
  misc_feature 1..505: note = chr7:27135266-27135771
  misc_feature 1..505: note = hyper
  source 1..505: mol_type = genomic DNA

SEQ ID NO: 97294 - DNA, 445 bp, Homo sapiens; identical to SEQ ID NO: 652
  misc_feature 1..445: note = chr7:27135979-27136424
  misc_feature 1..445: note = hyper
  source 1..445: mol_type = genomic DNA

SEQ ID NO: 97295 - DNA, 365 bp, Homo sapiens; identical to SEQ ID NO: 31130
  misc_feature 1..365: note = chr7:27136425-27136790
  misc_feature 1..365: note = hyper
  source 1..365: mol_type = genomic DNA

SEQ ID NO: 97296 - DNA, 203 bp, Homo sapiens
  misc_feature 1..203: note = chr7:2718466-2718669
  misc_feature 1..203: note = hypo
  source 1..203: mol_type = genomic DNA
agtagggtggcgggacgtcagtttagcctcaggattcgactccgagcctcttgcgagaccacgtcttgggcagcatcgtagacccggctgtgagcacagagtggctcttccagaaagtttgttgaatgactgactaagtcagcccctgtgccaggcagcccagagggaccagcccagagcctccttctcggggtgcaagcctg

SEQ ID NO: 97297 - DNA, 1128 bp, Homo sapiens
  misc_feature 1..1128: note = chr7:27190145-27191273
  misc_feature 1..1128: note = hyper
  source 1..1128: mol_type = genomic DNA
tcctggagccaaagccgtccttctttgccatagccaatcctcctcagagcagccaggcctacaggcctcaggactacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtttgcgtccttccttcaaccttagctgcgggaccctgccacgcgcgctaacagcattatgtcctctgcaccgaaacttcccaccaagtaacacccaattaatcccatcctctcctccaacacagaattccacccacgcacctattccccctcccagcgcttcagacacctctctcatcgaaaaaccgggcgaagggaagccggc

SEQ ID NO: 97298 - DNA, 77 bp, Homo sapiens
  misc_feature 1..77: note = chr7:27191507-27191584
  misc_feature 1..77: note = hyper
  source 1..77: mol_type = genomic DNA
aacccaaagggctggcggggaacacagtgtgccgggccacttccttttgggcttcacggggtcgctagggaagggga

SEQ ID NO: 97299 - DNA, 16 bp, Homo sapiens
  misc_feature 1..16: note = chr7:27195586-27195602
  misc_feature 1..16: note = hyper
  source 1..16: mol_type = genomic DNA
atgctatgggctccac

SEQ ID NO: 97300 - DNA, 27 bp, Homo sapiens
  misc_feature 1..27: note = chr7:27195866-27195893
  misc_feature 1..27: note = hyper
  source 1..27: mol_type = genomic DNA
cgcctttggcgaggtcactgcagagcc

SEQ ID NO: 97301 - skipped

SEQ ID NO: 97302 - DNA, 132 bp, Homo sapiens; identical to SEQ ID NO: 658
  misc_feature 1..132: note = chr7:27196154-27196286
  misc_feature 1..132: note = hyper
  source 1..132: mol_type = genomic DNA

SEQ ID NO: 97303 - DNA, 351 bp, Homo sapiens; identical to SEQ ID NO: 659
  misc_feature 1..351: note = chr7:27196287-27196638
  misc_feature 1..351: note = hyper
  source 1..351: mol_type = genomic DNA

SEQ ID NO: 97304 - DNA, 127 bp, Homo sapiens
  misc_feature 1..127: note = chr7:2720013-2720140
  misc_feature 1..127: note = hypo
  source 1..127: mol_type = genomic DNA
aggcactggagaccccgggagaccccggatcctgcagggcttctccaggtgtttccaggagcccagacatgcagccgccctgggccgcgaagcctcaagagggagccgggcacgtccttggcacccc

SEQ ID NO: 97305 - DNA, 30 bp, Homo sapiens
  misc_feature 1..30: note = chr7:27204111-27204141
  misc_feature 1..30: note = hyper
  source 1..30: mol_type = genomic DNA
ggctgccgccgctcacggacaatctagttg

SEQ ID NO: 97306 - DNA, 386 bp, Homo sapiens
  misc_feature 1..386: note = chr7:27204384-27204770
  misc_feature 1..386: note = hyper
  source 1..386: mol_type = genomic DNA
tcgagaggcttccagcgaggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 97307 - DNA, 116 bp, Homo sapiens; identical to SEQ ID NO: 31139
  misc_feature 1..116: note = chr7:27205265-27205381
  misc_feature 1..116: note = hyper
  source 1..116: mol_type = genomic DNA

SEQ ID NO: 97308 - DNA, 408 bp, Homo sapiens
  misc_feature 1..408: note = chr7:27205382-27205790
  misc_feature 1..408: note = hyper
  source 1..408: mol_type = genomic DNA
attaaaagatcaaatctagccttgtctctgtactctcccgtctccccccccatacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccc

SEQ ID NO: 97309 - DNA, 36 bp, Homo sapiens
  misc_feature 1..36: note = chr7:27208865-27208901
  misc_feature 1..36: note = hyper
  source 1..36: mol_type = genomic DNA
ctaccacgcccccggcgtccgcgaaggagcagccaa

SEQ ID NO: 97310 - DNA, 178 bp, Homo sapiens
  misc_feature 1..178: note = chr7:27209503-27209681
  misc_feature 1..178: note = hyper
  source 1..178: mol_type = genomic DNA
aatcttgcagcccagcgagccggcgccaagaggcggtagccgtggaaggctcgaaagcgccagggacggtacagatcccggctccctgtctggccccggcctcccgcctctcgctctccccctctccctcctagctgcccgcccgccggggcgcgcgctcctgcgccccctcccctta

SEQ ID NO: 97311 - DNA, 637 bp, Homo sapiens
  misc_feature 1..637: note = chr7:27212347-27212984
  misc_feature 1..637: note = hyper
  source 1..637: mol_type = genomic DNA
atagctgggcgattccgaggtccaggggaagggaaatggcccttctctggctctcagctcagggccccccgcttccaggccggatttgccttttcttcttcccgcaacgaagattcccgcccctcagcaactttgaaaaaagcatgggggatcgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 97312 - DNA, 796 bp, Homo sapiens; identical to SEQ ID NO: 661
  misc_feature 1..796: note = chr7:27213188-27213984
  misc_feature 1..796: note = hyper
  source 1..796: mol_type = genomic DNA

SEQ ID NO: 97313 - DNA, 277 bp, Homo sapiens; identical to SEQ ID NO: 662
  misc_feature 1..277: note = chr7:27213985-27214262
  misc_feature 1..277: note = hyper
  source 1..277: mol_type = genomic DNA

SEQ ID NO: 97314 - DNA, 68 bp, Homo sapiens
  misc_feature 1..68: note = chr7:27214329-27214397
  misc_feature 1..68: note = hyper
  source 1..68: mol_type = genomic DNA
cgcagaagctgccactagtccccggtgtactctaaccactgaagcggccgtgtcggggactcacgcgc

SEQ ID NO: 97315 - DNA, 524 bp, Homo sapiens
  misc_feature 1..524: note = chr7:27219320-27219844
  misc_feature 1..524: note = hyper
  source 1..524: mol_type = genomic DNA
gctcgcgaggcctagcgaatgcgcgttgctttaaattaccataccaatcacttcttgagggtgagtcccctttttctgttatgaaggggagcgggacaagtgaaataatgtaccgtgctgctcttagtatcagaagcgaacaaaggccaagaatcatgctggggttcccggctccccggcggctttgacattgatcggaagtgcgccatctcgtggcggctgcgcgcctaggttgggccggagttccagccccgagccgagagacggaaaccagctccgggcagagagagaaggagagaggagaggatgtgcccagcccgctgctattgagatctcatttttacatctaagaaatcgctgcaaaaccccagccgggtttatagcggcgcattccaaatatgcaaattggccggccccggacgggtttacgaccacattgtcacagccatcggaggatgggcttttatagggctcagaaatcaaacccgcgcccgcccgccgcccgcccgcgagcagtcctcctg

SEQ ID NO: 97316 - DNA, 79 bp, Homo sapiens; identical to SEQ ID NO: 31148
  misc_feature 1..79: note = chr7:27223114-27223193
  misc_feature 1..79: note = hyper
  source 1..79: mol_type = genomic DNA

SEQ ID NO: 97317 - DNA, 85 bp, Homo sapiens
  misc_feature 1..85: note = chr7:27223221-27223306
  misc_feature 1..85: note = hyper
  source 1..85: mol_type = genomic DNA
cggaagccccctaccctaggccttcgctgagcaccacggccacacggccatcctgcacacggcagagcagcggctctatcttagg

SEQ ID NO: 97318 - DNA, 1484 bp, Homo sapiens
  misc_feature 1..1484: note = chr7:27223574-27225058
  misc_feature 1..1484: note = hyper
  source 1..1484: mol_type = genomic DNA
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactc

SEQ ID NO: 97319 - DNA, 268 bp, Homo sapiens
  misc_feature 1..268: note = chr7:27227776-27228044
  misc_feature 1..268: note = hyper
  source 1..268: mol_type = genomic DNA
tggggctgagaaaggcgctccgggagcggctggcagggcaattcggcaggctgcaccgaagccgagtgcccggagggacttgccgcccggaagggggtgtgtgggggcgctgccgtgaagatggatgagggaaaaggtttttgatatcagcagaagggaaaacgcctggagtggccgaacacttttagttgcccagcaggaataggagacgggtactcagctccccaaggctgcgcaatatcccagctttgcccgctcctgccctcgt

SEQ ID NO: 97320 - DNA, 52 bp, Homo sapiens
  misc_feature 1..52: note = chr7:27228676-27228728
  misc_feature 1..52: note = hyper
  source 1..52: mol_type = genomic DNA
gaaggccaacgcctgcgccaggcttgtcaggcggaaacggctaacaaggaga

SEQ ID NO: 97321 - DNA, 887 bp, Homo sapiens
  misc_feature 1..887: note = chr7:27232211-27233098
  misc_feature 1..887: note = hyper
  source 1..887: mol_type = genomic DNA
ccaaccgggacctgccggtgccacggtcccgtgcgccgggtcccggcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacaccccagtacctgggggaggacctatgtcgccgcataaccgcccgcagaggtttggaaatctctgagacccgttgtaattatttctgcccagtggatccggctcttcagcgtcacgagagccgg

SEQ ID NO: 97322 - DNA, 30 bp, Homo sapiens; identical to SEQ ID NO: 31155
  misc_feature 1..30: note = chr7:27237273-27237303
  misc_feature 1..30: note = hyper
  source 1..30: mol_type = genomic DNA

SEQ ID NO: 97323 - DNA, 30 bp, Homo sapiens
  misc_feature 1..30: note = chr7:27237530-27237560
  misc_feature 1..30: note = hyper
  source 1..30: mol_type = genomic DNA
acttatctgaaattgcgtattttgggggtt

SEQ ID NO: 97324 - DNA, 179 bp, Homo sapiens
  misc_feature 1..179: note = chr7:27237991-27238170
  misc_feature 1..179: note = hyper
  source 1..179: mol_type = genomic DNA
ttggtataaggcacgcgcttctttctccccctcctataggagctggcatccgagggatgggagaccacgtctagaagacaagggagaaggcaagttacacagggatcggaccccagccagggcataggcgacagctcgatctgagccacccgccttgcagcgcccggctgctctttgcc

SEQ ID NO: 97325 - DNA, 410 bp, Homo sapiens
  misc_feature 1..410: note = chr7:27238507-27238917
  misc_feature 1..410: note = hyper
  source 1..410: mol_type = genomic DNA
aggggctggggagggcggggcgcagagggagagggaagctagccgaggtctccacaagccacccctcacccagggagagccagggaccagctcaactcgaggcagtgcaggcagacccagccagccatgctcgggctcccaggggtgcagagccgctagggcagaccaggaagagaacagaaacgcacccgggatcgcccgggtgcgagcggagaagaagctggagcagagccggaagaccagggctgggaataggtcgtcatttaccgggcagagtggacttccagaggtggggaggctgcgcctgctctttggggcagtacatttggccgttccagccgttgggcagcgcccagggctggtagctttccatgggaagacccaagggttcgtggcgcgactcgccgggg

SEQ ID NO: 97326 - DNA, 32 bp, Homo sapiens; identical to SEQ ID NO: 8952
  misc_feature 1..32: note = chr7:27239141-27239173
  misc_feature 1..32: note = hyper
  source 1..32: mol_type = genomic DNA

SEQ ID NO: 97327 - DNA, 1099 bp, Homo sapiens
  misc_feature 1..1099: note = chr7:27239225-27240324
  misc_feature 1..1099: note = hyper
  source 1..1099: mol_type = genomic DNA
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccggcccccccgctccgcccacggcgtatgcaaagcgggcggctccgactccagctctgcacggtgcacccgtcgtccccgccgcggcccgcgccgtccccagcgccagccgcgcggccgcgcaccattcacccgggggagaggcggaggaacgtgcgggtggggcagggaaggaaggcggccccatctccgccccccttcccttcctttatcccagtggggcccagacccgcgcaaccaggcggggaggggaggtgggcgcgcgattgggttgcgatctggagcagtggggacaggtcaggtaattctgccggcggtcagggatgggagagtggggaggacgggaccagcctagctcagaatgggtgtttcttggagcctctgggactgttttctttccaggaaccggcgcgtatttctgcagtgagaccacaggacggacatcggcgccttcggcttcgatggagttgcgattttgctctttc

SEQ ID NO: 97328 - DNA, 181 bp, Homo sapiens; identical to SEQ ID NO: 31161
  misc_feature 1..181: note = chr7:27240992-27241173
  misc_feature 1..181: note = hyper
  source 1..181: mol_type = genomic DNA

SEQ ID NO: 97329 - DNA, 32 bp, Homo sapiens
  misc_feature 1..32: note = chr7:27242143-27242175
  misc_feature 1..32: note = hyper
  source 1..32: mol_type = genomic DNA
tagccccgaaccctgcgcgcagagaaagggtc

SEQ ID NO: 97330 - DNA, 72 bp, Homo sapiens; identical to SEQ ID NO: 8957
  misc_feature 1..72: note = chr7:27244539-27244611
  misc_feature 1..72: note = hyper
  source 1..72: mol_type = genomic DNA

SEQ ID NO: 97331 - DNA, 513 bp, Homo sapiens; identical to SEQ ID NO: 31163
  misc_feature 1..513: note = chr7:27244797-27245310
  misc_feature 1..513: note = hyper
  source 1..513: mol_type = genomic DNA

SEQ ID NO: 97332 - DNA, 114 bp, Homo sapiens
  misc_feature 1..114: note = chr7:27245526-27245640
  misc_feature 1..114: note = hyper
  source 1..114: mol_type = genomic DNA
gctggtgacatacttcgctggcgcatctccttactcactcttacttttccgacccctcaccattccctctcctgtggcttggtaaatacacctgccctccgtggaaggtgagtc

SEQ ID NO: 97333 - DNA, 165 bp, Homo sapiens; identical to SEQ ID NO: 31165
  misc_feature 1..165: note = chr7:27250066-27250231
  misc_feature 1..165: note = hyper
  source 1..165: mol_type = genomic DNA

SEQ ID NO: 97334 - DNA, 449 bp, Homo sapiens
  misc_feature 1..449: note = chr7:27252370-27252819
  misc_feature 1..449: note = hyper
  source 1..449: mol_type = genomic DNA
acctcttcaggcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattgtccagcctgtctgcagcctgtaattatgcgttcaagatgtttaatgtgtgcaaatgcattagccgctttcgctggtgaaaaccctagctgggggcggggtagaggcaagtctggagataattatgtcgtacagtcgcaaacattattccgttcttactgtaaacggccccggccacctttacgagaaaccaggaaacttctgagagttactagcagcgtttacgcgggcaaactgagttctttttctttctctcccggattgtt

SEQ ID NO: 97335 - DNA, 297 bp, Homo sapiens
  misc_feature 1..297: note = chr7:27252895-27253192
  misc_feature 1..297: note = hyper
  source 1..297: mol_type = genomic DNA
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcgaaaggtgcggact

SEQ ID NO: 97336 - DNA, 1013 bp, Homo sapiens
  misc_feature 1..1013: note = chr7:27264571-27265584
  misc_feature 1..1013: note = hyper
  source 1..1013: mol_type = genomic DNA
ttgaatgcattcattcgggaatatttactagattattttagtgataatgaaaactatgcaaattttcagaagtgacatttcagggacaaaccgaataataactgtaaattcataaatgtcaaaattgccttcaaaaaggttttgccgttttgttttttgtttgttttaacgttccaccaatggttttcgggtgacggtgtccttgcacgatgtagtccgtcttcaaagttcttttacacaacgtgaattatattgaaattgggctacttcatagagcttcgcctcagtggaggacagcctggaataggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcgccttggcgccccgtcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcagaaatgcagaggaagccggggacactgaagcccgggtggttgcagtg

SEQ ID NO: 97337 - DNA, 452 bp, Homo sapiens
  misc_feature 1..452: note = chr7:27274962-27275414
  misc_feature 1..452: note = hyper
  source 1..452: mol_type = genomic DNA
acctatcacccatcccgcttagggtccagctcagagagcgggcgcatagggcctggtggaacaggctgccctctggggatgggggattggggccgctgctccgggcagagccgcgggatccgagccagcaaggatgctgggactcgccgcgacttccgcctctggcgatcggcagtggggggcgcaccaagacagcagttcgggagctgcgctttgtcaccgaggcggcgaggggcggagggcgcagaaaggggccgcggagaaaggacaaggcggccgaccagctcccaggatggaaagggaccctcaaggggctccaggcagcacctggggcaaggggagggactgatactcccggccggagcccaacctgtggcgcgtgcttcagtcctgagccagcggctccctggcttctgggctggcatccgtcctaccctcctcccgctgcaaca

SEQ ID NO: 97338 - DNA, 406 bp, Homo sapiens
  misc_feature 1..406: note = chr7:2727853-2728259
  misc_feature 1..406: note = hyper
  source 1..406: mol_type = genomic DNA
cgagctgcccacgctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatgggagcaaact

SEQ ID NO: 97339 - DNA, 132 bp, Homo sapiens; identical to SEQ ID NO: 665
  misc_feature 1..132: note = chr7:27279237-27279369
  misc_feature 1..132: note = hyper
  source 1..132: mol_type = genomic DNA

SEQ ID NO: 97340 - DNA, 206 bp, Homo sapiens
  misc_feature 1..206: note = chr7:27279453-27279659
  misc_feature 1..206: note = hyper
  source 1..206: mol_type = genomic DNA
cgccgggcctggagcggcctccacctcagctgctatcaccccctctccgctgtcatgggattgcccaggcttaatggggttgtgcagggcttcacttgctctcggaatttaccttccttctcgagccgtgccgcgaataaccttcacgacacagtgataacgatgttattaaatactccccccacattcaccgcccaaaaaaccaa

SEQ ID NO: 97341 - DNA, 1347 bp, Homo sapiens
  misc_feature 1..1347: note = chr7:27281948-27283295
  misc_feature 1..1347: note = hyper
  source 1..1347: mol_type = genomic DNA
ttgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 97342 - DNA, 15 bp, Homo sapiens
  misc_feature 1..15: note = chr7:27284655-27284670
  misc_feature 1..15: note = hyper
  source 1..15: mol_type = genomic DNA
tcgctgtgcagggtc

SEQ ID NO: 97343 - DNA, 74 bp, Homo sapiens
  misc_feature 1..74: note = chr7:27285445-27285519
  misc_feature 1..74: note = hyper
  source 1..74: mol_type = genomic DNA
ctggcctctgagcatcgggccaagtccagctactgaacctgctccgctcctctccccaggtgtggttccagaac

SEQ ID NO: 97344 - DNA, 205 bp, Homo sapiens; identical to SEQ ID NO: 31175
  misc_feature 1..205: note = chr7:27285620-27285825
  misc_feature 1..205: note = hyper
  source 1..205: mol_type = genomic DNA

SEQ ID NO: 97345 - DNA, 121 bp, Homo sapiens
  misc_feature 1..121: note = chr7:27289445-27289566
  misc_feature 1..121: note = hyper
  source 1..121: mol_type = genomic DNA
tttttctgtcctacagtttgatcctgtctcccaatgtggcatgccccacgaacggtttctttagtgattatgttgactccaccttcctagtttcaaaccctgcacccgcactctccagaca

SEQ ID NO: 97346 - DNA, 93 bp, Homo sapiens
  misc_feature 1..93: note = chr7:27289789-27289882
  misc_feature 1..93: note = hyper
  source 1..93: mol_type = genomic DNA
attattccccaactgcggaaacaccagccaccatatgtccgccggagaataagcgtgagtgtcgcggtggacagttgccgccaaaggtgtcca

SEQ ID NO: 97347 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 97348 - DNA, 864 bp, Homo sapiens
  misc_feature 1..864: note = chr7:27291314-27292178
  misc_feature 1..864: note = hyper
  source 1..864: mol_type = genomic DNA
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacg

SEQ ID NO: 97349 - DNA, 17 bp, Homo sapiens
  misc_feature 1..17: note = chr7:2731870-2731887
  misc_feature 1..17: note = hypo
  source 1..17: mol_type = genomic DNA
gggttgaaagaggaccg

SEQ ID NO: 97350 - DNA, 98 bp, Homo sapiens
  misc_feature 1..98: note = chr7:2747103-2747201
  misc_feature 1..98: note = hypo
  source 1..98: mol_type = genomic DNA
gggcttctggtttcccggctttgatgccatcgtgcccaggttcagcccctgggcctctcctgtatctgtccacactcatgctccggggaaccatgcta

SEQ ID NO: 97351 - DNA, 56 bp, Homo sapiens
  misc_feature 1..56: note = chr7:27531197-27531253
  misc_feature 1..56: note = hypo
  source 1..56: mol_type = genomic DNA
atggggttggagtgccggctccagcagagttgtctgagcagcggcctgaggtgctg

SEQ ID NO: 97352 - DNA, 203 bp, Homo sapiens
  misc_feature 1..203: note = chr7:27555618-27555821
  misc_feature 1..203: note = hypo
  source 1..203: mol_type = genomic DNA
tctctctggaaataccggtcttgccatctttcaagcaaatagcggctcactggtaggaatttcaaaacctgtgcttaaactgccaaattcctttcctctgctgttcccatttctctgtaatgatggccccagaagggaggcttggtgcaggctgacgctttctctgccttgggcagcatggaatgtctcgcctttgacacaca

SEQ ID NO: 97353 - DNA, 30 bp, Homo sapiens
  misc_feature 1..30: note = chr7:27591774-27591804
  misc_feature 1..30: note = hypo
  source 1..30: mol_type = genomic DNA
acaatcagtttagagcgtgccatgtttgat

SEQ ID NO: 97354 - DNA, 47 bp, Homo sapiens
  misc_feature 1..47: note = chr7:27686768-27686815
  misc_feature 1..47: note = hypo
  source 1..47: mol_type = genomic DNA
acctgaaaataagcacgcgatatcacaacacccgatcactgaggcgg

SEQ ID NO: 97355 - DNA, 30 bp, Homo sapiens
  misc_feature 1..30: note = chr7:2770610-2770640
  misc_feature 1..30: note = hypo
  source 1..30: mol_type = genomic DNA
ggattcagtagctaacgtgacagtttccat

SEQ ID NO: 97356 - DNA, 32 bp, Homo sapiens; identical to SEQ ID NO: 41235
  misc_feature 1..32: note = chr7:27903816-27903848
  misc_feature 1..32: note = hypo
  source 1..32: mol_type = genomic DNA

SEQ ID NO: 97357 - DNA, 67 bp, Homo sapiens
  misc_feature 1..67: note = chr7:27905659-27905726
  misc_feature 1..67: note = hypo
  source 1..67: mol_type = genomic DNA
tacctagaatgggttcgcagacaggttcaagtcttgcagcacaacctcagctcgtcttcatcgagtg

SEQ ID NO: 97358 - DNA, 242 bp, Homo sapiens
  misc_feature 1..242: note = chr7:27907826-27908068
  misc_feature 1..242: note = hypo
  source 1..242: mol_type = genomic DNA
tattgggatgagtcacgttgcttgctcaacaactttaaggcctaggatcagtgacagaactccaggagcagcggggttaacacgggtgaccaatttctcctgcccactgtcactcacatggcccatgcctgctcctgcagatgccgttccccggtcctcaccgcaactccctgtggggttgactgccgcttgcttctcccgctcccatccccctctccagattcctccgcccctgcatgggc

SEQ ID NO: 97359 - DNA, 99 bp, Homo sapiens
  misc_feature 1..99: note = chr7:27916674-27916773
  misc_feature 1..99: note = hypo
  source 1..99: mol_type = genomic DNA
agaagggcaggctaccgagagggcgctagactttggcagaggccgctgctggaaagccagcatccccagctttatcaccgaccacgtttattttcttcc

SEQ ID NO: 97360 - DNA, 30 bp, Homo sapiens
  misc_feature 1..30: note = chr7:27980078-27980108
  misc_feature 1..30: note = hypo
  source 1..30: mol_type = genomic DNA
cacatgcccagatgccgtctcagcagtcag

SEQ ID NO: 97361 - DNA, 80 bp, Homo sapiens
  misc_feature 1..80: note = chr7:2798456-2798536
  misc_feature 1..80: note = hypo
  source 1..80: mol_type = genomic DNA
tgagagggttatcaccgcatgtatcaacatgatgggtctctgctgggcgcggtggctcatgcctataatcccagcgctct

SEQ ID NO: 97362 - DNA, 24 bp, Homo sapiens
  misc_feature 1..24: note = chr7:28049405-28049429
  misc_feature 1..24: note = hypo
  source 1..24: mol_type = genomic DNA
tcaccattgcgttttttaaaaatg

SEQ ID NO: 97363 - DNA, 116 bp, Homo sapiens
  misc_feature 1..116: note = chr7:28050616-28050732
  misc_feature 1..116: note = hypo
  source 1..116: mol_type = genomic DNA
tctggtggtaactagcgggctcctcacaatcccacatcacctggcagggtgtttctgcttacgatgctaatgagattttacttgaaagatgtaattattgccgcaacccaagaaaa

SEQ ID NO: 97364 - DNA, 30 bp, Homo sapiens; identical to SEQ ID NO: 41239
  misc_feature 1..30: note = chr7:28055637-28055667
  misc_feature 1..30: note = hypo
  source 1..30: mol_type = genomic DNA

SEQ ID NO: 97365 - DNA, 30 bp, Homo sapiens
  misc_feature 1..30: note = chr7:28241732-28241762
  misc_feature 1..30: note = hypo
  source 1..30: mol_type = genomic DNA
agaattgagagtcctcggccgggtgcggtg

SEQ ID NO: 97366 - DNA, 128 bp, Homo sapiens
  misc_feature 1..128: note = chr7:28258505-28258633
  misc_feature 1..128: note = hypo
  source 1..128: mol_type = genomic DNA
gtgaatgttcccaagcgctcgggattaaggttgatttaatctggttgcttctattttgccatgttgtgactttcacgtgcatcccattgcctgatgcttataaatgatggttgcgcataatgtcccat

SEQ ID NO: 97367 - DNA, 24 bp, Homo sapiens
  misc_feature 1..24: note = chr7:28310468-28310492
  misc_feature 1..24: note = hypo
  source 1..24: mol_type = genomic DNA
acagaatgagtccagcgggcctga

SEQ ID NO: 97368 - DNA, 183 bp, Homo sapiens
  misc_feature 1..183: note = chr7:28351972-28352155
  misc_feature 1..183: note = hypo
  source 1..183: mol_type = genomic DNA
cccatgatacctactcggatttcacagagggggaggcacagagtggtggagctgcaaggaatgctggcaggagctgagggggctcagtgacaagaccggtgcagccagaggtggcttgggagaccatggacatgcagaaagtctctggtgtacaaagggggagggaagcgggtggaggcgaag

SEQ ID NO: 97369 - DNA, 25 bp, Homo sapiens
  misc_feature 1..25: note = chr7:28366473-28366498
  misc_feature 1..25: note = hypo
  source 1..25: mol_type = genomic DNA
tatttaggctgggtgcggtggctca

SEQ ID NO: 97370 - DNA, 590 bp, Homo sapiens
  misc_feature 1..590: note = chr7:28448701-28449291
  misc_feature 1..590: note = hyper
  source 1..590: mol_type = genomic DNA
ctaatgtcagggagccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccc

SEQ ID NO: 97371 - DNA, 124 bp, Homo sapiens; identical to SEQ ID NO: 3013
  misc_feature 1..124: note = chr7:28449658-28449782
  misc_feature 1..124: note = hyper
  source 1..124: mol_type = genomic DNA

SEQ ID NO: 97372 - DNA, 383 bp, Homo sapiens
  misc_feature 1..383: note = chr7:28449857-28450240
  misc_feature 1..383: note = hyper
  source 1..383: mol_type = genomic DNA
cgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttgaacttttcacgaagttcttagaggggcaagatgcgaaggaaggaaccaaggagatgttttctctcagcagctgcatcccgcttcttctttgccatagatttatttttaaggggcgtctggtagataaagccctagaccttgtccacactctcacccccatccccaactttccctggaccggtgccgcccccacttgatg

SEQ ID NO: 97373 - DNA, 99 bp, Homo sapiens
  misc_feature 1..99: note = chr7:28450611-28450710
  misc_feature 1..99: note = hyper
  source 1..99: mol_type = genomic DNA
tccctggggcgagcacggtccctggagtgtgggtaaaagcttctggggtctgaggggaccactgtacctgatcagcgcgcaatccgcccttttgtatta

SEQ ID NO: 97374 - DNA, 30 bp, Homo sapiens
  misc_feature 1..30: note = chr7:28535177-28535207
  misc_feature 1..30: note = hypo
  source 1..30: mol_type = genomic DNA
acctgtaatcacactcgagcaacaaatgtg

SEQ ID NO: 97375 - DNA, 21 bp, Homo sapiens
  misc_feature 1..21: note = chr7:28571358-28571379
  misc_feature 1..21: note = hypo
  source 1..21: mol_type = genomic DNA
ctgaggctagccgggcgtggg

SEQ ID NO: 97376 - DNA, 30 bp, Homo sapiens
  misc_feature 1..30: note = chr7:28572177-28572207
  misc_feature 1..30: note = hypo
  source 1..30: mol_type = genomic DNA
cagtgcctcgggtctcgtggatcggaaggt

SEQ ID NO: 97377 - DNA, 75 bp, Homo sapiens
  misc_feature 1..75: note = chr7:2864022-2864097
  misc_feature 1..75: note = hypo
  source 1..75: mol_type = genomic DNA
gctcctctgggtctgcggaggcctctgcacttggggtgctctccccatcacctctgcaggcggctccctgccacc

SEQ ID NO: 97378 - DNA, 50 bp, Homo sapiens
  misc_feature 1..50: note = chr7:288278-288328
  misc_feature 1..50: note = hypo
  source 1..50: mol_type = genomic DNA
aggatcctggacttccgccgggtccctcccgtggccggcaggatggtcaa

SEQ ID NO: 97379 - DNA, 30 bp, Homo sapiens
  misc_feature 1..30: note = chr7:28887552-28887582
  misc_feature 1..30: note = hypo
  source 1..30: mol_type = genomic DNA
ctgcagaggctcacccggcctcatctgtgt

SEQ ID NO: 97380 - DNA, 221 bp, Homo sapiens; identical to SEQ ID NO: 31183
  misc_feature 1..221: note = chr7:28893380-28893601
  misc_feature 1..221: note = hyper
  source 1..221: mol_type = genomic DNA

SEQ ID NO: 97381 - DNA, 197 bp, Homo sapiens
  misc_feature 1..197: note = chr7:28907350-28907547
  misc_feature 1..197: note = hypo
  source 1..197: mol_type = genomic DNA
agacttccacgaggacgtgatttgccctttccatggggttggggagttgatgggggtcaggatggctgcaaaaggaggtaagggagatcacacagggcctcaacagctgtgctgatgactttagccattatcccgagagccgaagagcaaggggaatccactggagggtcgcaatgggtgtgcggagcaggaagaga

SEQ ID NO: 97382 - DNA, 32 bp, Homo sapiens
  misc_feature 1..32: note = chr7:28988955-28988987
  misc_feature 1..32: note = hypo
  source 1..32: mol_type = genomic DNA
gggcgcagtggctcacgcctgtaatcccagca

SEQ ID NO: 97383 - DNA, 151 bp, Homo sapiens
  misc_feature 1..151: note = chr7:28989227-28989378
  misc_feature 1..151: note = hypo
  source 1..151: mol_type = genomic DNA
aaaaaaagtacagctgaccttcctgagtctcggattatgtatctgtgaattcattttctcaccaaaatttgtttgtgaccctagaatcaacactccatagcactgtcatggtcattcgctgacatgcttagggcagcgaaaaatctgagct

SEQ ID NO: 97384 - DNA, 425 bp, Homo sapiens
  misc_feature 1..425: note = chr7:28995567-28995992
  misc_feature 1..425: note = hyper
  source 1..425: mol_type = genomic DNA
tcagcagctggtagtcgacgccgccccggctcccggcctccggtagggtgaccagccccgcgcagtggtcccggggagccacagggcagacacggcccccaagcacgccctccacgcacaccaggtagggggtgtccccgcgcagctcgcgcagcgtggccgagtcgctgctctcaggcaggtagacgaagcggtggaacttgggctgctggccaaagcggtcaaagagcaggcggaagcgcgcgccgcccagcggccggggactgcggtgctcgcgcacggcccagcgcaccgaggcgctgtctgcgcccaccgcctccaccgtcaggttgcacagaatgaacttgttgaagtcgcatgggtcggacaccagcggcggcagcccggccccaccgtcggactgggcggcacgctcctggtgctcc

SEQ ID NO: 97385 - DNA, 1161 bp, Homo sapiens
  misc_feature 1..1161: note = chr7:28996324-28997485
  misc_feature 1..1161: note = hyper
  source 1..1161: mol_type = genomic DNA
gagacctgcaggtggcgtcatctcctcccctgcggccgtgggtaggggctgccgcctgcggtcagcggtcagggaagctgagggcgagggatccgcgcaggatccattttgcagctgctggtcatccaggtaatccaggtatttgcctcgcagggccggggggtggcgacactgcacgaagacagtgaggagccggccctgcgagtgccagtcgcccatccagcgcttcaggcctcgcagccggcagtcgcaggtccagccgttgccgtctagatccagccgataaagggctgggctggcggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtc

SEQ ID NO: 97386 - DNA, 160 bp, Homo sapiens; identical to SEQ ID NO: 31187
  misc_feature 1..160: note = chr7:28997486-28997646
  misc_feature 1..160: note = hyper
  source 1..160: mol_type = genomic DNA

SEQ ID NO: 97387 - DNA, 533 bp, Homo sapiens
  misc_feature 1..533: note = chr7:28997676-28998209
  misc_feature 1..533: note = hyper
  source 1..533: mol_type = genomic DNA
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcgggctgcgtccggaagggacccaag

SEQ ID NO: 97388 - DNA, 164 bp, Homo sapiens
  misc_feature 1..164: note = chr7:2900214-2900378
  misc_feature 1..164: note = hypo
  source 1..164: mol_type = genomic DNA
acccaagacttatttctggtttggggactctcttccatatcatctcaccccaggatccaggctgacgcagcagccactgtcttgaacgttgttggccactgagccaagagaaagaaagagcttgggaaagttttgtgctgacaggtgcacggcctgcaagtgac

SEQ ID NO: 97389 - DNA, 44 bp, Homo sapiens
  misc_feature 1..44: note = chr7:2916072-2916116
  misc_feature 1..44: note = hypo
  source 1..44: mol_type = genomic DNA
ggcttcccagcggggcgctgcctgaggcccggtttgcccagaga

SEQ ID NO: 97390 - DNA, 382 bp, Homo sapiens; identical to SEQ ID NO: 31189
  misc_feature 1..382: note = chr7:29185815-29186197
  misc_feature 1..382: note = hyper
  source 1..382: mol_type = genomic DNA

SEQ ID NO: 97391 - DNA, 30 bp, Homo sapiens
  misc_feature 1..30: note = chr7:2920175-2920205
  misc_feature 1..30: note = hypo
  source 1..30: mol_type = genomic DNA
gaattgggggcagggcgatgatggagagaa

SEQ ID NO: 97392 - DNA, 382 bp, Homo sapiens
  misc_feature 1..382: note = chr7:29234504-29234886
  misc_feature 1..382: note = hyper
  source 1..382: mol_type = genomic DNA
cggcggcgtccgcaccggggctgagcgagcagcgacgcgaggggcgcgcggagatggcagcgtccagcaactccagcctgtccggctcgtcggtgtcctccggtgagtttcagcccgtcgggcgctgctgccgcgccgggtctcgccccactgccctcgccccgcagcctgggatggacagagcctacctgtggccatcccgcccgctctctcggaatgggggcaggcgtccggggtgatacttgtttggttcgccagcacctcggtgcccagagcacctccgcgcctgacatctgacagcgcagaggtgggagagcggtggtgcccttagtgtgcggacgcgggtgttccggggcttggagtgcagcgagcgaaaagcgaa

SEQ ID NO: 97393 - DNA, 206 bp, Homo sapiens
  misc_feature 1..206: note = chr7:2923723-2923929
  misc_feature 1..206: note = hypo
  source 1..206: mol_type = genomic DNA
aaaaggacaggcactcggttgaggtcacacagcaagggagtcgggaagttggaaggaggaggatgtggaagacgcagtttgctcctgggtcctcagaaaggaggctgggtgtcaaattctacccttaggaattttagtgagcaggcggtgcctttgtgcatagaaaaagatgccccatcctctgggtggcccggcccagcaccagg

SEQ ID NO: 97394 - DNA, 69 bp, Homo sapiens
  misc_feature 1..69: note = chr7:294045-294114
  misc_feature 1..69: note = hypo
  source 1..69: mol_type = genomic DNA
gggcaggcaggtgatcggggcgttggaaccagaccagccgggacctgccgggtgcgtggggtgtggtgg

SEQ ID NO: 97395 - DNA, 30 bp, Homo sapiens
  misc_feature 1..30: note = chr7:2946546-2946576
  misc_feature 1..30: note = hypo
  source 1..30: mol_type = genomic DNA
gccacccctgactgccgtggtccccacccc

SEQ ID NO: 97396 - DNA, 105 bp, Homo sapiens
  misc_feature 1..105: note = chr7:29482437-29482542
  misc_feature 1..105: note = hypo
  source 1..105: mol_type = genomic DNA
catttattttttcagcgattaatacctgaatgctgcctaggtttttccttatttattccatttctatgattttctccacttaatccccatcgctttcaatttcat

SEQ ID NO: 97397 - DNA, 34 bp, Homo sapiens
  misc_feature 1..34: note = chr7:2950000-2950034
  misc_feature 1..34: note = hypo
  source 1..34: mol_type = genomic DNA
gcagagatgaggccccggacggggtgaaccaggt

SEQ ID NO: 97398 - DNA, 30 bp, Homo sapiens
  misc_feature 1..30: note = chr7:2954959-2954989
  misc_feature 1..30: note = hypo
  source 1..30: mol_type = genomic DNA
tcgttgctgttcatccgcttatacttgttc

SEQ ID NO: 97399 - DNA, 30 bp, Homo sapiens
  misc_feature 1..30: note = chr7:2958214-2958244
  misc_feature 1..30: note = hypo
  source 1..30: mol_type = genomic DNA
ctgggctctggggagcgaagagaggagcct

SEQ ID NO: 97400 - DNA, 30 bp, Homo sapiens; identical to SEQ ID NO: 41142
  misc_feature 1..30: note = chr7:2958507-2958537
  misc_feature 1..30: note = hypo
  source 1..30: mol_type = genomic DNA

SEQ ID NO: 97401 - DNA, 1463 bp, Homo sapiens
  misc_feature 1..1463: note = chr7:29603263-29604726
  misc_feature 1..1463: note = hyper
  source 1..1463: mol_type = genomic DNA
tacagcctcagcctccgggtctcaggtctccgccgtttcttctcaaggagtcggtcgggggagcggcactgcacagcttttctccaatcagacacctcaaggctggcgcctgatccaatctcctcccctggagggtgggaacgcgaagttcctacctgcacctgtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcaggtgagcgactgggggtggttcggcgtccgccgagacagagcctggccccgggggtcaccctggggtgctgcctggtacctcccaggtacccgcctcccggagccctaagagaggctgaaaaccacggacgctccaggactccgttttctgtacttttgagtaatttgccatcttttccttgcgcaattcgtacaaagcccttccgtgctcacaaagttgatgattgtgaagaagaaaatgtaggttagaggagaggaagcagcatcaggacaccttaccaccactgttagtaaatgacttgggggtacgggttgcttttccgatctgcaaagtaggagggaatgggatgtttgcagacgcagttgctaattgtgcctgagggcgtgggtgccttttgtaccgaaagaacttttggccgttttttcttgtattgttttcaagtcgctgcccgagtgtgtcctcagggcatcctggggaggagccggtgttgcggtttcggggcgcagccgaggccgccccgccgcctcccgtaggcgatcagacttcctctccctggcggttccgggaggagaacctcctacaacaaacaccgccgaagtttccctctccagcgcgatcgccaatcccaggagcgcccggcgcgtgggctgggaaggagccgagcggaaacctggaagtgagccgcggcgcaggcgaatcctgccgttgctggtggcagcgcccaagagacccc

SEQ ID NO: 97402 - DNA, 203 bp, Homo sapiens
  misc_feature 1..203: note = chr7:2960538-2960741
  misc_feature 1..203: note = hypo
  source 1..203: mol_type = genomic DNA
gaccatggcacatgtcgttttaaccttatttaaatgtcatcaacctcccaagtaaagttttgcaaatactttgtgagggagcggggcataaaccatgaatgcaacaaatgcagcaagctctgctatgatatcaaaccataatataaacccccacatcagccccacctgctgagggctgtataatactgcggaagctaaaatgg

SEQ ID NO: 97403 - DNA, 30 bp, Homo sapiens
  misc_feature 1..30: note = chr7:2961827-2961857
  misc_feature 1..30: note = hypo
  source 1..30: mol_type = genomic DNA
tctccatgcccagtccgtgggcagactgac

SEQ ID NO: 97404 - DNA, 34 bp, Homo sapiens
  misc_feature 1..34: note = chr7:2963968-2964002
  misc_feature 1..34: note = hypo
  source 1..34: mol_type = genomic DNA
ggtccgaaggagtagcgttcgtgactgtcatctg

SEQ ID NO: 97405 - DNA, 73 bp, Homo sapiens; identical to SEQ ID NO: 41143
  misc_feature 1..73: note = chr7:2966469-2966542
  misc_feature 1..73: note = hypo
  source 1..73: mol_type = genomic DNA

SEQ ID NO: 97406 - DNA, 97 bp, Homo sapiens
  misc_feature 1..97: note = chr7:29679947-29680044
  misc_feature 1..97: note = hypo
  source 1..97: mol_type = genomic DNA
gtgagggtgaccaattcagccttctgtgccaagttacctgccggcagtgcctgggcctgcggtatatctgtctccatagtaacggctgcaccagcct

SEQ ID NO: 97407 - DNA, 160 bp, Homo sapiens
  misc_feature 1..160: note = chr7:2972398-2972558
  misc_feature 1..160: note = hypo
  source 1..160: mol_type = genomic DNA
gacgacaagacacagcggctcccctgggcttgaatcaggcagctgctggtatagacaagctctcctcccagggcggccgtgtaatatggctcatggcagaagacaggacaggagccaagagcggcagaggggaccaagtgatgtgcggggagtgtgaagc

SEQ ID NO: 97408 - DNA, 67 bp, Homo sapiens
  misc_feature 1..67: note = chr7:297499-297566
  misc_feature 1..67: note = hypo
  source 1..67: mol_type = genomic DNA
agcaaagcatggaggcgagtaactcgggcaggaggacgtccattcccaggctcggaggcctcagaga

SEQ ID NO: 97409 - DNA, 63 bp, Homo sapiens
  misc_feature 1..63: note = chr7:2976839-2976902
  misc_feature 1..63: note = hypo
  source 1..63: mol_type = genomic DNA
gtctgagcttcatctcgggagtggaaggcctgccagggagaagcgggacgaaggctgctttgg

SEQ ID NO: 97410 - DNA, 124 bp, Homo sapiens
  misc_feature 1..124: note = chr7:29845873-29845997
  misc_feature 1..124: note = hyper
  source 1..124: mol_type = genomic DNA
tgctgggccgtgtgccgcccgcgcaacagctcctatttggggaattccagccttaggcctcagtctctccgcagctgagacttgggactctgtacccgggaggcgcgcccgccgacttgggacc

SEQ ID NO: 97411 - DNA, 547 bp, Homo sapiens
  misc_feature 1..547: note = chr7:29846202-29846749
  misc_feature 1..547: note = hyper
  source 1..547: mol_type = genomic DNA
ctgcgggacggagcccggagccggaggcggcggcggcggagacgtcggccggagctcgagtccagtccagcccccggctccgccacctgcaggtagcggcttcccgcgcgggtgcgggtcggtgcccgagggtggaaggaacgggcggtgtggcggccgccgccctggtcggtcccggagcagagtggcccggcccgggacagagatcctgagggcgtgggagggccggggaacccccgccgggctgcagccccgggcccaggaggttgtcgacgtgccgcgcggcgctcacgccccccacccgcaccctgccacgccgccccggccgggccgggccgggccgggcggaaacaaaccgcggggtggggagcgaggtcaccacggggttgcttggtgacttctccggactggactccccggtgagcagcccctggcaccgaggccgcctcggcctggtccttcgcgacgctctctcttctccgcttcgcccccggaacaaaaggctggggtctcgctggggagggggctgtcgcgggaagggctgggg

SEQ ID NO: 97412 - DNA, 38 bp, Homo sapiens; identical to SEQ ID NO: 41244
  misc_feature 1..38: note = chr7:29876677-29876715
  misc_feature 1..38: note = hypo
  source 1..38: mol_type = genomic DNA

SEQ ID NO: 97413 - DNA, 218 bp, Homo sapiens
  misc_feature 1..218: note = chr7:29883063-29883281
  misc_feature 1..218: note = hypo
  source 1..218: mol_type = genomic DNA
taagccgctcgcaggcggtgtctgagctgagggttacggcaggaaggtgacagggggtacaatgccaaagggtgaccctagggtttgtctctggagcaatgattcctaactggagctttctgttatacccaaatcttctggctctttgccttggaaatattttaagattccagggtaactaacgattcctagaaaactgccagcgaacctttcctccc

SEQ ID NO: 97414 - DNA, 30 bp, Homo sapiens
  misc_feature 1..30: note = chr7:29884235-29884265
  misc_feature 1..30: note = hypo
  source 1..30: mol_type = genomic DNA
ctccagctgcgtgaacgggttcagtaagtg

SEQ ID NO: 97415 - DNA, 30 bp, Homo sapiens
  misc_feature 1..30: note = chr7:29966074-29966104
  misc_feature 1..30: note = hypo
  source 1..30: mol_type = genomic DNA
ctttcgatgatggcacgtgcccactcgtgg

SEQ ID NO: 97416 - DNA, 30 bp, Homo sapiens
  misc_feature 1..30: note = chr7:29977605-29977635
  misc_feature 1..30: note = hypo
  source 1..30: mol_type = genomic DNA
aatcagaattggaaacgtctctgcctcttg

SEQ ID NO: 97417 - DNA, 369 bp, Homo sapiens
  misc_feature 1..369: note = chr7:30028510-30028879
  misc_feature 1..369: note = hyper
  source 1..369: mol_type = genomic DNA
atttctctcggccctcgcgagtgaggtcgccaaatactcgacgcctcaagagcgagccgaggaggcagaggccgaccaagccggcctctcggcagccccgcccggcgccccgcggagaacgcccgggtgcggctcgagggaagttgtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggtacggcacctcggggaaggtgcccggctcgccccagac

SEQ ID NO: 97418 - DNA, 54 bp, Homo sapiens
  misc_feature 1..54: note = chr7:30029248-30029302
  misc_feature 1..54: note = hyper
  source 1..54: mol_type = genomic DNA
gcggctcacctggggcggcgggctccgggctccgctctccgctctgcggtgctg

SEQ ID NO: 97419 - DNA, 38 bp, Homo sapiens
  misc_feature 1..38: note = chr7:30180528-30180566
  misc_feature 1..38: note = hypo
  source 1..38: mol_type = genomic DNA
ttacaaatgaatacacgaggctccggttaaacattgcg

SEQ ID NO: 97420 - DNA, 153 bp, Homo sapiens
  misc_feature 1..153: note = chr7:30206381-30206534
  misc_feature 1..153: note = hypo
  source 1..153: mol_type = genomic DNA
caccctcaataccaccgccactgctggatgactgtcgtgctattgtgcagaaggaataagtgcaaatctgagaccccatttcaaaggcaaacacaattcacttttgagctcatcgggttgtttggatcatctctgccacgattttctccattc

SEQ ID NO: 97421 - DNA, 173 bp, Homo sapiens
  misc_feature 1..173: note = chr7:3026166-3026339
  misc_feature 1..173: note = hypo
  source 1..173: mol_type = genomic DNA
aggattaaatgttaccggtaagctgagtttgtgtaaatcaaactctcttctccccattgactggatttagagctgactcctcacctatgcaactgccctccacagcccctgctcacagcctcaaattcctcactcaaagtgtcgcccatcggccgcagcgtcagcaggtgctt

SEQ ID NO: 97422 - DNA, 321 bp, Homo sapiens; identical to SEQ ID NO: 41146
  misc_feature 1..321: note = chr7:3033477-3033798
  misc_feature 1..321: note = hypo
  source 1..321: mol_type = genomic DNA

SEQ ID NO: 97423 - DNA, 38 bp, Homo sapiens
  misc_feature 1..38: note = chr7:30340811-30340849
  misc_feature 1..38: note = hypo
  source 1..38: mol_type = genomic DNA
aaaggggccaggtgccgtggctcaagcctgtaatccta

SEQ ID NO: 97424 - DNA, 30 bp, Homo sapiens
  misc_feature 1..30: note = chr7:3044096-3044126
  misc_feature 1..30: note = hypo
  source 1..30: mol_type = genomic DNA
accgtgaagataccacgtgccttcccaggt

SEQ ID NO: 97425 - DNA, 59 bp, Homo sapiens
  misc_feature 1..59: note = chr7:3052608-3052667
  misc_feature 1..59: note = hypo
  source 1..59: mol_type = genomic DNA
aaaaaaggactctcccgctgtcttgaggggaatctaaatgggtccggccagtttttgag

SEQ ID NO: 97426 - DNA, 41 bp, Homo sapiens
  misc_feature 1..41: note = chr7:30565248-30565289
  misc_feature 1..41: note = hypo
  source 1..41: mol_type = genomic DNA
cattgtctgagtcaccgctccatgatgggggagggaaacac

SEQ ID NO: 97427 - DNA, 45 bp, Homo sapiens
  misc_feature 1..45: note = chr7:30603391-30603436
  misc_feature 1..45: note = hypo
  source 1..45: mol_type = genomic DNA
tgctcctgctgaagccgctgggggaggctccgtgtagtttctggg

SEQ ID NO: 97428 - DNA, 190 bp, Homo sapiens
  misc_feature 1..190: note = chr7:30687808-30687998
  misc_feature 1..190: note = hypo
  source 1..190: mol_type = genomic DNA
ggaggcctgctgcagcgctgtatgggagggccccgaggcctaaacaaacaaatacctaagaggaaaatctggcagaaactcagtcaacacagggcagtgatgccctctgcccattcctcctgctaattaacatgtctaagtggcacagccccctcaggaaaattaacggcaccttcgaggcagagcctgg

SEQ ID NO: 97429 - DNA, 114 bp, Homo sapiens
  misc_feature 1..114: note = chr7:306957-307071
  misc_feature 1..114: note = hypo
  source 1..114: mol_type = genomic DNA
gggcgtggcggtgcccgctgggcccgtaccagccataccctagcctaggttgcccaggtcggccacccagctaggctactgtggggggctccggccagccggccccttcccaga

SEQ ID NO: 97430 - DNA, 30 bp, Homo sapiens; identical to SEQ ID NO: 41248
  misc_feature 1..30: note = chr7:30699730-30699760
  misc_feature 1..30: note = hypo
  source 1..30: mol_type = genomic DNA

SEQ ID NO: 97431 - DNA, 741 bp, Homo sapiens; identical to SEQ ID NO: 31193
  misc_feature 1..741: note = chr7:30721202-30721943
  misc_feature 1..741: note = hyper
  source 1..741: mol_type = genomic DNA

SEQ ID NO: 97432 - DNA, 96 bp, Homo sapiens; identical to SEQ ID NO: 31194
  misc_feature 1..96: note = chr7:30722018-30722114
  misc_feature 1..96: note = hyper
  source 1..96: mol_type = genomic DNA

SEQ ID NO: 97433 - DNA, 343 bp, Homo sapiens
  misc_feature 1..343: note = chr7:30722115-30722458
  misc_feature 1..343: note = hyper
  source 1..343: mol_type = genomic DNA
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcctgagcttcccc

SEQ ID NO: 97434 - DNA, 30 bp, Homo sapiens
  misc_feature 1..30: note = chr7:3074446-3074476
  misc_feature 1..30: note = hypo
  source 1..30: mol_type = genomic DNA
ggcccggtaaaaggccgtcctttaagaagg

SEQ ID NO: 97435 - DNA, 165 bp, Homo sapiens
  misc_feature 1..165: note = chr7:30744677-30744842
  misc_feature 1..165: note = hypo
  source 1..165: mol_type = genomic DNA
gagtctaaggaaagccggcacctgtcgagaaacggacctctgccctgcatttggggccaccacacagaccacatctctgcctgtgactaagactgctcagacccagtgccataggagacgaggtgccttgggtcccgcagagggagctcccggctccaccccaac

SEQ ID NO: 97436 - DNA, 58 bp, Homo sapiens
  misc_feature 1..58: note = chr7:30780708-30780766
  misc_feature 1..58: note = hypo
  source 1..58: mol_type = genomic DNA
cagcctggcctgcaccggctttggaaggtttctctggggagaacggactggggttggg

SEQ ID NO: 97437 - DNA, 162 bp, Homo sapiens
  misc_feature 1..162: note = chr7:3083126-3083288
  misc_feature 1..162: note = hyper
  source 1..162: mol_type = genomic DNA
ggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccc

SEQ ID NO: 97438-97439 - skipped (2 entries)

SEQ ID NO: 97440 - DNA, 263 bp, Homo sapiens
  misc_feature 1..263: note = chr7:3083339-3083602
  misc_feature 1..263: note = hyper
  source 1..263: mol_type = genomic DNA
cctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaaggagagaaagtatgtcataggctgggaggggcgggggagggaaatgcaaaacccgacaggaaatgagactaaaaaatgcgaaaggttagaaaa

SEQ ID NO: 97441 - DNA, 179 bp, Homo sapiens
  misc_feature 1..179: note = chr7:30899905-30900084
  misc_feature 1..179: note = hypo
  source 1..179: mol_type = genomic DNA
cctctgctgtggattcgggggaggacagtgggggctctgtggcctcgtgcgccaggctgcctgctgcttgctgcttctgaccttattaaatgcgtgtgagtacacagcgctttccaacttctaatcctgccataatgatatgattcattcctggcgtggactcacgtgcatggagacca

SEQ ID NO: 97442 - DNA, 30 bp, Homo sapiens
  misc_feature 1..30: note = chr7:31018956-31018986
  misc_feature 1..30: note = hypo
  source 1..30: mol_type = genomic DNA
agctgttacccagcccggggcaggtgcagc

SEQ ID NO: 97443 - DNA, 272 bp, Homo sapiens
  misc_feature 1..272: note = chr7:31091895-31092167
  misc_feature 1..272: note = hyper
  source 1..272: mol_type = genomic DNA
gtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacc

SEQ ID NO: 97444 - DNA, 458 bp, Homo sapiens; identical to SEQ ID NO: 31197
  misc_feature 1..458: note = chr7:31092241-31092699
  misc_feature 1..458: note = hyper
  source 1..458: mol_type = genomic DNA

SEQ ID NO: 97445 - DNA, 167 bp, Homo sapiens; identical to SEQ ID NO: 8988
  misc_feature 1..167: note = chr7:31092713-31092880
  misc_feature 1..167: note = hyper
  source 1..167: mol_type = genomic DNA

SEQ ID NO: 97446 - DNA, 296 bp, Homo sapiens; identical to SEQ ID NO: 8989
  misc_feature 1..296: note = chr7:31092894-31093190
  misc_feature 1..296: note = hyper
  source 1..296: mol_type = genomic DNA

SEQ ID NO: 97447 - DNA, 84 bp, Homo sapiens; identical to SEQ ID NO: 41251
  misc_feature 1..84: note = chr7:31116600-31116684
  misc_feature 1..84: note = hypo
  source 1..84: mol_type = genomic DNA

SEQ ID NO: 97448 - DNA, 248 bp, Homo sapiens
  misc_feature 1..248: note = chr7:31118287-31118535
  misc_feature 1..248: note = hypo
  source 1..248: mol_type = genomic DNA
gcccgttggggctggcgcacactcacgtttgctcagcagagcattttctgggccctagctgccctcaggcagttacacgggctcaagatgggaggagctggaccttgggctacctggggagagggtgccacacacggggagcagtgccacagtgctgtcggtgacttgtggacgtgggcttggaggcgcgggtgtgcgatggcgcctccctgagagggaaggctgggtgggtgcggtgtcctgcagac

SEQ ID NO: 97449 - DNA, 40 bp, Homo sapiens
  misc_feature 1..40: note = chr7:31232678-31232718
  misc_feature 1..40: note = hyper
  source 1..40: mol_type = genomic DNA
gcgggagcctggctgcggattgccgcgctgcccctagagg

SEQ ID NO: 97450 - DNA, 46 bp, Homo sapiens
  misc_feature 1..46: note = chr7:312592-312638
  misc_feature 1..46: note = hypo
  source 1..46: mol_type = genomic DNA
agcccctcctcagctcgcagtccaagggacccgtaaatgtgtgagc

SEQ ID NO: 97451 - DNA, 221 bp, Homo sapiens
  misc_feature 1..221: note = chr7:31375997-31376218
  misc_feature 1..221: note = hyper
  source 1..221: mol_type = genomic DNA
cggctcaggaagtcccgccagccgtgggaggagcagggcagggtcagctctcggctgcacttgggcaagagatagctggagctatcgccgcctgcgccgcgtccctgcttgtggcacaaggggcgggtgaaggggcaaccccctttctccctctccgagcgagtgcggggcagagcctccaggcccgcgcgcggcggtgcgctcgccgctctccatgccac

SEQ ID NO: 97452 - DNA, 158 bp, Homo sapiens
  misc_feature 1..158: note = chr7:31518808-31518966
  misc_feature 1..158: note = hypo
  source 1..158: mol_type = genomic DNA
tcccctgccctgcttcggtccagcatggtgcccgatacattttaagtactgtaaagtgaaatgtttgaggatttggacaggtgcatttggtctggaagaagactagatgagggattagtacctgagttcagtttatcacctgccggtgggcaggccac

SEQ ID NO: 97453 - DNA, 159 bp, Homo sapiens
  misc_feature 1..159: note = chr7:31528357-31528516
  misc_feature 1..159: note = hyper
  source 1..159: mol_type = genomic DNA
taactccaaggagcccgggtatcattgtagtccatgtcaatggcgccccctggtgttcgggggcgcagcagccctgtgcgagtcctgcagcaggccctcctggcccatccactcggtataccccacttaacttttttgcgggggcggtttcatttttgc

SEQ ID NO: 97454 - DNA, 34 bp, Homo sapiens
  misc_feature 1..34: note = chr7:31939253-31939287
  misc_feature 1..34: note = hypo
  source 1..34: mol_type = genomic DNA
aaaaggaggcttccacgtgcgggagacagagaag

SEQ ID NO: 97455 - DNA, 49 bp, Homo sapiens
  misc_feature 1..49: note = chr7:32110065-32110114
  misc_feature 1..49: note = hyper
  source 1..49: mol_type = genomic DNA
tctcctcgcccagctcgcgatgcccagccaggcgcggcgcgcgtttgcc

SEQ ID NO: 97456 - DNA, 343 bp, Homo sapiens
  misc_feature 1..343: note = chr7:32110180-32110523
  misc_feature 1..343: note = hyper
  source 1..343: mol_type = genomic DNA
cggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgcccc

SEQ ID NO: 97457 - DNA, 126 bp, Homo sapiens
  misc_feature 1..126: note = chr7:32110524-32110650
  misc_feature 1..126: note = hyper
  source 1..126: mol_type = genomic DNA
cgcccagcgccccgctcactccctggccgcgcctgccttcgcgcccctctgttttctctcacttaccagcagctctgctgacaagcgagaaaactgacaagtgagaaaagtcgtctgtcagcgccc

SEQ ID NO: 97458 - DNA, 41 bp, Homo sapiens
  misc_feature 1..41: note = chr7:32110651-32110692
  misc_feature 1..41: note = hyper
  source 1..41: mol_type = genomic DNA
ggctggtgtctgggctgtcaccgcgggcgcggagggagggg

SEQ ID NO: 97459 - DNA, 379 bp, Homo sapiens
  misc_feature 1..379: note = chr7:32110703-32111082
  misc_feature 1..379: note = hyper
  source 1..379: mol_type = genomic DNA
cgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaatattgaagcgactgatggggacgaagggaaccacacaccacactcaaaaactcttgatgttttcttgctaaaggggctctctcgctcgcgctctctctcctcc

SEQ ID NO: 97460 - DNA, 158 bp, Homo sapiens; identical to SEQ ID NO: 41253
  misc_feature 1..158: note = chr7:32128181-32128339
  misc_feature 1..158: note = hypo
  source 1..158: mol_type = genomic DNA

SEQ ID NO: 97461 - DNA, 216 bp, Homo sapiens
  misc_feature 1..216: note = chr7:322599-322815
  misc_feature 1..216: note = hypo
  source 1..216: mol_type = genomic DNA
actccatcttcacagcgaagacgtctgatgggcgtcccgttacctggctctgtgtggccggctcaggagactccctgaggcctgtcctgctgagcgctgggggagggtgctgctgccaagtgggcatcgggctgccggcccctcctcccagaatgccaccttcactctcctaaggggacccagatccccatcctgtctgcccggggccctgttaac

SEQ ID NO: 97462 - DNA, 16 bp, Homo sapiens
  misc_feature 1..16: note = chr7:32276939-32276955
  misc_feature 1..16: note = hypo
  source 1..16: mol_type = genomic DNA
ccgcccatctcggcta

SEQ ID NO: 97463 - DNA, 30 bp, Homo sapiens; identical to SEQ ID NO: 41255
  misc_feature 1..30: note = chr7:32323599-32323629
  misc_feature 1..30: note = hypo
  source 1..30: mol_type = genomic DNA

SEQ ID NO: 97464 - DNA, 217 bp, Homo sapiens
  misc_feature 1..217: note = chr7:32337766-32337983
  misc_feature 1..217: note = hyper
  source 1..217: mol_type = genomic DNA
gtctgtcttgacgtccgcctctatctctggggcctaggtgtttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 97465 - DNA, 175 bp, Homo sapiens; identical to SEQ ID NO: 31206
  misc_feature 1..175: note = chr7:32338043-32338218
  misc_feature 1..175: note = hyper
  source 1..175: mol_type = genomic DNA

SEQ ID NO: 97466 - DNA, 814 bp, Homo sapiens
  misc_feature 1..814: note = chr7:32338283-32339097
  misc_feature 1..814: note = hyper
  source 1..814: mol_type = genomic DNA
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgcctggccacgctactctctgtcagccgcggatcccgcgcgccacaggaaagtctgttttctacttcaccttctccttccgtctctggtggctggggggatttggggacccaagggaatggctgaattggcgtcgtgcgtcttctagatatgttttctctggcagaccggggagcttccagaaagcacatcaacagatggaaaggcaaacccctcagccatgagatgttgccgaagtttactccaaacaaggaagtcgggaaaatcgccacgcccacttccttctagccactgcccccagcactggcctggagccccgatagtgtttcttctccactgtccctgccaggaaggtaattgtcaaagtcaccggaggctctatgatgtgaaatgtacaatcgaattagaactcgc

SEQ ID NO: 97467 - DNA, 497 bp, Homo sapiens
  misc_feature 1..497: note = chr7:32467159-32467656
  misc_feature 1..497: note = hyper
  source 1..497: mol_type = genomic DNA
ttctccccatggtgccggccccggtactaagctggggaaagggatccttagggtgtaaactgtcttgccacctactgtttaaacctctgtgaaagataagccttctgaaatagcctcctattcaacccagaaatcaatcctaacttgtaaaagaagttatggacacgaggacgagaaacgggaaatcctgcgggagatagcgctttctcttttcccccagaaagtctccaggcagcagctctgtgagatccttaagcaaggtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagc

SEQ ID NO: 97468 - DNA, 116 bp, Homo sapiens; identical to SEQ ID NO: 31211
  misc_feature 1..116: note = chr7:32467946-32468062
  misc_feature 1..116: note = hyper
  source 1..116: mol_type = genomic DNA

SEQ ID NO: 97469 - DNA, 30 bp, Homo sapiens; identical to SEQ ID NO: 8997
  misc_feature 1..30: note = chr7:32468472-32468502
  misc_feature 1..30: note = hyper
  source 1..30: mol_type = genomic DNA

SEQ ID NO: 97470 - DNA, 89 bp, Homo sapiens
  misc_feature 1..89: note = chr7:32801573-32801662
  misc_feature 1..89: note = hyper
  source 1..89: mol_type = genomic DNA
cgcgggcagtccctgcgtgtccccccacgtgctccccagcactcgcaggacccccgcctccgagcttccctgagcgtgcagcttccagt

SEQ ID NO: 97471 - DNA, 160 bp, Homo sapiens
  misc_feature 1..160: note = chr7:328246-328406
  misc_feature 1..160: note = hypo
  source 1..160: mol_type = genomic DNA
gatgtgtctgagagccgctggatttgtgagattcactgctggtctttgagaacgtccccaaaacaggctgcagctcccgactggctgatcgccggctctctgtttcccttgcgcgtgtgggaatcaagtgattctcctgcctcagcctcctgagtagctg

SEQ ID NO: 97472 - DNA, 396 bp, Homo sapiens; identical to SEQ ID NO: 41147
  misc_feature 1..396: note = chr7:3283498-3283894
  misc_feature 1..396: note = hypo
  source 1..396: mol_type = genomic DNA

SEQ ID NO: 97473 - DNA, 39 bp, Homo sapiens
  misc_feature 1..39: note = chr7:328586-328625
  misc_feature 1..39: note = hypo
  source 1..39: mol_type = genomic DNA
tgacatccgattaaggggacaatacggagtcactgaagt

SEQ ID NO: 97474 - DNA, 25 bp, Homo sapiens
  misc_feature 1..25: note = chr7:3287058-3287083
  misc_feature 1..25: note = hypo
  source 1..25: mol_type = genomic DNA
aatagggccaggcaccgtggctcac

SEQ ID NO: 97475 - DNA, 72 bp, Homo sapiens
  misc_feature 1..72: note = chr7:329622-329694
  misc_feature 1..72: note = hyper
  source 1..72: mol_type = genomic DNA
cccggaaagcaccaccgagtctcaggcgcgcccagggcgcacgggaccggggctcacggcaccggggcgctc

SEQ ID NO: 97476 - DNA, 167 bp, Homo sapiens
  misc_feature 1..167: note = chr7:329764-329931
  misc_feature 1..167: note = hyper
  source 1..167: mol_type = genomic DNA
cgagccctgccctgagcgccccaggaagggagccgggtagggggggccgccccgcccgtcggaccacccagcgcgccgcctcctcctccctccccccgcggcggtcagagggtcacccagacgccccacaccgctcccctcggccgctttaccggtggctggggcct

SEQ ID NO: 97477 - DNA, 158 bp, Homo sapiens
  misc_feature 1..158: note = chr7:32982112-32982270
  misc_feature 1..158: note = hyper
  source 1..158: mol_type = genomic DNA
ttgaacttgcctgttcggtccacaaatgccgagcaagcgccaataactcttggcttccccaaaagaggcgacgcccacaccaaagcgggggcgaggagcgcaagccgctgccgcctccccgggccgaggcccccgcccacccgcgccgcggcctccag

SEQ ID NO: 97478 - DNA, 438 bp, Homo sapiens
  misc_feature 1..438: note = chr7:32996944-32997382
  misc_feature 1..438: note = hyper
  source 1..438: mol_type = genomic DNA
gcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccc

SEQ ID NO: 97479 - DNA, 253 bp, Homo sapiens; identical to SEQ ID NO: 30964
  misc_feature 1..253: note = chr7:330425-330678
  misc_feature 1..253: note = hyper
  source 1..253: mol_type = genomic DNA

SEQ ID NO: 97480 - DNA, 108 bp, Homo sapiens
  misc_feature 1..108: note = chr7:330720-330828
  misc_feature 1..108: note = hyper
  source 1..108: mol_type = genomic DNA
cgccaaccagcgcgcctggcagaactccatccgccacaacctgtccctcaacagctgcttcgtcaaggtgagcgccgcccccgacgggccccgggtgtcccagcgtgg

SEQ ID NO: 97481 - DNA, 884 bp, Homo sapiens
  misc_feature 1..884: note = chr7:3339931-3340815
  misc_feature 1..884: note = hyper
  source 1..884: mol_type = genomic DNA
ttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 97482 - DNA, 123 bp, Homo sapiens; identical to SEQ ID NO: 31017
  misc_feature 1..123: note = chr7:3341286-3341409
  misc_feature 1..123: note = hyper
  source 1..123: mol_type = genomic DNA

SEQ ID NO: 97483 - DNA, 715 bp, Homo sapiens
  misc_feature 1..715: note = chr7:3341569-3342284
  misc_feature 1..715: note = hyper
  source 1..715: mol_type = genomic DNA
cgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctg

SEQ ID NO: 97484 - DNA, 77 bp, Homo sapiens
  misc_feature 1..77: note = chr7:33545157-33545234
  misc_feature 1..77: note = hypo
  source 1..77: mol_type = genomic DNA
ggtgattctgctgatcgcgctgtggcagaagcttagtgctgaccaggttgctattctggaagcggcatttctgccgc

SEQ ID NO: 97485 - DNA, 2103 bp, Homo sapiens
  misc_feature 1..2103: note = chr7:33943451-33945554
  misc_feature 1..2103: note = hyper
  source 1..2103: mol_type = genomic DNA
ctcgcatcagctcctcggtgtgtcgcgatgttggcaatgttgcactaattaagtgaagtctccaaatcactcgaaaaaacgaataaacagtcaacgaggcagggaagggttaaggtgaagctagattaaacctgtcagcaaacagactcatttattttcaaagctgtagtttccacaatggaaacaacccactttgcctggagacccttaggtccgttccgtggggacccggtttcaactcttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggcacccgggcctgagcgctagtgctgcggcatccccggggctcccccaagaaagggaggaggagccgcgctcgcccggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggaggtgaggagtgcgggagtggaggacgctgcggcagcgacagcgacagcccccgaaacagtagcggcagcccgggcggcggctgagcggcagtgcgcagtcggcagcgccgcagctcctctcagtctatctccggctgccgcaacaccccttcctcctggccccctctccggcgctgaggggctgactgctaagccactgcaagcaactccctcaggaaaaaaaaaaaaaaagccgcatcggaggagcctggccgcaggacccctcctccccgggcgcccccacaccttggtctctccccccgccctccctcacacccccccgccccccagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggtaggggagggggcgggagggaccggccctccgggacgccggtttggtacctgggaaaggtggcgctggcttgccccggggatgggagggtggggagcgcgcaccttggcgcttgccctgcgctggtcgatggggatgaagcgaagccccgggagggctgggaaggctggtgaagaggttgcgggctgagaggctg

SEQ ID NO: 97486 - DNA, 30 bp, Homo sapiens
  misc_feature 1..30: note = chr7:33963977-33964007
  misc_feature 1..30: note = hypo
  source 1..30: mol_type = genomic DNA
gcttctcctctcacccggaatccagcttga

SEQ ID NO: 97487 - DNA, 30 bp, Homo sapiens
  misc_feature 1..30: note = chr7:341655-341685
  misc_feature 1..30: note = hypo
  source 1..30: mol_type = genomic DNA
ccccagctgacctcccgaagctcctgtacc

SEQ ID NO: 97488 - DNA, 313 bp, Homo sapiens
  misc_feature 1..313: note = chr7:345295-345608
  misc_feature 1..313: note = hypo
  source 1..313: mol_type = genomic DNA
gctcctggagcttcccggagctggtcctccagtagaggtgctggggatggggggacgcagccacggccttcatgcaccaacctggggtctccacgagcaaactctgtgttcaaggaggcactcggcctggggacgcggtgggaagagctatcggaggagcccctcggagctgcctcagcacagctgatgaaagcaatcagcgcccgcctgagctggatgtaaaggttaatacataaatcaaagggaaatgtcaggtgccttttaacactgattgagatgtaattgggcagggaccgtgcgccaggcacccgcg

SEQ ID NO: 97489 - DNA, 25 bp, Homo sapiens
  misc_feature 1..25: note = chr7:35190140-35190165
  misc_feature 1..25: note = hypo
  source 1..25: mol_type = genomic DNA
atcttttttttgagacggggtcttg

SEQ ID NO: 97490 - DNA, 561 bp, Homo sapiens; identical to SEQ ID NO: 31218
  misc_feature 1..561: note = chr7:35225273-35225834
  misc_feature 1..561: note = hyper
  source 1..561: mol_type = genomic DNA

SEQ ID NO: 97491 - DNA, 479 bp, Homo sapiens; identical to SEQ ID NO: 31219
  misc_feature 1..479: note = chr7:35226044-35226523
  misc_feature 1..479: note = hyper
  source 1..479: mol_type = genomic DNA

SEQ ID NO: 97492 - DNA, 54 bp, Homo sapiens; identical to SEQ ID NO: 31220
  misc_feature 1..54: note = chr7:35226556-35226610
  misc_feature 1..54: note = hyper
  source 1..54: mol_type = genomic DNA

SEQ ID NO: 97493 - DNA, 117 bp, Homo sapiens
  misc_feature 1..117: note = chr7:35226611-35226728
  misc_feature 1..117: note = hyper
  source 1..117: mol_type = genomic DNA
ccacttccttggcacggaacagcgtttactgaatcttagagcaaaatgcttttccaatgaggttcctcagaagtcatcggccctaggagcggtgtgctcaagcgctttcagcaccag

SEQ ID NO: 97494 - DNA, 210 bp, Homo sapiens; identical to SEQ ID NO: 31222
  misc_feature 1..210: note = chr7:35292877-35293087
  misc_feature 1..210: note = hyper
  source 1..210: mol_type = genomic DNA

SEQ ID NO: 97495 - DNA, 296 bp, Homo sapiens; identical to SEQ ID NO: 673
  misc_feature 1..296: note = chr7:35293182-35293478
  misc_feature 1..296: note = hyper
  source 1..296: mol_type = genomic DNA

SEQ ID NO: 97496 - DNA, 646 bp, Homo sapiens
  misc_feature 1..646: note = chr7:35294031-35294677
  misc_feature 1..646: note = hyper
  source 1..646: mol_type = genomic DNA
cgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagccgtgt

SEQ ID NO: 97497 - DNA, 29 bp, Homo sapiens
  misc_feature 1..29: note = chr7:35295077-35295106
  misc_feature 1..29: note = hyper
  source 1..29: mol_type = genomic DNA
gctggaaggaatttacgctgtcttctagc

SEQ ID NO: 97498 - DNA, 32 bp, Homo sapiens
  misc_feature 1..32: note = chr7:35295864-35295896
  misc_feature 1..32: note = hyper
  source 1..32: mol_type = genomic DNA
ctttccaagtgcctacgcggccttagcccagc

SEQ ID NO: 97499 - DNA, 266 bp, Homo sapiens; identical to SEQ ID NO: 31226
  misc_feature 1..266: note = chr7:35296739-35297005
  misc_feature 1..266: note = hyper
  source 1..266: mol_type = genomic DNA

SEQ ID NO: 97500 - DNA, 217 bp, Homo sapiens; identical to SEQ ID NO: 676
  misc_feature 1..217: note = chr7:35297137-35297354
  misc_feature 1..217: note = hyper
  source 1..217: mol_type = genomic DNA

SEQ ID NO: 97501 - DNA, 547 bp, Homo sapiens; identical to SEQ ID NO: 677
  misc_feature 1..547: note = chr7:35297470-35298017
  misc_feature 1..547: note = hyper
  source 1..547: mol_type = genomic DNA

SEQ ID NO: 97502 - DNA, 51 bp, Homo sapiens
  misc_feature 1..51: note = chr7:35298121-35298172
  misc_feature 1..51: note = hyper
  source 1..51: mol_type = genomic DNA
cgagctcactaccgcagggaccggccctcagagccccgggcctcctcccgg

SEQ ID NO: 97503 - DNA, 231 bp, Homo sapiens
  misc_feature 1..231: note = chr7:35300778-35301009
  misc_feature 1..231: note = hyper
  source 1..231: mol_type = genomic DNA
ggtctttctgccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcc

SEQ ID NO: 97504 - DNA, 865 bp, Homo sapiens
  misc_feature 1..865: note = chr7:35301101-35301966
  misc_feature 1..865: note = hyper
  source 1..865: mol_type = genomic DNA
cggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggctgacgagttattagaatt

SEQ ID NO: 97505 - DNA, 25 bp, Homo sapiens
  misc_feature 1..25: note = chr7:35327606-35327631
  misc_feature 1..25: note = hypo
  source 1..25: mol_type = genomic DNA
catgagccaccgagcctggccagaa

SEQ ID NO: 97506 - DNA, 87 bp, Homo sapiens
  misc_feature 1..87: note = chr7:35350106-35350193
  misc_feature 1..87: note = hypo
  source 1..87: mol_type = genomic DNA
ctcactccctggaagcgatcactgctaattacatccagttagaatgctcaagcaagcaggtttcttttttttttcttttctttttgt

SEQ ID NO: 97507-97508 - skipped (2 entries)

SEQ ID NO: 97509 - DNA, 30 bp, Homo sapiens
  misc_feature 1..30: note = chr7:355057-355087
  misc_feature 1..30: note = hypo
  source 1..30: mol_type = genomic DNA
tcactctgtgtttgccgtggttttacctta

SEQ ID NO: 97510 - DNA, 185 bp, Homo sapiens
  misc_feature 1..185: note = chr7:35579059-35579244
  misc_feature 1..185: note = hypo
  source 1..185: mol_type = genomic DNA
actcagtggctgacacggtagagattcagtatatgtctgtttgttgaaaccaggcccgataatatgaaagcaaggttctttctacacagatgaatagactgaatggccaaaaacatcatttgccaaaggtattctgggaacagcactgtcttgggatgttaataaatgtgcgtcaaacgtgggct

SEQ ID NO: 97511 - DNA, 30 bp, Homo sapiens
  misc_feature 1..30: note = chr7:35689006-35689036
  misc_feature 1..30: note = hypo
  source 1..30: mol_type = genomic DNA
taaaacgttagtaatcgttgtcaacaaaaa

SEQ ID NO: 97512 - DNA, 138 bp, Homo sapiens
  misc_feature 1..138: note = chr7:35839940-35840078
  misc_feature 1..138: note = hyper
  source 1..138: mol_type = genomic DNA
caatgggggctacagcggccgacctctggggctgtgccaggccactagagtgtgatggcgcgagggaagggtcggggaaacagggcctaacctcacttttcaccccgaaagtcaagatagccacggaaacagggatga

SEQ ID NO: 97513 - DNA, 88 bp, Homo sapiens; identical to SEQ ID NO: 41257
  misc_feature 1..88: note = chr7:36428640-36428728
  misc_feature 1..88: note = hypo
  source 1..88: mol_type = genomic DNA

SEQ ID NO: 97514 - DNA, 30 bp, Homo sapiens
  misc_feature 1..30: note = chr7:36441223-36441253
  misc_feature 1..30: note = hypo
  source 1..30: mol_type = genomic DNA
agacgtgagccacctcggcaggccacctga

SEQ ID NO: 97515 - DNA, 30 bp, Homo sapiens
  misc_feature 1..30: note = chr7:36923939-36923969
  misc_feature 1..30: note = hypo
  source 1..30: mol_type = genomic DNA
tattctgaggcgctacgagctaaaattaat

SEQ ID NO: 97516 - DNA, 272 bp, Homo sapiens
  misc_feature 1..272: note = chr7:369844-370116
  misc_feature 1..272: note = hypo
  source 1..272: mol_type = genomic DNA
gacaagttagcacaacgtttatggccacgaagttggcaacatcaataaaaatgtaaatgcatctgccctttggcccggcaattctgcttatcctatagataccattgcgcacaggtgaggccgtctatgtgtgaaattactcactgcagcattatttacaatggcctaaaagcccgttgataagaggttgttatataaatcataatagatccataaagtgaaacacaactgtaagaaaaacgaggaggctgggcacagtggctcacacctgc

SEQ ID NO: 97517 - DNA, 26 bp, Homo sapiens
  misc_feature 1..26: note = chr7:37025520-37025546
  misc_feature 1..26: note = hypo
  source 1..26: mol_type = genomic DNA
tactcaccaagctcccgtaagtccat

SEQ ID NO: 97518 - DNA, 60 bp, Homo sapiens
  misc_feature 1..60: note = chr7:37136264-37136324
  misc_feature 1..60: note = hypo
  source 1..60: mol_type = genomic DNA
agctctatactactgcggccaaagggacattcatgcttgtcttctcgactactgttctca

SEQ ID NO: 97519 - DNA, 39 bp, Homo sapiens
  misc_feature 1..39: note = chr7:37211371-37211410
  misc_feature 1..39: note = hypo
  source 1..39: mol_type = genomic DNA
caggcgtgagccaccacgcctggccgcctttctcttcta

SEQ ID NO: 97520 - DNA, 30 bp, Homo sapiens; identical to SEQ ID NO: 14984
  misc_feature 1..30: note = chr7:37264509-37264539
  misc_feature 1..30: note = hypo
  source 1..30: mol_type = genomic DNA

SEQ ID NO: 97521 - DNA, 38 bp, Homo sapiens; identical to SEQ ID NO: 41148
  misc_feature 1..38: note = chr7:3727142-3727180
  misc_feature 1..38: note = hypo
  source 1..38: mol_type = genomic DNA

SEQ ID NO: 97522 - DNA, 181 bp, Homo sapiens; identical to SEQ ID NO: 14985
  misc_feature 1..181: note = chr7:37279183-37279364
  misc_feature 1..181: note = hypo
  source 1..181: mol_type = genomic DNA

SEQ ID NO: 97523 - DNA, 30 bp, Homo sapiens
  misc_feature 1..30: note = chr7:37347397-37347427
  misc_feature 1..30: note = hypo
  source 1..30: mol_type = genomic DNA
ttgtcaatctctatgcgaattttaaaacaa

SEQ ID NO: 97524 - DNA, 119 bp, Homo sapiens; identical to SEQ ID NO: 41261
  misc_feature 1..119: note = chr7:37399153-37399272
  misc_feature 1..119: note = hypo
  source 1..119: mol_type = genomic DNA

SEQ ID NO: 97525 - DNA, 24 bp, Homo sapiens
  misc_feature 1..24: note = chr7:37423707-37423731
  misc_feature 1..24: note = hypo
  source 1..24: mol_type = genomic DNA
gtgcccggccgaaacatacaggtt

SEQ ID NO: 97526 - DNA, 208 bp, Homo sapiens
  misc_feature 1..208: note = chr7:37424312-37424520
  misc_feature 1..208: note = hypo
  source 1..208: mol_type = genomic DNA
actccgtctcaaaaaaaaaaaaaagaactttccagtttgtttatttgtcaagaaaacagtaagttctagatctacttgagaggttgcctcagaaatctgacctcaacaaattacttctttcactctaatctgcaataaaactagcaacggttgtacacacaaaaaaagacatgagtaaaaatgcacacgaattcgtttgagcttgtga

SEQ ID NO: 97527 - DNA, 43 bp, Homo sapiens
  misc_feature 1..43: note = chr7:37446822-37446865
  misc_feature 1..43: note = hypo
  source 1..43: mol_type = genomic DNA
tggatgagggtctggcgcggtggctcacgtctgtaatcctagc

SEQ ID NO: 97528 - DNA, 30 bp, Homo sapiens
  misc_feature 1..30: note = chr7:37484434-37484464
  misc_feature 1..30: note = hypo
  source 1..30: mol_type = genomic DNA
agttaagtcaatagccgacagaactgcatc

SEQ ID NO: 97529 - DNA, 138 bp, Homo sapiens
  misc_feature 1..138: note = chr7:37487113-37487251
  misc_feature 1..138: note = hyper
  source 1..138: mol_type = genomic DNA
ggtcaaggcaggtcccgacccgcctccaacttcaaatggccccctaggcgggagagggtcactgggcggggagttcctggctgtgcggtcacacacacacacaccgactcacacacacacccacaacaccccccccac

SEQ ID NO: 97530 - DNA, 83 bp, Homo sapiens
  misc_feature 1..83: note = chr7:37487371-37487454
  misc_feature 1..83: note = hyper
  source 1..83: mol_type = genomic DNA
cggcacagcaccgacttcccaaccccaaacacacgcgcgcacccccgggacagctgagttctgtatttcctcttcctcaaagc

SEQ ID NO: 97531 - DNA, 211 bp, Homo sapiens; identical to SEQ ID NO: 31235
  misc_feature 1..211: note = chr7:37487755-37487966
  misc_feature 1..211: note = hyper
  source 1..211: mol_type = genomic DNA

SEQ ID NO: 97532 - DNA, 1204 bp, Homo sapiens
  misc_feature 1..1204: note = chr7:37487984-37489188
  misc_feature 1..1204: note = hyper
  source 1..1204: mol_type = genomic DNA
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacccttggacagagtggcaaaaaaaaaaaaaaaaagtttcctccctctccgtcgacatctatgtatttactaaccctgcaattgaaactacaagatgtatttctaaccaattaagccagggacttcctaattttgcataactttgcataaggcaagacgttccacccataat

SEQ ID NO: 97533 - DNA, 30 bp, Homo sapiens
  misc_feature 1..30: note = chr7:37533583-37533613
  misc_feature 1..30: note = hypo
  source 1..30: mol_type = genomic DNA
caggcccttgcgtaacgggccccgctctcc

SEQ ID NO: 97534 - DNA, 30 bp, Homo sapiens; identical to SEQ ID NO: 41265
  misc_feature 1..30: note = chr7:37686948-37686978
  misc_feature 1..30: note = hypo
  source 1..30: mol_type = genomic DNA

SEQ ID NO: 97535 - DNA, 33 bp, Homo sapiens
  misc_feature 1..33: note = chr7:3771086-3771119
  misc_feature 1..33: note = hypo
  source 1..33: mol_type = genomic DNA
ccagctgacagcttccgacgagttgccagatga

SEQ ID NO: 97536 - DNA, 142 bp, Homo sapiens
  misc_feature 1..142: note = chr7:37727598-37727740
  misc_feature 1..142: note = hypo
  source 1..142: mol_type = genomic DNA
gaatgcaaccacagacgatgcataaataaataagcttggctgtgatcagataaaaactgtgtttacaaaaacgagtggccagcccatgggatgtactttgctggcccatgaactatattgaatgcttcgtgtcaacttttaa

SEQ ID NO: 97537 - DNA, 146 bp, Homo sapiens
  misc_feature 1..146: note = chr7:37770953-37771099
  misc_feature 1..146: note = hypo
  source 1..146: mol_type = genomic DNA
caagcaagtcatgcacgtggagaacgaggtgtctctctgaaagaaatgtagagagaaaattttaggtcaactaattaaaaattcccatcaatctctagaatagcatcccatatgcaaaggaatactctgtcgcccaggctggagtg

SEQ ID NO: 97538 - DNA, 178 bp, Homo sapiens
  misc_feature 1..178: note = chr7:37835728-37835906
  misc_feature 1..178: note = hypo
  source 1..178: mol_type = genomic DNA
atggttatgatgttacgtatgatcttcaaaacaaatagccaatcaatgatcggtacaatcatcttcaatatcatagtgctgcactccatcctcctggtcagccttccgttccacctcagctattatgtcttagtcatctgggagcttggatttctttacctgccgagtggttagcatc

SEQ ID NO: 97539 - DNA, 187 bp, Homo sapiens
  misc_feature 1..187: note = chr7:37868787-37868974
  misc_feature 1..187: note = hypo
  source 1..187: mol_type = genomic DNA
ctcagtagaaggctgcggtggttttgcttgccctcaggctgtatacccagttcttcatacctctcccaggctcctccagatctgcctcctgctgaccttgtacccagctgcagcgacaccgagctcctcacagcttcccaaagtgggctggcccctctcacgacagggtcatcgcacaggctccctc

SEQ ID NO: 97540 - DNA, 30 bp, Homo sapiens
  misc_feature 1..30: note = chr7:37888029-37888059
  misc_feature 1..30: note = hypo
  source 1..30: mol_type = genomic DNA
gagagccttctgctccgatttgaggtgtat

SEQ ID NO: 97541 - DNA, 30 bp, Homo sapiens; identical to SEQ ID NO: 41268
  misc_feature 1..30: note = chr7:37907440-37907470
  misc_feature 1..30: note = hypo
  source 1..30: mol_type = genomic DNA

SEQ ID NO: 97542 - DNA, 30 bp, Homo sapiens
  misc_feature 1..30: note = chr7:37953791-37953821
  misc_feature 1..30: note = hypo
  source 1..30: mol_type = genomic DNA
aatggctttaacagacgacttaccatagct

SEQ ID NO: 97543 - DNA, 419 bp, Homo sapiens
  misc_feature 1..419: note = chr7:37955637-37956056
  misc_feature 1..419: note = hyper
  source 1..419: mol_type = genomic DNA
tggcagccacagccccgggcgcctcctcgcctccctccatccttcctacggcctcaccctccgggaggtccgtgacgatggcttcaggcgagatgcacacgccacggtcatagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatggcgttctcctgcgtgctgtggtgcaggtggttgggcatccgcgtgatgttccagggcatgtgccggcacatagggatg

SEQ ID NO: 97544 - DNA, 308 bp, Homo sapiens; identical to SEQ ID NO: 31238
  misc_feature 1..308: note = chr7:37956260-37956568
  misc_feature 1..308: note = hyper
  source 1..308: mol_type = genomic DNA

SEQ ID NO: 97545 - DNA, 373 bp, Homo sapiens
  misc_feature 1..373: note = chr7:37960164-37960537
  misc_feature 1..373: note = hyper
  source 1..373: mol_type = genomic DNA
ccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 97546 - DNA, 396 bp, Homo sapiens; identical to SEQ ID NO: 9019
  misc_feature 1..396: note = chr7:37960562-37960958
  misc_feature 1..396: note = hyper
  source 1..396: mol_type = genomic DNA

SEQ ID NO: 97547 - DNA, 41 bp, Homo sapiens
  misc_feature 1..41: note = chr7:37961158-37961199
  misc_feature 1..41: note = hyper
  source 1..41: mol_type = genomic DNA
ccctgcagtctagggcgtgtcttctgcgctatctcatttct

SEQ ID NO: 97548 - DNA, 30 bp, Homo sapiens
  misc_feature 1..30: note = chr7:37962835-37962865
  misc_feature 1..30: note = hypo
  source 1..30: mol_type = genomic DNA
aatcttggagattgtcgtagtggtccaggt

SEQ ID NO: 97549 - DNA, 30 bp, Homo sapiens; identical to SEQ ID NO: 41269
  misc_feature 1..30: note = chr7:37969938-37969968
  misc_feature 1..30: note = hypo
  source 1..30: mol_type = genomic DNA

SEQ ID NO: 97550 - DNA, 38 bp, Homo sapiens
  misc_feature 1..38: note = chr7:37973881-37973919
  misc_feature 1..38: note = hypo
  source 1..38: mol_type = genomic DNA
ctgccattcttagcatgatggctcgtagttccaagatt

SEQ ID NO: 97551 - DNA, 30 bp, Homo sapiens
  misc_feature 1..30: note = chr7:38044515-38044545
  misc_feature 1..30: note = hypo
  source 1..30: mol_type = genomic DNA
accataaggagagcacgatgcaccaggcat

SEQ ID NO: 97552 - DNA, 32 bp, Homo sapiens
  misc_feature 1..32: note = chr7:380766-380798
  misc_feature 1..32: note = hypo
  source 1..32: mol_type = genomic DNA
gcctccggtgctggccgcggtccttgccactc

SEQ ID NO: 97553 - DNA, 30 bp, Homo sapiens; identical to SEQ ID NO: 41021
  misc_feature 1..30: note = chr7:381568-381598
  misc_feature 1..30: note = hypo
  source 1..30: mol_type = genomic DNA

SEQ ID NO: 97554 - DNA, 37 bp, Homo sapiens; identical to SEQ ID NO: 41270
  misc_feature 1..37: note = chr7:38170685-38170722
  misc_feature 1..37: note = hypo
  source 1..37: mol_type = genomic DNA

SEQ ID NO: 97555 - DNA, 30 bp, Homo sapiens
  misc_feature 1..30: note = chr7:38422917-38422947
  misc_feature 1..30: note = hypo
  source 1..30: mol_type = genomic DNA
atttttatgtacctacgaacataaacatgc

SEQ ID NO: 97556 - DNA, 97 bp, Homo sapiens
  misc_feature 1..97: note = chr7:38508402-38508499
  misc_feature 1..97: note = hypo
  source 1..97: mol_type = genomic DNA
tataagagcatattccgatgtgaccctggcttgtaaaaacttaatgtaaccagcagtagaacatacagacggccgggcgcggtggctcacgcctgta

SEQ ID NO: 97557 - DNA, 358 bp, Homo sapiens; identical to SEQ ID NO: 31241
  misc_feature 1..358: note = chr7:38670306-38670664
  misc_feature 1..358: note = hyper
  source 1..358: mol_type = genomic DNA

SEQ ID NO: 97558 - DNA, 29 bp, Homo sapiens
  misc_feature 1..29: note = chr7:38670956-38670985
  misc_feature 1..29: note = hyper
  source 1..29: mol_type = genomic DNA
cgggtccggggagctgcgaagagcagagc

SEQ ID NO: 97559 - DNA, 188 bp, Homo sapiens
  misc_feature 1..188: note = chr7:38670986-38671174
  misc_feature 1..188: note = hyper
  source 1..188: mol_type = genomic DNA
cgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcgggactggctgtga

SEQ ID NO: 97560 - DNA, 79 bp, Homo sapiens
  misc_feature 1..79: note = chr7:38731677-38731756
  misc_feature 1..79: note = hypo
  source 1..79: mol_type = genomic DNA
tggggttttacatgccggcatatttcccgggtcttgcgtcccttttcccatgattcttcccttagggtgggccaccaca

SEQ ID NO: 97561 - DNA, 195 bp, Homo sapiens
  misc_feature 1..195: note = chr7:38740329-38740524
  misc_feature 1..195: note = hypo
  source 1..195: mol_type = genomic DNA
cttgttttctgagctcgctgggggattgatgctccacggagcgctgctgggaaacgctggaccagagccagttccaaagacttccttctgaaaatcctaggtttgttctgcaggtgtggcctaacagctccatcttttttgtgttcagaaacattcatcctgtgctatcacatgcggcatcgcctcaggtaagac

SEQ ID NO: 97562 - DNA, 30 bp, Homo sapiens
  misc_feature 1..30: note = chr7:38752794-38752824
  misc_feature 1..30: note = hypo
  source 1..30: mol_type = genomic DNA
attcttgggcttacccgatggtcttagtac

SEQ ID NO: 97563 - DNA, 34 bp, Homo sapiens
  misc_feature 1..34: note = chr7:387990-388024
  misc_feature 1..34: note = hypo
  source 1..34: mol_type = genomic DNA
cacagaggcccccaccgggcgtctgggggcaggg

SEQ ID NO: 97564 - DNA, 239 bp, Homo sapiens
  misc_feature 1..239: note = chr7:389663-389902
  misc_feature 1..239: note = hypo
  source 1..239: mol_type = genomic DNA
accagcagggtgtcacggggcaagtacctcatgttcgagttctccacgccacagccttgctgctgagagaccacccactatggaaagagcaggcgtgcacagctatgggtcagcagggcctcagatggacggtctctccctctgcaggctgtggtcagcaggcccctggatgcaggctggccctggatggacggtcctcctctgcaggccgtgtttggtgagttcggttcacatgcatc

SEQ ID NO: 97565 - DNA, 536 bp, Homo sapiens
  misc_feature 1..536: note = chr7:39015528-39016064
  misc_feature 1..536: note = hyper
  source 1..536: mol_type = genomic DNA
gggaagttgagcctccgatcgggtggcagcgcgtggggaacccaggctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttctgtctagtgtccgcccaggcggggtcccaagaaggcgatgccaggagcagtcgcgccccctgccctctgtgagcccgcaggtttcgggcaagtttggctcagtccttgtcgatgctccaggctcggcttccctggcctccccttccctggccaaaggagatgatgggaagcctgaggttctgatctgggataactgcagaaacccccgggtaggacttcag

SEQ ID NO: 97566 - DNA, 30 bp, Homo sapiens
  misc_feature 1..30: note = chr7:39056562-39056592
  misc_feature 1..30: note = hypo
  source 1..30: mol_type = genomic DNA
gagctctagggaacccgtgaatgtcataaa

SEQ ID NO: 97567 - DNA, 30 bp, Homo sapiens; identical to SEQ ID NO: 41273
  misc_feature 1..30: note = chr7:39192698-39192728
  misc_feature 1..30: note = hypo
  source 1..30: mol_type = genomic DNA

SEQ ID NO: 97568 - DNA, 199 bp, Homo sapiens
  misc_feature 1..199: note = chr7:39317796-39317995
  misc_feature 1..199: note = hypo
  source 1..199: mol_type = genomic DNA
gaaaagcagagaaggcgtttcggaaaagctcctgagataggatccatgggacactttggcatcactgtgatcagaaactggaagtaagctctttccatagatccaggcccaggagacacaaaccaatggcattgagcctgtttatggtcaccttctgcatggtgttgggggtaaggggagttggcgcacctggttttgc

SEQ ID NO: 97569 - DNA, 34 bp, Homo sapiens
  misc_feature 1..34: note = chr7:3942787-3942821
  misc_feature 1..34: note = hypo
  source 1..34: mol_type = genomic DNA
tttttttgagacagacgagactccgtcgctcagg

SEQ ID NO: 97570 - DNA, 763 bp, Homo sapiens
  misc_feature 1..763: note = chr7:39453541-39454304
  misc_feature 1..763: note = hyper
  source 1..763: mol_type = genomic DNA
aagatgccccacaaacgacggtcccctggtccgaggagccgggcagcgccgcgcagccgtctcgcgtgggacccacccgcgggcggagccaggcggcagggctgccccaccgagcttcaccccagcaacccctttaactttcttaaccctgtattccccaaccgaacacttcccagagttcacgctggcagagcccacttcaaaaaatgctgcaggaagccattcacactcattcctatccacgtttttaaaaatgcgaaatagtgatttaaatcagaacagaacctcttccaatgggggtttcctttgcaaccggggcttcgcggtgatttctgtgctgttttgagggcacacacctacataacacgtttgcagagataagggatctcaaactgttcccaaaagtcccagggactcgtaatatgcaaaccgagggcaaatgaacgtgggaggatccgaggcgctcgctgaaggggctctcctgcagtgcccaggcagagggagagtggagggggcggctgtggagtgaagggcggaagtgccctcgccgtcctgaggcctgggaccctcttgatggtaaatggcgctgttgagccccgatgcgcagggactccgcgggcggcggacttgacaggaagctttgctgcggggcggcccagctgcggacgcgcgggacgtcagggccccagcagaagcgccgggctgtgcgtccttaagactgcgggtgcggccccgcccaaggtcgccccgccctccatccttc

SEQ ID NO: 97571 - DNA, 57 bp, Homo sapiens
  misc_feature 1..57: note = chr7:39873278-39873335
  misc_feature 1..57: note = hyper
  source 1..57: mol_type = genomic DNA
cagagaccttcttgtcggagattcgatgggaaaaaaacatcacgttgggagaaccgc

SEQ ID NO: 97572 - DNA, 30 bp, Homo sapiens
  misc_feature 1..30: note = chr7:3991878-3991908
  misc_feature 1..30: note = hypo
  source 1..30: mol_type = genomic DNA
ctcttatttggctatcgtgatcggtgttca

SEQ ID NO: 97573 - DNA, 101 bp, Homo sapiens; identical to SEQ ID NO: 41275
  misc_feature 1..101: note = chr7:39921805-39921906
  misc_feature 1..101: note = hypo
  source 1..101: mol_type = genomic DNA

SEQ ID NO: 97574 - DNA, 41 bp, Homo sapiens
  misc_feature 1..41: note = chr7:4000133-4000174
  misc_feature 1..41: note = hypo
  source 1..41: mol_type = genomic DNA
gctgtgccacccttccggtgcagcggcgtgtcacccttcca

SEQ ID NO: 97575 - DNA, 30 bp, Homo sapiens
  misc_feature 1..30: note = chr7:4000394-4000424
  misc_feature 1..30: note = hypo
  source 1..30: mol_type = genomic DNA
gagagaagagtaagacgaattttacgtgga

SEQ ID NO: 97576 - DNA, 30 bp, Homo sapiens
  misc_feature 1..30: note = chr7:4006028-4006058
  misc_feature 1..30: note = hypo
  source 1..30: mol_type = genomic DNA
ggggttccggttaatcgttattgggtagca

SEQ ID NO: 97577 - DNA, 93 bp, Homo sapiens
  misc_feature 1..93: note = chr7:40157085-40157178
  misc_feature 1..93: note = hypo
  source 1..93: mol_type = genomic DNA
gatgataacatggtatacgtattgttatgaaagtgaccgtgtccataaataggagaaatcccataactcctactacatcggttctaccttttg

SEQ ID NO: 97578 - DNA, 37 bp, Homo sapiens
  misc_feature 1..37: note = chr7:40401724-40401761
  misc_feature 1..37: note = hypo
  source 1..37: mol_type = genomic DNA
aagttcaaccatgcccggcgcagtggctatcgcctgt

SEQ ID NO: 97579 - DNA, 142 bp, Homo sapiens
  misc_feature 1..142: note = chr7:40407687-40407829
  misc_feature 1..142: note = hypo
  source 1..142: mol_type = genomic DNA
ctctattgtcatctccgaaagtcttccttgacctcttacttcctgcttttccctcgtaagtcagatctcacattataacattttagtctatacttttttattttgtgattatttatttatttatttttgagatggagtgttg

SEQ ID NO: 97580 - DNA, 188 bp, Homo sapiens
  misc_feature 1..188: note = chr7:4056761-4056949
  misc_feature 1..188: note = hypo
  source 1..188: mol_type = genomic DNA
cagttatttccttatcgtgatgggcttccttcgtggcgcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtctt

SEQ ID NO: 97581 - DNA, 159 bp, Homo sapiens
  misc_feature 1..159: note = chr7:40603511-40603670
  misc_feature 1..159: note = hypo
  source 1..159: mol_type = genomic DNA
gtcccccagagatgtcgaggagacaaatacagatatcagtccttaaaagtccacagcacaatgagtgggatatgtatatacagagaaaaaaatatctagaagtaaacataccaaaacgtttcttatctttgggttgttgagttgtaggtgatttatttg

SEQ ID NO: 97582 - DNA, 30 bp, Homo sapiens
  misc_feature 1..30: note = chr7:4066497-4066527
  misc_feature 1..30: note = hypo
  source 1..30: mol_type = genomic DNA
gactctaccaggtaacgaactcaccgctcc

SEQ ID NO: 97583 - DNA, 30 bp, Homo sapiens
  misc_feature 1..30: note = chr7:4070228-4070258
  misc_feature 1..30: note = hypo
  source 1..30: mol_type = genomic DNA
cgggcttttcatacgcgccttggtgctatg

SEQ ID NO: 97584 - DNA, 30 bp, Homo sapiens
  misc_feature 1..30: note = chr7:40938913-40938943
  misc_feature 1..30: note = hypo
  source 1..30: mol_type = genomic DNA
ctttatttacccctccgcctcccattttgg

SEQ ID NO: 97585 - DNA, 46 bp, Homo sapiens
  misc_feature 1..46: note = chr7:40943566-40943612
  misc_feature 1..46: note = hypo
  source 1..46: mol_type = genomic DNA
gcagtactggatggccgctgcccaagcttggcgcagcttacatcac

SEQ ID NO: 97586 - DNA, 179 bp, Homo sapiens; identical to SEQ ID NO: 41023
  misc_feature 1..179: note = chr7:409602-409781
  misc_feature 1..179: note = hypo
  source 1..179: mol_type = genomic DNA

SEQ ID NO: 97587 - DNA, 97 bp, Homo sapiens
  misc_feature 1..97: note = chr7:4096353-4096450
  misc_feature 1..97: note = hypo
  source 1..97: mol_type = genomic DNA
acgctgcaccccacacgcccgagcccagagcagctactatgcagtgctgctcaaagagcccagccccaccagaacattccgccgtgggtcccaccag

SEQ ID NO: 97588 - DNA, 459 bp, Homo sapiens
  misc_feature 1..459: note = chr7:409986-410445
  misc_feature 1..459: note = hypo
  source 1..459: mol_type = genomic DNA
aggaggcctcagcttcggactcagcccaggcctggcctcccgactcccaccaccaggggcctggctgtacctgtgggggctggagccccagggcagacacttcgcagactctgtgcagggccaggtgagccccagggcggagctggcagctgagggtgctccgtggctcggtgcactggccctgactcacgaatgccgcagcgcgtcctacgggaagccatgtcacagcctccgtcctgcagggcaaagggggctgctgcgggcaaagatggccagtgatcttctaggttactgggtgcaggaagcaggaaaaggcccagagacactctcagttcttccagaaagccctgggggatttgactttgaccacagtgcgtgcgtccaggtattacctcattccttggcttttcgctacagacagactgacctggctggccgggttgccgcctcccagtcaca

SEQ ID NO: 97589 - DNA, 30 bp, Homo sapiens
  misc_feature 1..30: note = chr7:41189426-41189456
  misc_feature 1..30: note = hyper
  source 1..30: mol_type = genomic DNA
tgctgggtagggctccggtctccaccctcc

SEQ ID NO: 97590 - DNA, 30 bp, Homo sapiens
  misc_feature 1..30: note = chr7:4119957-4119987
  misc_feature 1..30: note = hypo
  source 1..30: mol_type = genomic DNA
tggcattggtgaagccgtgcaatctgccac

SEQ ID NO: 97591 - DNA, 30 bp, Homo sapiens
  misc_feature 1..30: note = chr7:4139378-4139408
  misc_feature 1..30: note = hypo
  source 1..30: mol_type = genomic DNA
tggggcgtgtgtgagcgggatgtgatggga

SEQ ID NO: 97592 - DNA, 30 bp, Homo sapiens
  misc_feature 1..30: note = chr7:4147449-4147479
  misc_feature 1..30: note = hypo
  source 1..30: mol_type = genomic DNA
ctctgtgctgtggtgcgtgttctccattac

SEQ ID NO: 97593 - DNA, 30 bp, Homo sapiens
  misc_feature 1..30: note = chr7:414915-414945
  misc_feature 1..30: note = hypo
  source 1..30: mol_type = genomic DNA
gtctcacaaagggtacggggtccgtgtcgg

SEQ ID NO: 97594 - DNA, 193 bp, Homo sapiens
  misc_feature 1..193: note = chr7:41699313-41699506
  misc_feature 1..193: note = hypo
  source 1..193: mol_type = genomic DNA
gtctctttcatcccccgtaatatcccattgcaagagtacattaacctaggcaaccggcatagtgtcaatttctttgcttctcttggagggccataactgtcagtggaaattattttagttatgtcagctctgcagaggaaagtacaaaaacaagggagtctaagtccttggagttctacgtttgtctcagtct

SEQ ID NO: 97595 - DNA, 89 bp, Homo sapiens
  misc_feature 1..89: note = chr7:41745163-41745252
  misc_feature 1..89: note = hyper
  source 1..89: mol_type = genomic DNA
gcaaatgtcagggagcgggacctgcggaggggccggctggctccccgcggacagaggcgagccgggagcgctcgcgcaccagccaactg

SEQ ID NO: 97596 - DNA, 96 bp, Homo sapiens
  misc_feature 1..96: note = chr7:41814070-41814166
  misc_feature 1..96: note = hypo
  source 1..96: mol_type = genomic DNA
aatcacaataactttcgcaccaatctaataatatagagtgaccaaaagataaatcccttaaaaataagaaaactgttgggaggccgaggtgggcgg

SEQ ID NO: 97597 - DNA, 160 bp, Homo sapiens
  misc_feature 1..160: note = chr7:4183288-4183448
  misc_feature 1..160: note = hypo
  source 1..160: mol_type = genomic DNA
gtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatc

SEQ ID NO: 97598 - DNA, 30 bp, Homo sapiens
  misc_feature 1..30: note = chr7:41840845-41840875
  misc_feature 1..30: note = hypo
  source 1..30: mol_type = genomic DNA
gaaaagaatgctacccggtacttggctcac

SEQ ID NO: 97599 - DNA, 43 bp, Homo sapiens
  misc_feature 1..43: note = chr7:41850638-41850681
  misc_feature 1..43: note = hypo
  source 1..43: mol_type = genomic DNA
tagccatataaagaacggtaaaagaggccggcctgtaatcctc

SEQ ID NO: 97600 - DNA, 56 bp, Homo sapiens
  misc_feature 1..56: note = chr7:4187810-4187866
  misc_feature 1..56: note = hypo
  source 1..56: mol_type = genomic DNA
cagaacgtgtgcttacggaggcaagtgctgatgaagtgagacgggagccctcctcc

SEQ ID NO: 97601 - DNA, 42 bp, Homo sapiens
  misc_feature 1..42: note = chr7:4189003-4189045
  misc_feature 1..42: note = hypo
  source 1..42: mol_type = genomic DNA
ttcaccatgcaggtgcgagagctgcctcggggtgagtggcag

SEQ ID NO: 97602 - DNA, 30 bp, Homo sapiens; identical to SEQ ID NO: 41280
  misc_feature 1..30: note = chr7:41923780-41923810
  misc_feature 1..30: note = hypo
  source 1..30: mol_type = genomic DNA

SEQ ID NO: 97603 - DNA, 30 bp, Homo sapiens; identical to SEQ ID NO: 41281
  misc_feature 1..30: note = chr7:41943672-41943702
  misc_feature 1..30: note = hypo
  source 1..30: mol_type = genomic DNA

SEQ ID NO: 97604 - DNA, 17 bp, Homo sapiens
  misc_feature 1..17: note = chr7:41981795-41981812
  misc_feature 1..17: note = hypo
  source 1..17: mol_type = genomic DNA
gggcgtggtggctcacg

SEQ ID NO: 97605 - DNA, 159 bp, Homo sapiens
  misc_feature 1..159: note = chr7:42005369-42005528
  misc_feature 1..159: note = hypo
  source 1..159: mol_type = genomic DNA
ttaaatactgcaccacgtcgtccggcaggaaatcctcatcgttcaggttggcatcagcgtccatggtcagggactccagggtgacgttctcggtgatgctgggaggacagggggacgagtggaagtttcgggactggccgccctcgggccgcgtgtaat

SEQ ID NO: 97606 - DNA, 30 bp, Homo sapiens
  misc_feature 1..30: note = chr7:4206325-4206355
  misc_feature 1..30: note = hypo
  source 1..30: mol_type = genomic DNA
cggcccgggggaccacggtggccggatcag

SEQ ID NO: 97607 - DNA, 30 bp, Homo sapiens
  misc_feature 1..30: note = chr7:4211243-4211273
  misc_feature 1..30: note = hypo
  source 1..30: mol_type = genomic DNA
aggctggagcagagccggcaccaaggtccc

SEQ ID NO: 97608 - DNA, 172 bp, Homo sapiens
  misc_feature 1..172: note = chr7:4214921-4215093
  misc_feature 1..172: note = hypo
  source 1..172: mol_type = genomic DNA
ctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggag

SEQ ID NO: 97609 - DNA, 50 bp, Homo sapiens
  misc_feature 1..50: note = chr7:4215324-4215374
  misc_feature 1..50: note = hypo
  source 1..50: mol_type = genomic DNA
ctcccttgttcctgccgcacatcacctgcgatggccgtgtccctgcgtgc

SEQ ID NO: 97610 - DNA, 104 bp, Homo sapiens
  misc_feature 1..104: note = chr7:42267608-42267712
  misc_feature 1..104: note = hyper
  source 1..104: mol_type = genomic DNA
aagggatgtttttcacgcctttcaccacttttgcccgcgcctgcgtcccctgcccgaggtcccaggccgcggcggcggcgcggtgggttcattagcgggcgcgc

SEQ ID NO: 97611 - skipped

SEQ ID NO: 97612 - DNA, 1287 bp, Homo sapiens
  misc_feature 1..1287: note = chr7:42275617-42276904
  misc_feature 1..1287: note = hyper
  source 1..1287: mol_type = genomic DNA
aagcctggggtgcagcgcctctcgggggacggcatcttacagaaggaggtgcaatgggggacaggagcacaaagttcaggaaaggataaaaggccgggtgcggggtggagcgtccgcttcggacaatctgcttaaaagtcgcttcacaaactctgcaagtttgggatcaatatttacaccctctctgccttctcccgcccgttttcccgctgctactcaagaaagtaactgtcccctgctgctctgtgtaaacgcggcaccttaaatgattattgcatggaccacggttactttgtgtgtctgtgcgcgctgcccctggaaaggaaaagaaataagagaatcccaaatcatatacagatggtacaactttcacttttcctctatgacgacgaaggcgcgcctctctccatccgctcacaccacacccccgccctccgaagcatagcccgggctggagaagccccagcggcggcggcccccgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcccttctgact

SEQ ID NO: 97613 - DNA, 276 bp, Homo sapiens
  misc_feature 1..276: note = chr7:42277312-42277588
  misc_feature 1..276: note = hyper
  source 1..276: mol_type = genomic DNA
cgctgagcagcaggacgcctgccgccgcagggggcgaagttgggaaaacttggagtgctgctcgccttacttttgctttctcgctccttccaggccgcgccgggagcccccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgctccctccccgccctccgccgccgccgc

SEQ ID NO: 97614 - DNA, 215 bp, Homo sapiens
  misc_feature 1..215: note = chr7:42277648-42277863
  misc_feature 1..215: note = hyper
  source 1..215: mol_type = genomic DNA
ccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccccaaatgcgcgccctggcactcgtgctgcgtcctgtctgctcc

SEQ ID NO: 97615 - DNA, 30 bp, Homo sapiens
  misc_feature 1..30: note = chr7:4251136-4251166
  misc_feature 1..30: note = hypo
  source 1..30: mol_type = genomic DNA
gaggaatgggggttgcgggcaggtggctct

SEQ ID NO: 97616 - DNA, 43 bp, Homo sapiens
  misc_feature 1..43: note = chr7:42533038-42533081
  misc_feature 1..43: note = hyper
  source 1..43: mol_type = genomic DNA
gacagcaggagcagccggattttggaaagggaggaggccggga

SEQ ID NO: 97617 - DNA, 172 bp, Homo sapiens
  misc_feature 1..172: note = chr7:42533256-42533428
  misc_feature 1..172: note = hyper
  source 1..172: mol_type = genomic DNA
cggttgctctgccgggctgcgggggcggtgccctggaaggaggggctgtgcatctgcaccatttctaggaatgtccgccctctgggaacccagccctgaagtgctctgagaatgagccgtgtttacggaaagcctctgtctcatgctccgcattctccgttctgattctgac

SEQ ID NO: 97618 - DNA, 30 bp, Homo sapiens; identical to SEQ ID NO: 41152
  misc_feature 1..30: note = chr7:4260867-4260897
  misc_feature 1..30: note = hypo
  source 1..30: mol_type = genomic DNA

SEQ ID NO: 97619 - DNA, 30 bp, Homo sapiens
  misc_feature 1..30: note = chr7:4265593-4265623
  misc_feature 1..30: note = hypo
  source 1..30: mol_type = genomic DNA
catgggaagttgagacgccccctcccttca

SEQ ID NO: 97620 - DNA, 55 bp, Homo sapiens
  misc_feature 1..55: note = chr7:4275488-4275543
  misc_feature 1..55: note = hypo
  source 1..55: mol_type = genomic DNA
cagggtgtcctgccccgtatgagagtcctccaggacagcccggccttcctttcct

SEQ ID NO: 97621 - DNA, 30 bp, Homo sapiens
  misc_feature 1..30: note = chr7:4287245-4287275
  misc_feature 1..30: note = hypo
  source 1..30: mol_type = genomic DNA
gggccgctgctctttcgagtatccaggcac

SEQ ID NO: 97622 - DNA, 26 bp, Homo sapiens
  misc_feature 1..26: note = chr7:42909823-42909849
  misc_feature 1..26: note = hypo
  source 1..26: mol_type = genomic DNA
actgggagtaatggccgggcgcggtg

SEQ ID NO: 97623 - DNA, 385 bp, Homo sapiens
  misc_feature 1..385: note = chr7:42927790-42928175
  misc_feature 1..385: note = hyper
  source 1..385: mol_type = genomic DNA
aatccctgagtgtgacgccgccccaaagggccccaagcaggtagatcccatgctgatgctcttttatcctggcctctcagctgttgaggagagtaattgccgggctaaactgataaagtttcattccaaacaattagcctagtctgcaggattgcagtcgcggcttggacaccatcccggtgtctgtcccccgcagagggcttgctaccttgctgtatcagctggcccagcaggtctggggccgcgcgctgcttacaggcgctggatctcgctgctcgtcgctgcgcgctactaggtcctgctgtcgtccgagtcgcctccgggactctccggaattgtagcggctgtagccggctccttgcctgcggcgcggagggcaggtccc

SEQ ID NO: 97624 - DNA, 92 bp, Homo sapiens
  misc_feature 1..92: note = chr7:4299734-4299826
  misc_feature 1..92: note = hypo
  source 1..92: mol_type = genomic DNA
ggaagatgtgttcatcgtcacctgatggagaagctggctgctccggggtctctgtgtgtgtgggaagatgtgttcatcgtcacctgatggag

SEQ ID NO: 97625 - DNA, 132 bp, Homo sapiens
  misc_feature 1..132: note = chr7:430257-430389
  misc_feature 1..132: note = hypo
  source 1..132: mol_type = genomic DNA
aagggagacacaaggcggaaggcgtgagggcaggagggtgggaggaaggggaatagcgggcagatgggaggatgaaatcacagcagggtggggccaggtggccagggagggcctggccgggaggcaacagtc

SEQ ID NO: 97626 - DNA, 30 bp, Homo sapiens
  misc_feature 1..30: note = chr7:4308164-4308194
  misc_feature 1..30: note = hypo
  source 1..30: mol_type = genomic DNA
gcgcctccacagccccgggaggtggctcac

SEQ ID NO: 97627 - DNA, 397 bp, Homo sapiens
  misc_feature 1..397: note = chr7:431386-431783
  misc_feature 1..397: note = hypo
  source 1..397: mol_type = genomic DNA
tgtgggctccactcccgggctcacccaggccagctctggatgctgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctgagctggcagccctgagcctgagaccagggctctgactcacttctgggccgccctcctcacaga

SEQ ID NO: 97628 - DNA, 238 bp, Homo sapiens; identical to SEQ ID NO: 31255
  misc_feature 1..238: note = chr7:43151970-43152208
  misc_feature 1..238: note = hyper
  source 1..238: mol_type = genomic DNA

SEQ ID NO: 97629 - DNA, 787 bp, Homo sapiens
  misc_feature 1..787: note = chr7:43152413-43153200
  misc_feature 1..787: note = hyper
  source 1..787: mol_type = genomic DNA
cgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcccagcccacacccaccccttgtgaaccaaagctctggatttgcgcttcgccttgggctcgcttttgaacaattgtgtcccatgcaatgcccgtggttagcccagagagcgcccagagcctccgcacgggctcgccggtgctcgctcgaggggcgcgtggccaggtccggcccttgctcccatggacgggtgcaggaggggaggaggcgctgtgtgggtgctcccccagcgcctccctgttaccggccggctgcgccgctcagccgggcctgccacctgagttttag

SEQ ID NO: 97630 - DNA, 355 bp, Homo sapiens
  misc_feature 1..355: note = chr7:43153229-43153584
  misc_feature 1..355: note = hyper
  source 1..355: mol_type = genomic DNA
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggtt

SEQ ID NO: 97631 - DNA, 177 bp, Homo sapiens; identical to SEQ ID NO: 41284
  misc_feature 1..177: note = chr7:43237814-43237991
  misc_feature 1..177: note = hypo
  source 1..177: mol_type = genomic DNA

SEQ ID NO: 97632 - DNA, 285 bp, Homo sapiens
  misc_feature 1..285: note = chr7:43279396-43279681
  misc_feature 1..285: note = hypo
  source 1..285: mol_type = genomic DNA
ttcttagctgtgatgcgctcttacagccccagacctgtagggacatgtccctcccagaaggcggcacactggctgggcctctctcaaaccaccccataaaaaagagaaccttacccgaaccaggacttctggctttcttctagggtggggttctgagtgacctttcatcatattgtttgtcgtccgtatggcttggcttttcaaaagcaaatgtactttgtttctataattaggaaaaaaagttttttttaaatgtcatcttttgccaggcacggtggctcacgc

SEQ ID NO: 97633 - DNA, 30 bp, Homo sapiens
  misc_feature 1..30: note = chr7:43282402-43282432
  misc_feature 1..30: note = hypo
  source 1..30: mol_type = genomic DNA
ggctgtggcagggagcgggaaggagcaagg

SEQ ID NO: 97634 - DNA, 30 bp, Homo sapiens
  misc_feature 1..30: note = chr7:43304457-43304487
  misc_feature 1..30: note = hypo
  source 1..30: mol_type = genomic DNA
aaaaattgctattgtcgagaaatagttctt

SEQ ID NO: 97635 - DNA, 69 bp, Homo sapiens
  misc_feature 1..69: note = chr7:43351483-43351552
  misc_feature 1..69: note = hypo
  source 1..69: mol_type = genomic DNA
catggacctcaggggcggcccccacgatggcgtcaccattccccgctccaccagcgacactgacctggt

SEQ ID NO: 97636 - DNA, 88 bp, Homo sapiens
  misc_feature 1..88: note = chr7:4342694-4342782
  misc_feature 1..88: note = hypo
  source 1..88: mol_type = genomic DNA
caacccactgtgtctctgctcttctgtgcaaacaatcccagcaccaggaaggagccagccctgccccccgctgcggccctctccatgg

SEQ ID NO: 97637 - DNA, 30 bp, Homo sapiens
  misc_feature 1..30: note = chr7:4345969-4345999
  misc_feature 1..30: note = hypo
  source 1..30: mol_type = genomic DNA
gaaaaaaagaaataccggaggtgaaccaca

SEQ ID NO: 97638 - DNA, 30 bp, Homo sapiens
  misc_feature 1..30: note = chr7:43656702-43656732
  misc_feature 1..30: note = hypo
  source 1..30: mol_type = genomic DNA
gactggaaagtgtcccgtgggacccagctt

SEQ ID NO: 97639 - DNA, 153 bp, Homo sapiens
  misc_feature 1..153: note = chr7:43767840-43767993
  misc_feature 1..153: note = hypo
  source 1..153: mol_type = genomic DNA
gggattacaggcgtgaggcaccgctacgttttaaatggtgaactctacggtaggtgaactatgtgtcaggaagctgttttatttttttaaaggactgaagacttttgttttgtgttttgttttgttttcattttatcccgtttttaaaacagt

SEQ ID NO: 97640 - DNA, 202 bp, Homo sapiens; identical to SEQ ID NO: 41286
  misc_feature 1..202: note = chr7:43865061-43865263
  misc_feature 1..202: note = hypo
  source 1..202: mol_type = genomic DNA

SEQ ID NO: 97641 - DNA, 25 bp, Homo sapiens
  misc_feature 1..25: note = chr7:44083435-44083460
  misc_feature 1..25: note = hypo
  source 1..25: mol_type = genomic DNA
ccaccgtgcccggcaggatttatat

SEQ ID NO: 97642 - DNA, 43 bp, Homo sapiens
  misc_feature 1..43: note = chr7:44097753-44097796
  misc_feature 1..43: note = hypo
  source 1..43: mol_type = genomic DNA
ggaaaagcggcgggccgaggaggcacagcggcagctggagcag

SEQ ID NO: 97643 - DNA, 51 bp, Homo sapiens
  misc_feature 1..51: note = chr7:44143891-44143942
  misc_feature 1..51: note = hyper
  source 1..51: mol_type = genomic DNA
ccgggggtggggagccggctccggaagccccggcgcccccgccccgggccc

SEQ ID NO: 97644 - DNA, 495 bp, Homo sapiens
  misc_feature 1..495: note = chr7:44144029-44144524
  misc_feature 1..495: note = hyper
  source 1..495: mol_type = genomic DNA
cgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagag

SEQ ID NO: 97645 - DNA, 41 bp, Homo sapiens
  misc_feature 1..41: note = chr7:44149886-44149927
  misc_feature 1..41: note = hypo
  source 1..41: mol_type = genomic DNA
accaggaggactacccggttcacaggcgtcatcacccaggg

SEQ ID NO: 97646 - DNA, 71 bp, Homo sapiens
  misc_feature 1..71: note = chr7:44151000-44151071
  misc_feature 1..71: note = hypo
  source 1..71: mol_type = genomic DNA
gtcatgcccgtccctcgccatagagcaggccctggaagtggaaggggcatggtcagcgggggacggattgc

SEQ ID NO: 97647 - DNA, 501 bp, Homo sapiens
  misc_feature 1..501: note = chr7:44151276-44151777
  misc_feature 1..501: note = hypo
  source 1..501: mol_type = genomic DNA
gagctcactgcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgctggctccccacagggctcagagtttgggaactgggcgctgggactgtgga

SEQ ID NO: 97648 - DNA, 96 bp, Homo sapiens
  misc_feature 1..96: note = chr7:44152156-44152252
  misc_feature 1..96: note = hypo
  source 1..96: mol_type = genomic DNA
gtatccacggaggtccgggccatcattgcctggatggagaagaaccccttcgtgctgggagcaaatctgaacggcggcgagcggctagtatcctac

SEQ ID NO: 97649 - DNA, 194 bp, Homo sapiens
  misc_feature 1..194: note = chr7:44153428-44153622
  misc_feature 1..194: note = hypo
  source 1..194: mol_type = genomic DNA
cgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggagga

SEQ ID NO: 97650 - DNA, 35 bp, Homo sapiens
  misc_feature 1..35: note = chr7:44164101-44164136
  misc_feature 1..35: note = hypo
  source 1..35: mol_type = genomic DNA
gtttgtttgaggcagcgtcttgctctgtggcccag

SEQ ID NO: 97651 - DNA, 30 bp, Homo sapiens; identical to SEQ ID NO: 41290
  misc_feature 1..30: note = chr7:44193301-44193331
  misc_feature 1..30: note = hypo
  source 1..30: mol_type = genomic DNA

SEQ ID NO: 97652 - DNA, 189 bp, Homo sapiens
  misc_feature 1..189: note = chr7:44258465-44258654
  misc_feature 1..189: note = hypo
  source 1..189: mol_type = genomic DNA
ggtgtgtggggataccgggcacggaaaacccacacctagcccttcaggggatgaaaggaagggaagggaaagcaggaacaacagcaactctcaggcacaactagcgggaaaggaggcagcccagcgggcccccacagcccctcccaagagacagctgacagtcacgacagccagcgagcacaccacgtg

SEQ ID NO: 97653 - DNA, 53 bp, Homo sapiens; identical to SEQ ID NO: 41292
  misc_feature 1..53: note = chr7:44259286-44259339
  misc_feature 1..53: note = hypo
  source 1..53: mol_type = genomic DNA

SEQ ID NO: 97654 - DNA, 30 bp, Homo sapiens; identical to SEQ ID NO: 41293
  misc_feature 1..30: note = chr7:44275594-44275624
  misc_feature 1..30: note = hypo
  source 1..30: mol_type = genomic DNA

SEQ ID NO: 97655 - DNA, 30 bp, Homo sapiens
  misc_feature 1..30: note = chr7:44279543-44279573
  misc_feature 1..30: note = hypo
  source 1..30: mol_type = genomic DNA
tagtgttggtgtgaccgtgtgcacgcgttc

SEQ ID NO: 97656 - DNA, 30 bp, Homo sapiens
  misc_feature 1..30: note = chr7:44298773-44298803
  misc_feature 1..30: note = hypo
  source 1..30: mol_type = genomic DNA
cagtgcctcaccctccgctgccagtctggt

SEQ ID NO: 97657 - DNA, 205 bp, Homo sapiens
  misc_feature 1..205: note = chr7:44304621-44304826
  misc_feature 1..205: note = hypo
  source 1..205: mol_type = genomic DNA
tctcagggtgcaggacggtgagttcacggggttattgttttctttcctagtatctttcttaaactgattgtgaacatttttcagacttagagaaaaactgcaacaacagtacagagcaatcgtgtacagcacttctgtacaatctccctgccccgcccctgcttccatataacacactcgcttcttctgacgcgtgtgtaacacc

SEQ ID NO: 97658 - DNA, 30 bp, Homo sapiens
  misc_feature 1..30: note = chr7:44307247-44307277
  misc_feature 1..30: note = hypo
  source 1..30: mol_type = genomic DNA
ggtggctaagagagacgctggcaaaagcat

SEQ ID NO: 97659 - DNA, 47 bp, Homo sapiens
  misc_feature 1..47: note = chr7:44307677-44307724
  misc_feature 1..47: note = hypo
  source 1..47: mol_type = genomic DNA
agaagcacccccagccgagccctgcacagccacgctgagctcatctt

SEQ ID NO: 97660 - DNA, 48 bp, Homo sapiens
  misc_feature 1..48: note = chr7:44349559-44349607
  misc_feature 1..48: note = hyper
  source 1..48: mol_type = genomic DNA
ctcgcgaaggacacgcgggaagagcctttccgccggctgagccgtggg

SEQ ID NO: 97661 - DNA, 74 bp, Homo sapiens
  misc_feature 1..74: note = chr7:44349655-44349729
  misc_feature 1..74: note = hyper
  source 1..74: mol_type = genomic DNA
cggtggccgagaccgggcgggggcgggggcgctttgggagttaggatacgctttgtgcccgcttgctgcttttt

SEQ ID NO: 97662 - DNA, 194 bp, Homo sapiens; identical to SEQ ID NO: 31262
  misc_feature 1..194: note = chr7:44364485-44364679
  misc_feature 1..194: note = hyper
  source 1..194: mol_type = genomic DNA

SEQ ID NO: 97663 - DNA, 384 bp, Homo sapiens; identical to SEQ ID NO: 31263
  misc_feature 1..384: note = chr7:44364698-44365082
  misc_feature 1..384: note = hyper
  source 1..384: mol_type = genomic DNA

SEQ ID NO: 97664 - DNA, 141 bp, Homo sapiens
  misc_feature 1..141: note = chr7:44365117-44365258
  misc_feature 1..141: note = hyper
  source 1..141: mol_type = genomic DNA
cgggagacacctcggctcgcggcgccaggcgggggccgggctgggctgcgccgggcggcgagcgcacgcgagatctgctcgctccgtcctcgccaggagcgcgccgcacacctacgcgcggggaggcgcgggcgccgctgt

SEQ ID NO: 97665 - DNA, 40 bp, Homo sapiens
  misc_feature 1..40: note = chr7:44430994-44431034
  misc_feature 1..40: note = hypo
  source 1..40: mol_type = genomic DNA
tacgatgtattaatacgtgctgtaccggaaggtaagacta

SEQ ID NO: 97666 - DNA, 37 bp, Homo sapiens
  misc_feature 1..37: note = chr7:44517855-44517892
  misc_feature 1..37: note = hypo
  source 1..37: mol_type = genomic DNA
ttatttactttgggccgggcgcggtggctcacgcctg

SEQ ID NO: 97667 - DNA, 59 bp, Homo sapiens
  misc_feature 1..59: note = chr7:44582470-44582529
  misc_feature 1..59: note = hypo
  source 1..59: mol_type = genomic DNA
ggccttaggcagggccgtgggcacttgcgacaagaagacactgtcggcatgcacagagc

SEQ ID NO: 97668 - DNA, 83 bp, Homo sapiens
  misc_feature 1..83: note = chr7:4463665-4463748
  misc_feature 1..83: note = hypo
  source 1..83: mol_type = genomic DNA
tcctctgacaccagccgattaccaagcaattgatgtgcttgctgcccaatgtgcacagaggccaataccatggcaccagcttt

SEQ ID NO: 97669 - DNA, 30 bp, Homo sapiens; identical to SEQ ID NO: 41296
  misc_feature 1..30: note = chr7:44717883-44717913
  misc_feature 1..30: note = hypo
  source 1..30: mol_type = genomic DNA

SEQ ID NO: 97670 - DNA, 30 bp, Homo sapiens
  misc_feature 1..30: note = chr7:44746915-44746945
  misc_feature 1..30: note = hypo
  source 1..30: mol_type = genomic DNA
tattatgacctcacccgggagcgcaaagca

SEQ ID NO: 97671 - DNA, 30 bp, Homo sapiens
  misc_feature 1..30: note = chr7:44796802-44796832
  misc_feature 1..30: note = hypo
  source 1..30: mol_type = genomic DNA
acctcagaactgtggcgctgatcagctgga

SEQ ID NO: 97672 - DNA, 30 bp, Homo sapiens
  misc_feature 1..30: note = chr7:4479737-4479767
  misc_feature 1..30: note = hypo
  source 1..30: mol_type = genomic DNA
caatacgtctctattcgtttgcatttgtat

SEQ ID NO: 97673 - DNA, 30 bp, Homo sapiens; identical to SEQ ID NO: 41297
  misc_feature 1..30: note = chr7:44801185-44801215
  misc_feature 1..30: note = hypo
  source 1..30: mol_type = genomic DNA

SEQ ID NO: 97674 - DNA, 277 bp, Homo sapiens
  misc_feature 1..277: note = chr7:44835107-44835384
  misc_feature 1..277: note = hypo
  source 1..277: mol_type = genomic DNA
ggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtg

SEQ ID NO: 97675 - DNA, 42 bp, Homo sapiens
  misc_feature 1..42: note = chr7:44896731-44896773
  misc_feature 1..42: note = hyper
  source 1..42: mol_type = genomic DNA
tggaaagactgaaggcgccctccagtccgctttctgtttctc

SEQ ID NO: 97676 - DNA, 216 bp, Homo sapiens
  misc_feature 1..216: note = chr7:44924253-44924469
  misc_feature 1..216: note = hyper
  source 1..216: mol_type = genomic DNA
agcgcttggagtccacggtgatggaggtgccctccgggagctctccatacaggccgccccctgggcccccggcgccgcctcccgggccgcctgccagctcgtcgtcctcgcctccgtagtcgtctatgagcttcgccagcgcgtcgcggaactcgatgaggccctgcgcaggcagcgcgatggtctggccgctctgcaagccgcccggcccggggc

SEQ ID NO: 97677 - DNA, 40 bp, Homo sapiens
  misc_feature 1..40: note = chr7:44967575-44967615
  misc_feature 1..40: note = hypo
  source 1..40: mol_type = genomic DNA
aatagtcactgtatgcggccgggcgcggtggctcacgcct

SEQ ID NO: 97678 - DNA, 30 bp, Homo sapiens
  misc_feature 1..30: note = chr7:45005732-45005762
  misc_feature 1..30: note = hypo
  source 1..30: mol_type = genomic DNA
agtgtccggggtgagcggatgaacagcttg

SEQ ID NO: 97679 - DNA, 27 bp, Homo sapiens
  misc_feature 1..27: note = chr7:45027184-45027211
  misc_feature 1..27: note = hypo
  source 1..27: mol_type = genomic DNA
attgttaagggacgaaagggccaagag

SEQ ID NO: 97680 - DNA, 34 bp, Homo sapiens
  misc_feature 1..34: note = chr7:45038532-45038566
  misc_feature 1..34: note = hypo
  source 1..34: mol_type = genomic DNA
aaagaattattaggccgggcgcggtggctcacgc

SEQ ID NO: 97681 - DNA, 109 bp, Homo sapiens
  misc_feature 1..109: note = chr7:450465-450574
  misc_feature 1..109: note = hypo
  source 1..109: mol_type = genomic DNA
agggaaaggacaagccgggtcacgcggggtgtgacttctgcaggggcagccgcacaccccaggacagggcatcatgtatggagacgcggacctgcggcaggtggcaggg

SEQ ID NO: 97682 - DNA, 34 bp, Homo sapiens; identical to SEQ ID NO: 41301
  misc_feature 1..34: note = chr7:45125675-45125709
  misc_feature 1..34: note = hypo
  source 1..34: mol_type = genomic DNA

SEQ ID NO: 97683 - DNA, 680 bp, Homo sapiens
  misc_feature 1..680: note = chr7:45128453-45129133
  misc_feature 1..680: note = hyper
  source 1..680: mol_type = genomic DNA
cgggcagcagcagctcggcgcgggcagcctccccaggcatggcctggccgtgcgcccgcccgtccctcagtccttccgaccctccgtcagtccgtgccgccgccccgccgagcctgcgcggccaccgcccctcggccgggcggtgggggcagtgggtgacgtcaggccgccccgcccgcctgtcccagcgagtgagcgtgcgcgggctcgccaggcactgcggagggcgtagggggggctccctccccgcccccaccccacccggctgtggcctccctctcgctgtgggcggtttcgtgggggagcgggggtgggcgcctgcgcccggtcccaccctttccacagcatttacgagggagggtttcagggccaattggaagctgggttgcctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctcca

SEQ ID NO: 97684 - DNA, 37 bp, Homo sapiens
  misc_feature 1..37: note = chr7:45197017-45197054
  misc_feature 1..37: note = hyper
  source 1..37: mol_type = genomic DNA
tgcatcccagcccaccgtcagccggcccccacgctca

SEQ ID NO: 97685 - DNA, 214 bp, Homo sapiens
  misc_feature 1..214: note = chr7:45197376-45197590
  misc_feature 1..214: note = hyper
  source 1..214: mol_type = genomic DNA
cagccgcgcccccagcgggaccgagcgtgacccagctgcggccggccagccatggagactggagcgctgcggcgcccgcaacttctcccgttgctgctgctgctctgcggtaagggggcgacggcccgcaccgggggcgcccccactcctcggggttcaccggacccgggtggacccgcgccttcccgcacctgcgccgcggtccttcccttgc

SEQ ID NO: 97686 - DNA, 108 bp, Homo sapiens
  misc_feature 1..108: note = chr7:45222863-45222971
  misc_feature 1..108: note = hypo
  source 1..108: mol_type = genomic DNA
cttctccaactgcaccgtggacagggtccacttggaggaccccccagacgaggttctcatcccgctgatcgttatacccgtcgttctgactgtcgccatggctggcct

SEQ ID NO: 97687 - DNA, 45 bp, Homo sapiens
  misc_feature 1..45: note = chr7:45293665-45293710
  misc_feature 1..45: note = hypo
  source 1..45: mol_type = genomic DNA
cctgggattacaggcgtgagccaccgcgcccggtcttccctaagt

SEQ ID NO: 97688 - DNA, 30 bp, Homo sapiens
  misc_feature 1..30: note = chr7:453753-453783
  misc_feature 1..30: note = hypo
  source 1..30: mol_type = genomic DNA
cgaagcctcagtggtcgggcctttcctgac

SEQ ID NO: 97689 - DNA, 392 bp, Homo sapiens
  misc_feature 1..392: note = chr7:45613422-45613814
  misc_feature 1..392: note = hyper
  source 1..392: mol_type = genomic DNA
cgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 97690 - DNA, 1102 bp, Homo sapiens
  misc_feature 1..1102: note = chr7:45613857-45614959
  misc_feature 1..1102: note = hyper
  source 1..1102: mol_type = genomic DNA
cgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccct

SEQ ID NO: 97691 - DNA, 30 bp, Homo sapiens
  misc_feature 1..30: note = chr7:45615610-45615640
  misc_feature 1..30: note = hyper
  source 1..30: mol_type = genomic DNA
ccatctccaacgggccgcagggatggggct

SEQ ID NO: 97692 - DNA, 30 bp, Homo sapiens
  misc_feature 1..30: note = chr7:45717349-45717379
  misc_feature 1..30: note = hypo
  source 1..30: mol_type = genomic DNA
tcagattcccaaacccgaccccaccctgca

SEQ ID NO: 97693 - DNA, 30 bp, Homo sapiens
  misc_feature 1..30: note = chr7:45807201-45807231
  misc_feature 1..30: note = hypo
  source 1..30: mol_type = genomic DNA
gtgtaaagccaggcacgatggctcattcct

SEQ ID NO: 97694 - DNA, 30 bp, Homo sapiens
  misc_feature 1..30: note = chr7:45807471-45807501
  misc_feature 1..30: note = hypo
  source 1..30: mol_type = genomic DNA
aggggcgtgagccaccgggcctggcccaat

SEQ ID NO: 97695 - DNA, 33 bp, Homo sapiens
  misc_feature 1..33: note = chr7:45928114-45928147
  misc_feature 1..33: note = hyper
  source 1..33: mol_type = genomic DNA
catctgccgccgcgccgccgccaccctcccaga

SEQ ID NO: 97696 - DNA, 243 bp, Homo sapiens
  misc_feature 1..243: note = chr7:45928349-45928592
  misc_feature 1..243: note = hyper
  source 1..243: mol_type = genomic DNA
ctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctcccca

SEQ ID NO: 97697 - DNA, 1583 bp, Homo sapiens
  misc_feature 1..1583: note = chr7:45959968-45961551
  misc_feature 1..1583: note = hyper
  source 1..1583: mol_type = genomic DNA
cctgggattgcagtccgtgtgcacccccgtgcggggcgaggagaatctcctgtgtccaggatctttccaacagctaaacatcggtaccgctcccctcagctccggaaacctttaacccattttcactgaaagcgctttgcaatttacaagtactctgcacttagagaatcgagcaagtagagggccggctggggagggtccctccggcgaccgccttcacctttcccggagcgccttcagtttccccacatattatctccagtgagaagaaaagcggagtctcccgcagcggcacccagcaacccccaggcccttcggcgccagtgcgccgggtgctgcacgcagcgcacctggcgcgggcggctcacctggagctggcggcgctggcagcaggtaggcgcgcaggcggctgacggcactagcgttgacgcagagcccgcggccgtccagcagcgcctgcagcggtcgcgcctcgtcgggcgacggctggcagcgaaggccggagccacagcgctcggtgtagatgccgcacggctggccctcgctcagtgcgcacgtcaggcagcagccgcagcccggctcgcgcaccagctccgcgcacacggcgggcggaggcgcgcactgggccagtgcacgcgcgtcgcacggctcgcagcgcaccacgggacccaagcccgccgagctcgcgccagcccgcgccaccggcggcccgcggagcagcaccagcagagtcagcgcagcggcccagagcgtgggtcgcgcccgctgcatgacgcctgcaaccggggcacgctgcttggcaggctgggcgcgcagggatggggcgacagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaaccaaggtgtgcccggccaccccggcactccaggccacctcagcacccccggtcaccccagtcactcctggccaactcagcacccccgatctccttgaccccgccgcccttaccccttccgctctcggggtgaggtctccctgcggcgagccggtgtcggggaaactggcatacagcgctccgcattcgtgtgtacctcgtggagctttctaaaatttaattccgttggcaggcgaagtcttgggacatttctgacttacatttgggtctcagggagccaaggcactgcggggtttaatttacacccgctgggctgtttatatccccaggggcccacaaatacgcatctgaagatgcgcccggggccttcgcccctttccaggcttacttctcaacgcaagaagactctcacgtgttgctacaccgcaagtctccaatt

SEQ ID NO: 97698 - DNA, 218 bp, Homo sapiens
  misc_feature 1..218: note = chr7:45961756-45961974
  misc_feature 1..218: note = hyper
  source 1..218: mol_type = genomic DNA
gtcattttttgaaggcgacttcgtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagaggacgctggtggtccagg

SEQ ID NO: 97699 - DNA, 30 bp, Homo sapiens
  misc_feature 1..30: note = chr7:466547-466577
  misc_feature 1..30: note = hypo
  source 1..30: mol_type = genomic DNA
tgtgctgggtgcaggcggcacagcagagtt

SEQ ID NO: 97700 - DNA, 37 bp, Homo sapiens
  misc_feature 1..37: note = chr7:471149-471186
  misc_feature 1..37: note = hypo
  source 1..37: mol_type = genomic DNA
gtgtctgtctgaggtcgggtcacgtgggtgtcaccgc

SEQ ID NO: 97701 - DNA, 53 bp, Homo sapiens
  misc_feature 1..53: note = chr7:472685-472738
  misc_feature 1..53: note = hypo
  source 1..53: mol_type = genomic DNA
agcaagaggggtcctcggacgtgatgagctccctgtcacgggaggtaagcaag

SEQ ID NO: 97702 - DNA, 241 bp, Homo sapiens
  misc_feature 1..241: note = chr7:47394691-47394932
  misc_feature 1..241: note = hypo
  source 1..241: mol_type = genomic DNA
cacgggtggagccggcgtcaaggacagataaggaaacgtgctgagggctgcccagccagcaagttgcgcagggtcacctgagactccgccacgcccagcgggatctgggattcaccacagggtgcaaaaggacaccgagcctgcgaggcaggaggacgctcagtcattccggccccacaggaggagctggggatggtggggcctcagccccaggtgcatcctatgacgtaccttatccaaa

SEQ ID NO: 97703 - DNA, 45 bp, Homo sapiens
  misc_feature 1..45: note = chr7:47409164-47409209
  misc_feature 1..45: note = hypo
  source 1..45: mol_type = genomic DNA
tcttcctcaccttcgcgtaaaggctgccatcgacagggccctgcg

SEQ ID NO: 97704 - DNA, 203 bp, Homo sapiens; identical to SEQ ID NO: 41306
  misc_feature 1..203: note = chr7:47420119-47420322
  misc_feature 1..203: note = hypo
  source 1..203: mol_type = genomic DNA

SEQ ID NO: 97705 - DNA, 142 bp, Homo sapiens; identical to SEQ ID NO: 41307
  misc_feature 1..142: note = chr7:47420382-47420524
  misc_feature 1..142: note = hypo
  source 1..142: mol_type = genomic DNA

SEQ ID NO: 97706 - DNA, 30 bp, Homo sapiens
  misc_feature 1..30: note = chr7:47446763-47446793
  misc_feature 1..30: note = hypo
  source 1..30: mol_type = genomic DNA
caaaagatgcactcccgactctgatgggag

SEQ ID NO: 97707 - DNA, 30 bp, Homo sapiens; identical to SEQ ID NO: 41308
  misc_feature 1..30: note = chr7:47449194-47449224
  misc_feature 1..30: note = hypo
  source 1..30: mol_type = genomic DNA

SEQ ID NO: 97708 - DNA, 121 bp, Homo sapiens
  misc_feature 1..121: note = chr7:47513123-47513244
  misc_feature 1..121: note = hypo
  source 1..121: mol_type = genomic DNA
tgtggtgtatagacccgtgtctgtgtttctgaagtttactgaggggtggaaacaatctataagcaggaaataaccactgtccagtcaaatacctggacttatgggccgtgaggacaagaaa

SEQ ID NO: 97709 - DNA, 181 bp, Homo sapiens
  misc_feature 1..181: note = chr7:4751426-4751607
  misc_feature 1..181: note = hypo
  source 1..181: mol_type = genomic DNA
accgtagagaagcaacgcaaggtcagagagaaaagattgcggccggccggtgtcaaggcgggggacctgtgagctgggcctggagctgaggcagaacttgatggactatgactcaaggttgagatggggcagggactccgggggaggggcagagggcaggtgccgccgagcaggagggagg

SEQ ID NO: 97710 - DNA, 30 bp, Homo sapiens
  misc_feature 1..30: note = chr7:47515683-47515713
  misc_feature 1..30: note = hypo
  source 1..30: mol_type = genomic DNA
cttccccacacatcacgtgtcttccctgtg

SEQ ID NO: 97711 - DNA, 61 bp, Homo sapiens; identical to SEQ ID NO: 41309
  misc_feature 1..61: note = chr7:47586473-47586534
  misc_feature 1..61: note = hypo
  source 1..61: mol_type = genomic DNA

SEQ ID NO: 97712 - DNA, 119 bp, Homo sapiens
  misc_feature 1..119: note = chr7:476416-476535
  misc_feature 1..119: note = hypo
  source 1..119: mol_type = genomic DNA
cccggcacaggcatccgagggccaaggctgcaggaaccgtctctgctggtcacgtctggagtgtgaggccctggaggcccccgtgcacgtccgtgcgatgatgccgcccacaaccaccg

SEQ ID NO: 97713 - DNA, 30 bp, Homo sapiens; identical to SEQ ID NO: 41310
  misc_feature 1..30: note = chr7:47702782-47702812
  misc_feature 1..30: note = hypo
  source 1..30: mol_type = genomic DNA

SEQ ID NO: 97714 - DNA, 150 bp, Homo sapiens
  misc_feature 1..150: note = chr7:4771565-4771715
  misc_feature 1..150: note = hypo
  source 1..150: mol_type = genomic DNA
agacctgaggccacacggaggccgggctggccagggcggggctcagattcagtgacttgcccaggtgcccccagggcatctgagcagcccaggctccagccaggcaggtctgacttcacctcccttgccgtgagccgctgcactgttcca

SEQ ID NO: 97715 - DNA, 147 bp, Homo sapiens
  misc_feature 1..147: note = chr7:4781931-4782078
  misc_feature 1..147: note = hypo
  source 1..147: mol_type = genomic DNA
atcccaggctggtcacgtcagtccctccctgctgatctgcgcactctgctgaaccccggccgcaccttggcttgcttttttctttttttcctcttgcagctgtaggagaagaaagggcttttgtttgtatttcagagacagcgtctc

SEQ ID NO: 97716 - DNA, 30 bp, Homo sapiens
  misc_feature 1..30: note = chr7:4782599-4782629
  misc_feature 1..30: note = hypo
  source 1..30: mol_type = genomic DNA
gccccgggctcaggccgggcatggtcacct

SEQ ID NO: 97717 - DNA, 40 bp, Homo sapiens
  misc_feature 1..40: note = chr7:4784887-4784927
  misc_feature 1..40: note = hyper
  source 1..40: mol_type = genomic DNA
gtggagtggctggctcggtgtaggccgggctcgcccaggg

SEQ ID NO: 97718 - DNA, 68 bp, Homo sapiens; identical to SEQ ID NO: 31019
  misc_feature 1..68: note = chr7:4785735-4785803
  misc_feature 1..68: note = hyper
  source 1..68: mol_type = genomic DNA

SEQ ID NO: 97719 - DNA, 37 bp, Homo sapiens
  misc_feature 1..37: note = chr7:4802552-4802589
  misc_feature 1..37: note = hypo
  source 1..37: mol_type = genomic DNA
gaagccaggagctgccgagccacggaccacctaacag

SEQ ID NO: 97720 - DNA, 30 bp, Homo sapiens
  misc_feature 1..30: note = chr7:4805834-4805864
  misc_feature 1..30: note = hypo
  source 1..30: mol_type = genomic DNA
taatccctcaccagtcgggccgagtgtggc

SEQ ID NO: 97721 - DNA, 1012 bp, Homo sapiens
  misc_feature 1..1012: note = chr7:48074892-48075904
  misc_feature 1..1012: note = hyper
  source 1..1012: mol_type = genomic DNA
ctcccacccccgctgcgtcccgcccggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgac

SEQ ID NO: 97722 - DNA, 157 bp, Homo sapiens
  misc_feature 1..157: note = chr7:4813713-4813870
  misc_feature 1..157: note = hypo
  source 1..157: mol_type = genomic DNA
ttttaccctagtaaacgttaaacactggcagtaggctttccatagactacctgtcaccagctttcctttgccagtcttcaacctgcggctccaggggcacccgccgcactccaccgactcccatccaccgctcaccatccaccgattcccatctctt

SEQ ID NO: 97723 - DNA, 137 bp, Homo sapiens
  misc_feature 1..137: note = chr7:4837861-4837998
  misc_feature 1..137: note = hyper
  source 1..137: mol_type = genomic DNA
cgggtcggcagagggcgcggggcggacgcgctgcacctcgccgtagcgcacaccagggggcagcgtggagctgcacgaggcccagggcctgggacagacccaggacaccgatctggggaccccgcacagacctctgt

SEQ ID NO: 97724 - DNA, 288 bp, Homo sapiens
  misc_feature 1..288: note = chr7:4839163-4839451
  misc_feature 1..288: note = hypo
  source 1..288: mol_type = genomic DNA
cccacagggtgcagccgggcctctcctttaccccaggtccactcccctgagcagggcatctgggagaaggggccgggcgtgcatgcggtgggggtacctcaggtagccaaggcccaggaggctgctgccattcacctccaggatacggtcccccagcgacaggcgcccgtcggccgctgcggggctgcccgggagcagggtctggatgtagagcccgggggcgcccaggtgcgtgtgctggggacaagcagaggcctcagagctccgcaggcccgactggctgtcccc

SEQ ID NO: 97725 - DNA, 175 bp, Homo sapiens; identical to SEQ ID NO: 41160
  misc_feature 1..175: note = chr7:4840176-4840351
  misc_feature 1..175: note = hypo
  source 1..175: mol_type = genomic DNA

SEQ ID NO: 97726 - DNA, 30 bp, Homo sapiens; identical to SEQ ID NO: 41161
  misc_feature 1..30: note = chr7:4840692-4840722
  misc_feature 1..30: note = hypo
  source 1..30: mol_type = genomic DNA

SEQ ID NO: 97727 - DNA, 177 bp, Homo sapiens
  misc_feature 1..177: note = chr7:4841057-4841234
  misc_feature 1..177: note = hypo
  source 1..177: mol_type = genomic DNA
agtatctgcccaagacgtgtcagcgactgagcgaccgtgtggcccagctgctgggggctgagcagccctgagccctctccatctggccccgtctcaggttgcaggtgtctgtggggcaggtaaggaaacctaggacccaaggggggaacgatcccaggggaccggccatcagggtgc

SEQ ID NO: 97728 - DNA, 138 bp, Homo sapiens
  misc_feature 1..138: note = chr7:4843211-4843349
  misc_feature 1..138: note = hypo
  source 1..138: mol_type = genomic DNA
gcctgccagggctgccggggctggctctgctccgcagaccccacagaaagtggcggacgtagagcaggtgctggtagatgctgtcgtccaggcagttggcttccaagtccacctggaagccgtcgctgggcaggacga

SEQ ID NO: 97729 - DNA, 18 bp, Homo sapiens
  misc_feature 1..18: note = chr7:48465341-48465359
  misc_feature 1..18: note = hypo
  source 1..18: mol_type = genomic DNA
atttatttattttttcga

SEQ ID NO: 97730 - DNA, 152 bp, Homo sapiens
  misc_feature 1..152: note = chr7:4855938-4856090
  misc_feature 1..152: note = hypo
  source 1..152: mol_type = genomic DNA
tgcacctgcagctgccgcaggaggtccagggctgcctggtacacagacaccacgcggcgcagctcctcgggcagttcgggggccgaggaccagctctcacggcgctccgtctggaatggcgggcactccaggagtgccgggaggcagatgta

SEQ ID NO: 97731 - DNA, 453 bp, Homo sapiens
  misc_feature 1..453: note = chr7:4856843-4857296
  misc_feature 1..453: note = hypo
  source 1..453: mol_type = genomic DNA
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccgccactcttacctggggaggggaatgccgggaggggcaggaggggtccagacacccaacatctcaatgcccagcccagcccagcccaagcgctcattcactcccacgttctggatacgttttctgttacaa

SEQ ID NO: 97732 - DNA, 355 bp, Homo sapiens
  misc_feature 1..355: note = chr7:4857971-4858326
  misc_feature 1..355: note = hypo
  source 1..355: mol_type = genomic DNA
gccaggacaatggtgcgccaagcccttggacaagcccctgtcactttcgctctgccgctcctggtgctcctccttcaggggcttggggctgcctggcccccacccaccaagcccgctccccaagaacctgtgaagccccccagtgcctgccccacagggtcacatctgggaaccaggcagggcagctggagggaccccggggtccggggcagtaaggggctctcgggctctgccaacctcaacactgtgcccagaagcctccaggcctgtggagacacacaaggtggcccgacggcgcccacagcgagtgccggcaaaggatattcacagccacggcaggcgggtcaggaggctg

SEQ ID NO: 97733 - DNA, 30 bp, Homo sapiens
  misc_feature 1..30: note = chr7:4864784-4864814
  misc_feature 1..30: note = hypo
  source 1..30: mol_type = genomic DNA
ggcaggaggaacaggcgtagctggctgggg

SEQ ID NO: 97734 - DNA, 112 bp, Homo sapiens
  misc_feature 1..112: note = chr7:4867556-4867668
  misc_feature 1..112: note = hypo
  source 1..112: mol_type = genomic DNA
gtagaccagttttaccgataaattcagatgggaaaatcctaattaaaagatcaacagtcaacatcactaattctcggggagatgccaatcaaaaccacgagacgccacctca

SEQ ID NO: 97735 - DNA, 30 bp, Homo sapiens
  misc_feature 1..30: note = chr7:4873587-4873617
  misc_feature 1..30: note = hypo
  source 1..30: mol_type = genomic DNA
tctaggggtggaggccggggatgctgctga

SEQ ID NO: 97736 - DNA, 30 bp, Homo sapiens
  misc_feature 1..30: note = chr7:4874233-4874263
  misc_feature 1..30: note = hypo
  source 1..30: mol_type = genomic DNA
tgacccagacagtctcgcggatcagcctgg

SEQ ID NO: 97737 - DNA, 59 bp, Homo sapiens; identical to SEQ ID NO: 41165
  misc_feature 1..59: note = chr7:4875008-4875067
  misc_feature 1..59: note = hypo
  source 1..59: mol_type = genomic DNA

SEQ ID NO: 97738 - DNA, 30 bp, Homo sapiens
  misc_feature 1..30: note = chr7:4876009-4876039
  misc_feature 1..30: note = hypo
  source 1..30: mol_type = genomic DNA
cagaaggagcagatgcggggactggtacag

SEQ ID NO: 97739 - DNA, 30 bp, Homo sapiens; identical to SEQ ID NO: 41166
  misc_feature 1..30: note = chr7:4876594-4876624
  misc_feature 1..30: note = hypo
  source 1..30: mol_type = genomic DNA

SEQ ID NO: 97740 - DNA, 205 bp, Homo sapiens
  misc_feature 1..205: note = chr7:4918324-4918529
  misc_feature 1..205: note = hypo
  source 1..205: mol_type = genomic DNA
gaaacacaatgaggtcgcctaagtaagacacgctccgctgcagggcttggatttctggaaagtgctgggcgcagcgcccgtgtgcagtgagcatcaaggagcgccccacccggagccggccccagcaccatcacagccacagaagagcagcgggcagcccaagggcaaagcttcgcctctccgtaaacctcgtgtctcctacccc

SEQ ID NO: 97741 - DNA, 158 bp, Homo sapiens
  misc_feature 1..158: note = chr7:4922549-4922707
  misc_feature 1..158: note = hyper
  source 1..158: mol_type = genomic DNA
gatggtccgcagccccgccagggccctgccaaccccaccaacaggctcctcctgcgaggccccaggagctcggctcagcatctgttatcttggatgcagtatttgtcgaggggctggaaatggtacataaatagccgggaaacaatgctttgagctgg

SEQ ID NO: 97742 - DNA, 135 bp, Homo sapiens; identical to SEQ ID NO: 31022
  misc_feature 1..135: note = chr7:4922839-4922974
  misc_feature 1..135: note = hyper
  source 1..135: mol_type = genomic DNA

SEQ ID NO: 97743 - DNA, 302 bp, Homo sapiens; identical to SEQ ID NO: 31023
  misc_feature 1..302: note = chr7:4923327-4923629
  misc_feature 1..302: note = hyper
  source 1..302: mol_type = genomic DNA

SEQ ID NO: 97744 - DNA, 39 bp, Homo sapiens; identical to SEQ ID NO: 41168
  misc_feature 1..39: note = chr7:4931853-4931892
  misc_feature 1..39: note = hypo
  source 1..39: mol_type = genomic DNA

SEQ ID NO: 97745 - DNA, 20 bp, Homo sapiens
  misc_feature 1..20: note = chr7:49493501-49493521
  misc_feature 1..20: note = hypo
  source 1..20: mol_type = genomic DNA
cagcccgccatgcctgagcc

SEQ ID NO: 97746 - DNA, 49 bp, Homo sapiens
  misc_feature 1..49: note = chr7:494963-495012
  misc_feature 1..49: note = hypo
  source 1..49: mol_type = genomic DNA
gcagaacagcatgtccgttgggctgcagatgggacggtgccctggggac

SEQ ID NO: 97747 - DNA, 174 bp, Homo sapiens
  misc_feature 1..174: note = chr7:4956774-4956948
  misc_feature 1..174: note = hypo
  source 1..174: mol_type = genomic DNA
aagagcttagtggttcggatccaagctgtggagccaaaaggcctgggttcgaattccagctctacacttcaggagtacataaccttgagcaagttacctattcgctctaggtctcagcttccttctctgtaaaacacggaggatgccagcaacctgacacggggctgtggggag

SEQ ID NO: 97748 - DNA, 30 bp, Homo sapiens
  misc_feature 1..30: note = chr7:4966300-4966330
  misc_feature 1..30: note = hypo
  source 1..30: mol_type = genomic DNA
gcttcttttgcttaacgtgatttttgcgag

SEQ ID NO: 97749 - DNA, 203 bp, Homo sapiens
  misc_feature 1..203: note = chr7:49700763-49700966
  misc_feature 1..203: note = hypo
  source 1..203: mol_type = genomic DNA
accgcgcccccggccggtccttgtttttaaagaatttacaattgaacgggcagaagcagatagtaacaagtgaatgaaagtagtaagatctcagctttacagacaccgtattctaactatgtttagagaaaaaaagtgcagctttcaaatttcatttacagtccgtctttcacatagtctcccatccacgacagtgtgagcag

SEQ ID NO: 97750 - DNA, 179 bp, Homo sapiens
  misc_feature 1..179: note = chr7:49740612-49740791
  misc_feature 1..179: note = hypo
  source 1..179: mol_type = genomic DNA
ggaaggagctggcagcgctgcggcgacgcatccccagaggagcagcagcctctgacagcaacaccaagtgcaggagcggagggcgggggaagtcacctgctgccagggttccaccgtggggatgataagagggaacagcatgcaccactaagtgtgggagtcaacgataggtaggtttc

SEQ ID NO: 97751 - DNA, 167 bp, Homo sapiens; identical to SEQ ID NO: 41029
  misc_feature 1..167: note = chr7:497742-497909
  misc_feature 1..167: note = hypo
  source 1..167: mol_type = genomic DNA

SEQ ID NO: 97752 - DNA, 327 bp, Homo sapiens; identical to SEQ ID NO: 31277
  misc_feature 1..327: note = chr7:49812691-49813018
  misc_feature 1..327: note = hyper
  source 1..327: mol_type = genomic DNA

SEQ ID NO: 97753 - DNA, 284 bp, Homo sapiens; identical to SEQ ID NO: 31278
  misc_feature 1..284: note = chr7:49813809-49814093
  misc_feature 1..284: note = hyper
  source 1..284: mol_type = genomic DNA

SEQ ID NO: 97754 - DNA, 630 bp, Homo sapiens; identical to SEQ ID NO: 31279
  misc_feature 1..630: note = chr7:49814121-49814751
  misc_feature 1..630: note = hyper
  source 1..630: mol_type = genomic DNA

SEQ ID NO: 97755 - DNA, 134 bp, Homo sapiens; identical to SEQ ID NO: 685
  misc_feature 1..134: note = chr7:49815116-49815250
  misc_feature 1..134: note = hyper
  source 1..134: mol_type = genomic DNA

SEQ ID NO: 97756 - DNA, 109 bp, Homo sapiens; identical to SEQ ID NO: 686
  misc_feature 1..109: note = chr7:49815656-49815765
  misc_feature 1..109: note = hyper
  source 1..109: mol_type = genomic DNA

SEQ ID NO: 97757 - DNA, 27 bp, Homo sapiens
  misc_feature 1..27: note = chr7:4985872-4985899
  misc_feature 1..27: note = hypo
  source 1..27: mol_type = genomic DNA
cacaccccaccccgtgcacacaatccc

SEQ ID NO: 97758 - DNA, 422 bp, Homo sapiens
  misc_feature 1..422: note = chr7:4998165-4998587
  misc_feature 1..422: note = hyper
  source 1..422: mol_type = genomic DNA
cagaggtggtaccaacgccttttaccatgaacaagagtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 97759 - DNA, 353 bp, Homo sapiens
  misc_feature 1..353: note = chr7:4998770-4999123
  misc_feature 1..353: note = hyper
  source 1..353: mol_type = genomic DNA
cggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccgctgaggtggaggagggtcgtggggagatgggggggtgggagaggtgggggtgaggaagtgggcgtaaggagtgggggcgggacggggggggtcctggctgcgcgcgcgagccacccatcgcccaggcctggggcggccctggccccggccccttttcccggtgccctccctgg

SEQ ID NO: 97760 - DNA, 30 bp, Homo sapiens
  misc_feature 1..30: note = chr7:50140443-50140473
  misc_feature 1..30: note = hypo
  source 1..30: mol_type = genomic DNA
aaaataaaataaaatcgtttttctcaagat

SEQ ID NO: 97761 - DNA, 20 bp, Homo sapiens
  misc_feature 1..20: note = chr7:50141622-50141642
  misc_feature 1..20: note = hypo
  source 1..20: mol_type = genomic DNA
aatgccaaaatttgccgggc

SEQ ID NO: 97762 - DNA, 37 bp, Homo sapiens
  misc_feature 1..37: note = chr7:50207925-50207962
  misc_feature 1..37: note = hypo
  source 1..37: mol_type = genomic DNA
cagaagtacctggcacgttagacgcaatcaatacata

SEQ ID NO: 97763 - DNA, 100 bp, Homo sapiens
  misc_feature 1..100: note = chr7:502263-502363
  misc_feature 1..100: note = hypo
  source 1..100: mol_type = genomic DNA
tctgctgctaggagccgagagcgccgcccgcagtgggacggagccggccccacagctccgtgcactcgcgacgtgcggcggacggcggtggctgtgggtg

SEQ ID NO: 97764 - DNA, 80 bp, Homo sapiens
  misc_feature 1..80: note = chr7:50231283-50231363
  misc_feature 1..80: note = hypo
  source 1..80: mol_type = genomic DNA
aatgtgagaaggaggcgatcctggcttctcgtctcattgattctcgcacgtcttttcaacgtgagcggccgagctgagtg

SEQ ID NO: 97765 - DNA, 30 bp, Homo sapiens; identical to SEQ ID NO: 41313
  misc_feature 1..30: note = chr7:50241354-50241384
  misc_feature 1..30: note = hypo
  source 1..30: mol_type = genomic DNA

SEQ ID NO: 97766 - DNA, 206 bp, Homo sapiens
  misc_feature 1..206: note = chr7:50243557-50243763
  misc_feature 1..206: note = hypo
  source 1..206: mol_type = genomic DNA
gtatgataggttcctcgccttcataatattctcagttgtaaccatacagtcatttatgtgatactttggttaatctccatctccctccacgaggctctatgctttctgcaaacaagcaccatggtcattttctctcagcgccctatttccagtacccagcatagtccctgcagcaagctgtttatgatcatcgtttgcataagtga

SEQ ID NO: 97767 - DNA, 255 bp, Homo sapiens
  misc_feature 1..255: note = chr7:50251373-50251628
  misc_feature 1..255: note = hypo
  source 1..255: mol_type = genomic DNA
gaggaggcatccacacgctggcatcgggaggcaggtatccacacactggcatcgggaggtgtccacacattggcatcaggaggaggtgtccatacgctggtattgggaggcaggtgtcagcactctggcatcaggaggaggtaccctcacactggcatcgggaggaggtacctacatgcttgaatagggaggaggtgctcacacgctggcatcgggaggcaggtgtccacacgctggtatcgggaggcaggtgtc

SEQ ID NO: 97768 - DNA, 392 bp, Homo sapiens
  misc_feature 1..392: note = chr7:502708-503100
  misc_feature 1..392: note = hypo
  source 1..392: mol_type = genomic DNA
ctgatacagcggggtcgtgggtgctctggcgggacggcccccaggcagccccgggccaggccagcccagaagggcctaggaggcagccgcgtggttaaagtgggggtgctgtttttgttgcgggatgtctgtgggtttgaacccccttgccctcatcacactggtggtgtgagccttgctcggaaagctggatttgaacgtcgtctgggtttggcgttggccctcagggcccggcgtccttccccggcgctgggacccagcctccggggagccgtgaagccctgccgtcttgtggctccaaagccggtccaccaatgacctcgtgccagcggcatcacgacgctgcctcacaccgcacaagactcgccgggaagatgcgagacccatgacag

SEQ ID NO: 97769 - DNA, 262 bp, Homo sapiens
  misc_feature 1..262: note = chr7:50293897-50294159
  misc_feature 1..262: note = hypo
  source 1..262: mol_type = genomic DNA
tattgtgtcttcttccgagtatcaactccactgtggcatctgcctatgttcattcaccccggtgccttcaggttatatttttgtgttttgtccagggtttttagctggtctctgggaggtttggtccagcaggagctaacacagccatagcggaagctgccataggattttgtttattttcttttccttctgttttgtatttgtgaattttctttataagatcaagaaaggattcctggccgggcgcggtggctcacgcctg

SEQ ID NO: 97770 - DNA, 22 bp, Homo sapiens
  misc_feature 1..22: note = chr7:50294459-50294481
  misc_feature 1..22: note = hypo
  source 1..22: mol_type = genomic DNA
catgaatcggtattcaattgta

SEQ ID NO: 97771 - DNA, 30 bp, Homo sapiens; identical to SEQ ID NO: 41317
  misc_feature 1..30: note = chr7:50337681-50337711
  misc_feature 1..30: note = hypo
  source 1..30: mol_type = genomic DNA

SEQ ID NO: 97772 - DNA, 30 bp, Homo sapiens
  misc_feature 1..30: note = chr7:50342284-50342314
  misc_feature 1..30: note = hypo
  source 1..30: mol_type = genomic DNA
taagagctgcatatgcgctcagggagaatg

SEQ ID NO: 97773 - DNA, 282 bp, Homo sapiens
  misc_feature 1..282: note = chr7:50343208-50343490
  misc_feature 1..282: note = hyper
  source 1..282: mol_type = genomic DNA
cctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 97774 - DNA, 320 bp, Homo sapiens; identical to SEQ ID NO: 3046
  misc_feature 1..320: note = chr7:50343974-50344294
  misc_feature 1..320: note = hyper
  source 1..320: mol_type = genomic DNA

SEQ ID NO: 97775 - DNA, 36 bp, Homo sapiens; identical to SEQ ID NO: 3047
  misc_feature 1..36: note = chr7:50344295-50344331
  misc_feature 1..36: note = hyper
  source 1..36: mol_type = genomic DNA

SEQ ID NO: 97776 - DNA, 406 bp, Homo sapiens; identical to SEQ ID NO: 3048
  misc_feature 1..406: note = chr7:50344332-50344738
  misc_feature 1..406: note = hyper
  source 1..406: mol_type = genomic DNA

SEQ ID NO: 97777 - DNA, 42 bp, Homo sapiens
  misc_feature 1..42: note = chr7:50365027-50365069
  misc_feature 1..42: note = hypo
  source 1..42: mol_type = genomic DNA
tgaaagaggtgaaaacgctaagatatttagcaattattactt

SEQ ID NO: 97778 - DNA, 354 bp, Homo sapiens
  misc_feature 1..354: note = chr7:503676-504030
  misc_feature 1..354: note = hypo
  source 1..354: mol_type = genomic DNA
cagcccgggagggagcgtgaagtggaggatctcggcaggcgtggctgtgtccaggcaggcgggtgctgccgcgtccccggctgcagggtcttggttccccggagccacaggacggcagggcttcacggctccccggaggctgggtcccagcgctggggaaggacaccgggccctgagggccaacgccaaacccagacgacgttcaaatccagctttccgagcaaggctcacaccaccaggaaagccgatacactttctaaactccacttctgagttgaatattcgaaataggctcttaaagcaaatgttggcccccacgtcagagtcaaccatgttcatcggatgcctccagcc

SEQ ID NO: 97779 - DNA, 34 bp, Homo sapiens
  misc_feature 1..34: note = chr7:50423090-50423124
  misc_feature 1..34: note = hypo
  source 1..34: mol_type = genomic DNA
tggggtaccggccaacgcccgccttgaggcctgg

SEQ ID NO: 97780 - DNA, 166 bp, Homo sapiens; identical to SEQ ID NO: 41320
  misc_feature 1..166: note = chr7:50438618-50438784
  misc_feature 1..166: note = hypo
  source 1..166: mol_type = genomic DNA

SEQ ID NO: 97781 - DNA, 156 bp, Homo sapiens
  misc_feature 1..156: note = chr7:50444259-50444415
  misc_feature 1..156: note = hypo
  source 1..156: mol_type = genomic DNA
gatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacgga

SEQ ID NO: 97782 - DNA, 30 bp, Homo sapiens
  misc_feature 1..30: note = chr7:50454697-50454727
  misc_feature 1..30: note = hypo
  source 1..30: mol_type = genomic DNA
acatctctgtccagtcgctggcatccacgt

SEQ ID NO: 97783 - DNA, 30 bp, Homo sapiens; identical to SEQ ID NO: 41322
  misc_feature 1..30: note = chr7:50471189-50471219
  misc_feature 1..30: note = hypo
  source 1..30: mol_type = genomic DNA

SEQ ID NO: 97784 - DNA, 106 bp, Homo sapiens; identical to SEQ ID NO: 41323
  misc_feature 1..106: note = chr7:50560557-50560663
  misc_feature 1..106: note = hypo
  source 1..106: mol_type = genomic DNA

SEQ ID NO: 97785 - DNA, 30 bp, Homo sapiens
  misc_feature 1..30: note = chr7:50561907-50561937
  misc_feature 1..30: note = hypo
  source 1..30: mol_type = genomic DNA
gttattaagaatttccggccaggcaccgtg

SEQ ID NO: 97786 - DNA, 30 bp, Homo sapiens
  misc_feature 1..30: note = chr7:5081846-5081876
  misc_feature 1..30: note = hypo
  source 1..30: mol_type = genomic DNA
ccgcctgatccaccacgcccagccacaacc

SEQ ID NO: 97787 - DNA, 99 bp, Homo sapiens
  misc_feature 1..99: note = chr7:50860193-50860292
  misc_feature 1..99: note = hyper
  source 1..99: mol_type = genomic DNA
ggcaatcagcaaaggcgaagagttgcatcagaaatttccttctgcaaacggtaccgctcttatcacatttccacggctggcgggcggctaatccgcgag

SEQ ID NO: 97788 - DNA, 27 bp, Homo sapiens
  misc_feature 1..27: note = chr7:50861076-50861103
  misc_feature 1..27: note = hyper
  source 1..27: mol_type = genomic DNA
aactttgggctccaccgggtctccgag

SEQ ID NO: 97789 - DNA, 196 bp, Homo sapiens
  misc_feature 1..196: note = chr7:50861335-50861531
  misc_feature 1..196: note = hyper
  source 1..196: mol_type = genomic DNA
ggcgtggcgcgggggcgcgggccgcgggccggacggccggggggccagaagctcccggaggttcctgccccgggctgctgagcgggttcccccctcctgctgtcctcgggactcgggcgcgggaccacgaccgccgcggctcaggaggcttcgccagtgaaaggacaaattggacctgtcccgaaagacaatttat

SEQ ID NO: 97790 - DNA, 30 bp, Homo sapiens
  misc_feature 1..30: note = chr7:5112197-5112227
  misc_feature 1..30: note = hyper
  source 1..30: mol_type = genomic DNA
agaggaagtcagggacgcagggaaaggaat

SEQ ID NO: 97791 - DNA, 62 bp, Homo sapiens
  misc_feature 1..62: note = chr7:51383330-51383392
  misc_feature 1..62: note = hyper
  source 1..62: mol_type = genomic DNA
gtccccggcgcgccgcgctgaaaactacaaagtccaccgggactgcgcgctaccccgcggcc

SEQ ID NO: 97792 - DNA, 669 bp, Homo sapiens
  misc_feature 1..669: note = chr7:51384251-51384920
  misc_feature 1..669: note = hyper
  source 1..669: mol_type = genomic DNA
gccccctctccaccccgcccgaccgcggggccgcttacccggtcgggggcttggccgccgaggcgcgcggcgcgtccatggtgccgggggccgggacgcgggcggtgctccgggcccgccgagtcaggcgctggctaccgccgccaccgctgccgccctcattcactttttccgcgctgacccatcgtcctcccacgcgggccggcggaggacagcggcggagcgcggcggacggaaggggctggaatcgtctctagcgggcgggggcgccgggagcgcagggaggggctggcggcggcgcggggcgggggcgccgggagcaaggtgcgccgcgcccccgccccggctgctctgccgcgcccaccggagcgccgcccccgccccgccccgccccgcctgctcagagtcccgacccggcccgcggcgagcgtccggggaaggaatcctccggcacctgggccctgcaccgacacccgcgggtgcggcagagggcttctccccgtgctcctccacccctggggggagcgcgaccctctctgggcggagtgggggatcccggggccggcgcctcctggcggagttgggggaggggaaccacctggagcctggaggccgtgcgagggcgaggtgggcggaccagcccgggaggactgacgttggagggtgaga

SEQ ID NO: 97793 - DNA, 105 bp, Homo sapiens
  misc_feature 1..105: note = chr7:51408343-51408448
  misc_feature 1..105: note = hypo
  source 1..105: mol_type = genomic DNA
gagagtttcaggcagcgagtgtgcattctttagtgattagttggacaagtggaatgcctggtggttttcaaatcttgttatgtttaaaagtttcatatgaggcca

SEQ ID NO: 97794 - DNA, 37 bp, Homo sapiens
  misc_feature 1..37: note = chr7:5165566-5165603
  misc_feature 1..37: note = hypo
  source 1..37: mol_type = genomic DNA
atcagcatgaatcaacgccacacgaaggtgagctggg

SEQ ID NO: 97795 - DNA, 30 bp, Homo sapiens
  misc_feature 1..30: note = chr7:51873296-51873326
  misc_feature 1..30: note = hypo
  source 1..30: mol_type = genomic DNA
atctacttttattaccgtcaacaatcttct

SEQ ID NO: 97796 - DNA, 69 bp, Homo sapiens
  misc_feature 1..69: note = chr7:51886447-51886516
  misc_feature 1..69: note = hypo
  source 1..69: mol_type = genomic DNA
ggcccatggatgcgtcggacagtgttccatcccacgtgcctcagaaaatgcaggcggaggcaaaggagt

SEQ ID NO: 97797 - DNA, 28 bp, Homo sapiens
  misc_feature 1..28: note = chr7:52268621-52268649
  misc_feature 1..28: note = hypo
  source 1..28: mol_type = genomic DNA
ttttgtttgtttgttcgtttgtttgttt

SEQ ID NO: 97798 - DNA, 30 bp, Homo sapiens; identical to SEQ ID NO: 41325
  misc_feature 1..30: note = chr7:52499272-52499302
  misc_feature 1..30: note = hypo
  source 1..30: mol_type = genomic DNA

SEQ ID NO: 97799 - DNA, 65 bp, Homo sapiens
  misc_feature 1..65: note = chr7:5262558-5262623
  misc_feature 1..65: note = hypo
  source 1..65: mol_type = genomic DNA
gggccctccagtgcccggcagctcccagcctgctgtaagggacggggcggcgacgtcatgggtag

SEQ ID NO: 97800 - DNA, 61 bp, Homo sapiens
  misc_feature 1..61: note = chr7:52736850-52736911
  misc_feature 1..61: note = hypo
  source 1..61: mol_type = genomic DNA
ccatgcctgaggagtcgggcaggcggcccgcccaggccacgctttccgtgtcctctggccc

SEQ ID NO: 97801 - DNA, 111 bp, Homo sapiens
  misc_feature 1..111: note = chr7:5305461-5305572
  misc_feature 1..111: note = hypo
  source 1..111: mol_type = genomic DNA
aagtgcgtgcatctgcgtgagattgagtgtgtgtgggtgcgtctttttgtgtgtgtgtctttgtgtgtgtgtgtctaggtctgtccatctgtgcggcgcctttgtctcctg

SEQ ID NO: 97802 - DNA, 30 bp, Homo sapiens
  misc_feature 1..30: note = chr7:53103556-53103586
  misc_feature 1..30: note = hypo
  source 1..30: mol_type = genomic DNA
tacttccagtgggggcgcccggtgcccagc

SEQ ID NO: 97803 - DNA, 60 bp, Homo sapiens
  misc_feature 1..60: note = chr7:53104173-53104233
  misc_feature 1..60: note = hypo
  source 1..60: mol_type = genomic DNA
gacaacgccttcctgcggcagctgcagtagggtctccttcgccctcgaggtcacccagtc

SEQ ID NO: 97804 - DNA, 128 bp, Homo sapiens
  misc_feature 1..128: note = chr7:5316311-5316439
  misc_feature 1..128: note = hypo
  source 1..128: mol_type = genomic DNA
ccccgaaagcccagccggccagccccctctccctctgcctccgcagggaaccgtgtcccaagcagggcccttcaccccatctctgtctgatctccactgcgtgtacggattgacgggaaagattctaa

SEQ ID NO: 97805 - DNA, 19 bp, Homo sapiens
  misc_feature 1..19: note = chr7:5320472-5320491
  misc_feature 1..19: note = hypo
  source 1..19: mol_type = genomic DNA
cagccgtcatgaactttaa

SEQ ID NO: 97806 - DNA, 39 bp, Homo sapiens
  misc_feature 1..39: note = chr7:5323361-5323400
  misc_feature 1..39: note = hyper
  source 1..39: mol_type = genomic DNA
gggcagcagaggcatcgttagccccggttaacggggacc

SEQ ID NO: 97807 - DNA, 125 bp, Homo sapiens
  misc_feature 1..125: note = chr7:532811-532936
  misc_feature 1..125: note = hypo
  source 1..125: mol_type = genomic DNA
ttcctcgggaaaccccgtcctcccccattttctgtcttgtgcttctgatggaaatctatcccacaacagaaacggtacatgggactcagacccagcggatcccaggactccggatggagccaaag

SEQ ID NO: 97808 - DNA, 30 bp, Homo sapiens
  misc_feature 1..30: note = chr7:5328996-5329026
  misc_feature 1..30: note = hypo
  source 1..30: mol_type = genomic DNA
cagcctgagcaacggcgagactctgaaaaa

SEQ ID NO: 97809 - DNA, 98 bp, Homo sapiens
  misc_feature 1..98: note = chr7:5334502-5334600
  misc_feature 1..98: note = hypo
  source 1..98: mol_type = genomic DNA
gcttctacgggtacacggggatgctgcccaagcggtacacgcagggggtgatgaccggggagagtgagtatctgcagaccccccggggagggggtgct

SEQ ID NO: 97810 - DNA, 105 bp, Homo sapiens
  misc_feature 1..105: note = chr7:53364374-53364479
  misc_feature 1..105: note = hypo
  source 1..105: mol_type = genomic DNA
agatatcctgtagatcggggtccccatgctccaggccatggaccgatactgttaggaactgggctacacagcaggaggtgagccgggtgagcaagtgaagcttca

SEQ ID NO: 97811 - DNA, 160 bp, Homo sapiens
  misc_feature 1..160: note = chr7:5342789-5342949
  misc_feature 1..160: note = hypo
  source 1..160: mol_type = genomic DNA
cagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgca

SEQ ID NO: 97812 - DNA, 185 bp, Homo sapiens
  misc_feature 1..185: note = chr7:5343701-5343886
  misc_feature 1..185: note = hypo
  source 1..185: mol_type = genomic DNA
caagcagagtttgtgcgtggacgggggctgggactgccatctcgggataccggtggaactcgggctgccccgcataagccggtcctcagtcttcccatctgtgaggtgggccgggtggatcagggagcaggagggtgtcctcacactgggtaggcttggtttgtgggcagcgctgggtagtgggg

SEQ ID NO: 97813 - DNA, 37 bp, Homo sapiens
  misc_feature 1..37: note = chr7:543015-543052
  misc_feature 1..37: note = hypo
  source 1..37: mol_type = genomic DNA
aggctagaaaggaaacggaggccgggtcaccccctga

SEQ ID NO: 97814 - DNA, 142 bp, Homo sapiens; identical to SEQ ID NO: 41173
  misc_feature 1..142: note = chr7:5441304-5441446
  misc_feature 1..142: note = hypo
  source 1..142: mol_type = genomic DNA

SEQ ID NO: 97815 - DNA, 661 bp, Homo sapiens
  misc_feature 1..661: note = chr7:5458939-5459600
  misc_feature 1..661: note = hyper
  source 1..661: mol_type = genomic DNA
cgcaggcggggagtgcgcgacgccccttcccagcctcgaaaaagccaagcgcaggcccagccagccagagagacccgggtaccgattcccaggcttggggggggcccccctgccaccactccgggctggaccaaatgacccaaaagacacacgcatgcacacacacacacatcacggtggacttgtggggagcgcaaaaggggacagctcagatggtctctgtaccccagggccgccccccaagttcttcctcgggggtcccccgcgcccctccctcgccacaacacgccactagagaacaaacccttgccccggtcacagaccccgggcggaatacgcccccagctccggagggacacaagcaggtccgggggccaagacctggttcttgcgccccggctggcggggatctccgagctcccggcccccgggcgcgcgcccctcccccgcccggcgcctcacaaaggccctttgtcccgccgagcccccgggactccagttcctgaaaagttccaggagaaaaatcaaagagagagcaaaatcggcgagctccgccgagcgggcggggcaaggccgaggtggcagctcctgagagaccccaaggaagaggggagcatcgagggctactctggaaattgcaaaaatccgaaactgcaattcg

SEQ ID NO: 97816 - DNA, 93 bp, Homo sapiens
  misc_feature 1..93: note = chr7:5460480-5460573
  misc_feature 1..93: note = hyper
  source 1..93: mol_type = genomic DNA
tacggaaaaggtagccgagccgcgcgacactctccaccgccttggctccgggaccaggagtttcccagccctgggagccgagtctgcccgcac

SEQ ID NO: 97817 - DNA, 371 bp, Homo sapiens
  misc_feature 1..371: note = chr7:54609581-54609952
  misc_feature 1..371: note = hyper
  source 1..371: mol_type = genomic DNA
aaattcgtgtgaaatcgtagcatgtgatgctcctggttggagcagttaataactgggtaagcggcatttccctaaatggctgttttcctcggcccacccgtctctcccccatcccattgctccccggtcctcagcaatgccccaactccctcccggaaccttttgctccgagccccccgccagcgccgcaatcccgtcactgtattgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccggg

SEQ ID NO: 97818 - DNA, 31 bp, Homo sapiens; identical to SEQ ID NO: 31289
  misc_feature 1..31: note = chr7:54609991-54610022
  misc_feature 1..31: note = hyper
  source 1..31: mol_type = genomic DNA

SEQ ID NO: 97819 - DNA, 313 bp, Homo sapiens
  misc_feature 1..313: note = chr7:54610023-54610336
  misc_feature 1..313: note = hyper
  source 1..313: mol_type = genomic DNA
cgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctga

SEQ ID NO: 97820 - DNA, 489 bp, Homo sapiens
  misc_feature 1..489: note = chr7:54612317-54612806
  misc_feature 1..489: note = hyper
  source 1..489: mol_type = genomic DNA
aatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaagttctggtacttaggcagatgcccgccttgcccctaccacgctgccacatcccgggacatccgggagcccctttcc

SEQ ID NO: 97821 - DNA, 148 bp, Homo sapiens
  misc_feature 1..148: note = chr7:54614009-54614157
  misc_feature 1..148: note = hyper
  source 1..148: mol_type = genomic DNA
ggaaaaggaaaatagcgggaggaggggagaggggaagggggtccgggcgagggagacctagttgagcgagaggcggcgcccctgcgagccagcaagagaatctggggccaggagcgcggggcgggacggcaggcgggatggtggccgg

SEQ ID NO: 97822 - DNA, 153 bp, Homo sapiens
  misc_feature 1..153: note = chr7:54614380-54614533
  misc_feature 1..153: note = hyper
  source 1..153: mol_type = genomic DNA
gcgccgggacagccccgggacagccccggggaaagcgcggggacggcgtggggtatgccagggacagcgtggggtatgccagggacagcgtgggggcggtgcggtctgggcctggacaggggtggccacgcccctggtcgctcccctgtcccc

SEQ ID NO: 97823 - DNA, 38 bp, Homo sapiens
  misc_feature 1..38: note = chr7:54614739-54614777
  misc_feature 1..38: note = hyper
  source 1..38: mol_type = genomic DNA
gcccttccctgtccccgagaaggcggcttgccagcgct

SEQ ID NO: 97824 - DNA, 50 bp, Homo sapiens
  misc_feature 1..50: note = chr7:5464999-5465049
  misc_feature 1..50: note = hyper
  source 1..50: mol_type = genomic DNA
aaaacaagagaagcccgctctttcgccccgcgctgcggactcagcgtttt

SEQ ID NO: 97825 - DNA, 30 bp, Homo sapiens
  misc_feature 1..30: note = chr7:5466477-5466507
  misc_feature 1..30: note = hyper
  source 1..30: mol_type = genomic DNA
ggagccatcttggggcggaggaccgatccc

SEQ ID NO: 97826 - DNA, 716 bp, Homo sapiens
  misc_feature 1..716: note = chr7:5467189-5467905
  misc_feature 1..716: note = hyper
  source 1..716: mol_type = genomic DNA
gctcccgcgatcagacggtctctctcaattcggcgttgaacccggttcttcccaaattctggtattgctggccgcttggacacgttctccccttatccctcccccagcggggaaagaaaaagccaggatcctttccttggcgcggccacccgagccactccacccgtcgcgccaaccgcctttccaggtggggaccaaagcccccactctccgctggcatctcattgaagggcacccccccgagggattgccagcttctgctgccagctgagaggccgtgtggctgggcgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttccc

SEQ ID NO: 97827 - DNA, 510 bp, Homo sapiens; identical to SEQ ID NO: 31295
  misc_feature 1..510: note = chr7:54732044-54732554
  misc_feature 1..510: note = hyper
  source 1..510: mol_type = genomic DNA

SEQ ID NO: 97828 - DNA, 253 bp, Homo sapiens
  misc_feature 1..253: note = chr7:54794703-54794956
  misc_feature 1..253: note = hypo
  source 1..253: mol_type = genomic DNA
cacaccacagcctcacggcttgttctgttagaccgatgcctccgcccggctctctccgtgtcctgcacacagtacgccactacccggggtatgaaatataatacgtccaaggtcactcaaagggcatcatatttaagacttaaaatctcttcaagttccctgccacctctgaaaagagtagcagataatgaaattcagaacttcgttgtccgagtgacccggcacatgtgagactctccggagttttagggag

SEQ ID NO: 97829 - DNA, 30 bp, Homo sapiens
  misc_feature 1..30: note = chr7:5483425-5483455
  misc_feature 1..30: note = hypo
  source 1..30: mol_type = genomic DNA
aaatccaatgactcccgtccttaagagaca

SEQ ID NO: 97830 - DNA, 19 bp, Homo sapiens
  misc_feature 1..19: note = chr7:54846014-54846033
  misc_feature 1..19: note = hypo
  source 1..19: mol_type = genomic DNA
tgccatggctgggcacggt

SEQ ID NO: 97831 - DNA, 30 bp, Homo sapiens; identical to SEQ ID NO: 41329
  misc_feature 1..30: note = chr7:54866907-54866937
  misc_feature 1..30: note = hypo
  source 1..30: mol_type = genomic DNA

SEQ ID NO: 97832 - DNA, 33 bp, Homo sapiens
  misc_feature 1..33: note = chr7:5494673-5494706
  misc_feature 1..33: note = hypo
  source 1..33: mol_type = genomic DNA
gagtgccaccttccacgccgtcactttaggagt

SEQ ID NO: 97833 - DNA, 118 bp, Homo sapiens
  misc_feature 1..118: note = chr7:55086571-55086689
  misc_feature 1..118: note = hyper
  source 1..118: mol_type = genomic DNA
ctggccttgggtccccgctgctggttctcctccctcctcctcgcattctcctcctcctctgctcctcccgatccctcctccgccgcctggtccctcctcctcccgccctgcctccccg

SEQ ID NO: 97834 - DNA, 820 bp, Homo sapiens
  misc_feature 1..820: note = chr7:55086983-55087803
  misc_feature 1..820: note = hyper
  source 1..820: mol_type = genomic DNA
ggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 97835 - DNA, 135 bp, Homo sapiens
  misc_feature 1..135: note = chr7:55145845-55145980
  misc_feature 1..135: note = hypo
  source 1..135: mol_type = genomic DNA
tatttgggtgtgtggcgtgtggggaggggagaaggagcaaggcggcagggaggggatgaggaccaccctgtccatgggacaggccctgggccccgcacacaccccaagccccgcgtcccgcgtcctcactgtcct

SEQ ID NO: 97836 - DNA, 112 bp, Homo sapiens; identical to SEQ ID NO: 41034
  misc_feature 1..112: note = chr7:551572-551684
  misc_feature 1..112: note = hypo
  source 1..112: mol_type = genomic DNA

SEQ ID NO: 97837 - DNA, 66 bp, Homo sapiens
  misc_feature 1..66: note = chr7:551953-552019
  misc_feature 1..66: note = hypo
  source 1..66: mol_type = genomic DNA
ccctgccctgcccatcgcggcctcctggactcaccgatgcttctcttcctccgaatgggcaggggc

SEQ ID NO: 97838 - DNA, 195 bp, Homo sapiens
  misc_feature 1..195: note = chr7:5521589-5521784
  misc_feature 1..195: note = hypo
  source 1..195: mol_type = genomic DNA
ttacatgggtggccacggagggggcggagcctgctggggaagcccaggaggcactcacacctgcctccccgtcccgggctcacctggggctcccagacagaccatgcctgccagagtcaccctctaagtgcctcaagggccctgtacgtggcagacagagctggggaggagcacggcagccgggaacaggccaca

SEQ ID NO: 97839 - DNA, 105 bp, Homo sapiens; identical to SEQ ID NO: 31029
  misc_feature 1..105: note = chr7:5526299-5526404
  misc_feature 1..105: note = hyper
  source 1..105: mol_type = genomic DNA

SEQ ID NO: 97840 - DNA, 142 bp, Homo sapiens
  misc_feature 1..142: note = chr7:552953-553095
  misc_feature 1..142: note = hypo
  source 1..142: mol_type = genomic DNA
ccaccccttcacaggcgctgacggctacagcagacaggctgggggagtctcaggtctctccaaatcccgcagtagggagaggacccacagtcctgcccatggacacactgcccgcacctgggcaccgcgggtggctctgggc

SEQ ID NO: 97841 - DNA, 116 bp, Homo sapiens; identical to SEQ ID NO: 41174
  misc_feature 1..116: note = chr7:5529839-5529955
  misc_feature 1..116: note = hypo
  source 1..116: mol_type = genomic DNA

SEQ ID NO: 97842 - DNA, 194 bp, Homo sapiens
  misc_feature 1..194: note = chr7:55382606-55382800
  misc_feature 1..194: note = hypo
  source 1..194: mol_type = genomic DNA
agttgaataaagttgcgctcaattttggctcatgtattgactcagttgccagtttgggctcatttattctgtatcactgaaggtggtcctcagacagtgatgaagggccctcctcagccagaagcagagccctggcaggaaagcgcaagacagctcctattgtcaggccctgggcaccacgccacctcctcctg

SEQ ID NO: 97843 - DNA, 305 bp, Homo sapiens
  misc_feature 1..305: note = chr7:55410019-55410324
  misc_feature 1..305: note = hypo
  source 1..305: mol_type = genomic DNA
gggtcagggcagaggcgcaggtggtgcgacgccacggagttggtccccatggccgtgagccagccccagcggcacagccgccctgtccccagcggcatctaggtgatggccaactccaggccgctctccagctgcttggcctggcacctcagctctgccagctcccggaagcaacaggccaccaagcggccccgggctcccgtggcagtgagccctctactctgctctcaaaaactgatgccgccaaggagcccgccatggccagccctgctcaaagccagggccagccccgggagccaagccgc

SEQ ID NO: 97844 - DNA, 30 bp, Homo sapiens
  misc_feature 1..30: note = chr7:55432093-55432123
  misc_feature 1..30: note = hypo
  source 1..30: mol_type = genomic DNA
tggattttcctacaccgtctaggtatgaaa

SEQ ID NO: 97845 - DNA, 30 bp, Homo sapiens
  misc_feature 1..30: note = chr7:55570199-55570229
  misc_feature 1..30: note = hypo
  source 1..30: mol_type = genomic DNA
caggccccagctactcgaaggagcacacaa

SEQ ID NO: 97846 - DNA, 30 bp, Homo sapiens
  misc_feature 1..30: note = chr7:556686-556716
  misc_feature 1..30: note = hyper
  source 1..30: mol_type = genomic DNA
gcccagggtctgggccggatcctgccgctc

SEQ ID NO: 97847 - DNA, 127 bp, Homo sapiens
  misc_feature 1..127: note = chr7:557093-557220
  misc_feature 1..127: note = hyper
  source 1..127: mol_type = genomic DNA
gcctctcgatcacctcgcgggggatctcggcttcctgcaagcagaggccacacggtcagcgcccgcggccccgaccccgccggcacgcgcccccggccgccaggagcgccgccgccccgggcccgag

SEQ ID NO: 97848 - DNA, 157 bp, Homo sapiens
  misc_feature 1..157: note = chr7:55838624-55838781
  misc_feature 1..157: note = hypo
  source 1..157: mol_type = genomic DNA
gcctcccaggcagggcggtgcctgttctggaccagatcccaggtccaaggggatttcctctacaccgcagacttctctttgatcttcccttctttgaaattacagggcagggatgcgatttccatccaggtagttttgtttgtttgtttgtttgttt

SEQ ID NO: 97849 - DNA, 136 bp, Homo sapiens
  misc_feature 1..136: note = chr7:5589419-5589555
  misc_feature 1..136: note = hypo
  source 1..136: mol_type = genomic DNA
gggctctttgggaagcgtctggagagactttggtggggaggtctggactggacaccatttctatcctggccagtacccagcaaagtaagtgaagaggccgggcgcggtggctcacgcctgtaatcccagctatttg

SEQ ID NO: 97850 - DNA, 19 bp, Homo sapiens
  misc_feature 1..19: note = chr7:55940140-55940159
  misc_feature 1..19: note = hypo
  source 1..19: mol_type = genomic DNA
tttatttttttgagacgga

SEQ ID NO: 97851 - DNA, 360 bp, Homo sapiens
  misc_feature 1..360: note = chr7:56017869-56018229
  misc_feature 1..360: note = hypo
  source 1..360: mol_type = genomic DNA
tgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcattaatcattgatgttgtcggggtagggaccagagttctaactgtggaagaaaggagataaaaatacggaactggtgaagcaaaagaagaaacccactggtggctcatg

SEQ ID NO: 97852 - DNA, 161 bp, Homo sapiens
  misc_feature 1..161: note = chr7:560181-560342
  misc_feature 1..161: note = hyper
  source 1..161: mol_type = genomic DNA
ccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagc

SEQ ID NO: 97853 - DNA, 240 bp, Homo sapiens
  misc_feature 1..240: note = chr7:56018469-56018709
  misc_feature 1..240: note = hypo
  source 1..240: mol_type = genomic DNA
cgacagagacagcctccgtcccaaaaaagaaagaaacccactgctgtttaaaggtaggtgtgtgtgtgcgtgtgtgtatgtttcaatgtatcgatagctacatctgctgaaatagcctacaggcaggaaaatcccagtagcaagttgctcacctagcactcagagctttgttgctaagtaccactccccactgatatttttcgtttgaaaaacttctgatacaataactggtcagggaaa

SEQ ID NO: 97854 - DNA, 23 bp, Homo sapiens
  misc_feature 1..23: note = chr7:56031846-56031869
  misc_feature 1..23: note = hypo
  source 1..23: mol_type = genomic DNA
tgttaaagcgttgtggggctttt

SEQ ID NO: 97855 - DNA, 40 bp, Homo sapiens
  misc_feature 1..40: note = chr7:560554-560594
  misc_feature 1..40: note = hyper
  source 1..40: mol_type = genomic DNA
gtgctgtgcagaccccgaggctagacggcctaggcccctg

SEQ ID NO: 97856 - DNA, 317 bp, Homo sapiens
  misc_feature 1..317: note = chr7:560928-561245
  misc_feature 1..317: note = hyper
  source 1..317: mol_type = genomic DNA
cgcagccccacaccacgacccccgcggtcaagcatgccctctgggtggtcaggaccaagcgggaccgggacagaaccaggggagccttggaaacgtggaggagccccttaaagccaggccttgtccctccagggggaacttgcggcttgggaggggacacccactgcatggcttctggaaagagccggactcgcagggccaggacgcaggccggaccccggcctcattcttcggccagttatcccggagtggcgcgcatcctgtcttcctgggcctcggactgctcgcgcgcagagggggcccgaggacacctctgt

SEQ ID NO: 97857 - DNA, 25 bp, Homo sapiens
  misc_feature 1..25: note = chr7:56120758-56120783
  misc_feature 1..25: note = hypo
  source 1..25: mol_type = genomic DNA
ttaccaggcccgtgcccagctgggt

SEQ ID NO: 97858 - DNA, 198 bp, Homo sapiens
  misc_feature 1..198: note = chr7:5614360-5614558
  misc_feature 1..198: note = hyper
  source 1..198: mol_type = genomic DNA
taaaaattcatgccccgtgtgcacttcagtctagaacacacttccttttgttttaacgtgatacagcgttttcactatacaacttctggtaaaattgctgcctggttatccgggggctgtgtctggtcagagagggggcctggcaggctgggaaggacagggaggggtgggggagggggaagacgggtgggggaaggt

SEQ ID NO: 97859 - DNA, 30 bp, Homo sapiens; identical to SEQ ID NO: 41334
  misc_feature 1..30: note = chr7:56144506-56144536
  misc_feature 1..30: note = hypo
  source 1..30: mol_type = genomic DNA

SEQ ID NO: 97860 - DNA, 17 bp, Homo sapiens
  misc_feature 1..17: note = chr7:56172896-56172913
  misc_feature 1..17: note = hypo
  source 1..17: mol_type = genomic DNA
cccggccactttaatct

SEQ ID NO: 97861 - DNA, 35 bp, Homo sapiens
  misc_feature 1..35: note = chr7:56176289-56176324
  misc_feature 1..35: note = hypo
  source 1..35: mol_type = genomic DNA
taatggcaggctgggcgtggtggctcacgcctgta

SEQ ID NO: 97862 - DNA, 121 bp, Homo sapiens
  misc_feature 1..121: note = chr7:56183581-56183702
  misc_feature 1..121: note = hyper
  source 1..121: mol_type = genomic DNA
tgcggttccctaatacggttccctcagaggcagccgactctgcccagggcgagcagcgccgcgccgtggggggacgctcctagggtccccggggcactggttgggggaggtgttgggcgca

SEQ ID NO: 97863 - DNA, 332 bp, Homo sapiens
  misc_feature 1..332: note = chr7:56183846-56184178
  misc_feature 1..332: note = hyper
  source 1..332: mol_type = genomic DNA
cgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacagaggcggaccttcgacgacgtcacagtggcggtacagtgcctgg

SEQ ID NO: 97864 - DNA, 171 bp, Homo sapiens
  misc_feature 1..171: note = chr7:5626087-5626258
  misc_feature 1..171: note = hypo
  source 1..171: mol_type = genomic DNA
ggtcctcccggctgacggtgacgtcactatgagccaccacgcctggcccggtgggtgtttacagcagaggtggttcagggaggagtgagtggcagatggtgcaggctcagggaggagtgagtggcaggtggggcctgaggccagaggcaggaggaccgttcaagactgagg

SEQ ID NO: 97865 - DNA, 211 bp, Homo sapiens
  misc_feature 1..211: note = chr7:562619-562830
  misc_feature 1..211: note = hyper
  source 1..211: mol_type = genomic DNA
ggcacccagggagggcgggaaaggccttggccattcctctgggtaggggactggagaggggaagaaactttcgccgagtccagcgctgccccctcatacccatccccacccaggctgcgtgtccggggcccctccggggcttggcaccagcaggcacgcagcgatcgccgtcgttgttatttagtagtagtagtaacggctgacatttaca

SEQ ID NO: 97866 - DNA, 43 bp, Homo sapiens
  misc_feature 1..43: note = chr7:5629890-5629933
  misc_feature 1..43: note = hypo
  source 1..43: mol_type = genomic DNA
ggactggcctcacctcgtgccacgccctcgtaccaaggtggct

SEQ ID NO: 97867 - DNA, 569 bp, Homo sapiens
  misc_feature 1..569: note = chr7:5632903-5633472
  misc_feature 1..569: note = hyper
  source 1..569: mol_type = genomic DNA
ggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtgagtggggacgctgcccccgcctctcctggtccgtgcacaaagcgcaccccacccgcgcccctccagcctc

SEQ ID NO: 97868 - DNA, 62 bp, Homo sapiens
  misc_feature 1..62: note = chr7:56355682-56355744
  misc_feature 1..62: note = hyper
  source 1..62: mol_type = genomic DNA
cgcggtcccggacagctccgtctctggcgttggcgctgcagccgtgacggaggactacggcg

SEQ ID NO: 97869 - DNA, 102 bp, Homo sapiens
  misc_feature 1..102: note = chr7:5635640-5635742
  misc_feature 1..102: note = hyper
  source 1..102: mol_type = genomic DNA
gaaagggatgtgggacggcgcgggggtgggggtacttgggggccgaggttggggctcctctggcctcagatcttggggtccttatctcgtttctatgtcagc

SEQ ID NO: 97870 - DNA, 32 bp, Homo sapiens
  misc_feature 1..32: note = chr7:5637847-5637879
  misc_feature 1..32: note = hypo
  source 1..32: mol_type = genomic DNA
gggtgcctggccccccgcggtgggtgcctcac

SEQ ID NO: 97871 - DNA, 23 bp, Homo sapiens
  misc_feature 1..23: note = chr7:5644690-5644713
  misc_feature 1..23: note = hypo
  source 1..23: mol_type = genomic DNA
actgcggccgagcagaacacgtt

SEQ ID NO: 97872 - DNA, 30 bp, Homo sapiens
  misc_feature 1..30: note = chr7:5645977-5646007
  misc_feature 1..30: note = hypo
  source 1..30: mol_type = genomic DNA
tctttccgtccttcccgtccagccccagcc

SEQ ID NO: 97873 - DNA, 581 bp, Homo sapiens
  misc_feature 1..581: note = chr7:5647838-5648419
  misc_feature 1..581: note = hypo
  source 1..581: mol_type = genomic DNA
agccaggccaggggccgggggcatctctggggtcccaggtgagatgcgggtcgagggagccaggccacggttctccagactcgcgtggaggccacgagcgtcttctggaggagcgggcactgcgcggaccggcagactctggggcgctcaggctccccatctcctgaccttttcctaccttcagttccctcctgtcaggacaggttctggggctcgccggggcagggagccagggcagagggtgcagtttccgctcctgcctgagtcaccttcgctttctcagcgattcttcattcacaagggcgtggcccatcacacgcactcacacacttgtgaacttgcacgcacacacacatatggacctgtgcaaagagccccatgcacaggcaggtacacgtgcatgtaggcgtgcacacagacacgcacagatgcaggcagaccaactcccaggaatctgtctccagcctacagggattcagcactcagggtaccagcctctgtcccgtgcacccccattcccggcagttctcccaggtgggtcgggggccactagggaccccataccccgagggtggctcctc

SEQ ID NO: 97874 - DNA, 30 bp, Homo sapiens
  misc_feature 1..30: note = chr7:572406-572436
  misc_feature 1..30: note = hypo
  source 1..30: mol_type = genomic DNA
ggctaagtctgggctcgtgctgccccaggt

SEQ ID NO: 97875 - DNA, 167 bp, Homo sapiens
  misc_feature 1..167: note = chr7:57247720-57247887
  misc_feature 1..167: note = hypo
  source 1..167: mol_type = genomic DNA
agcacacagcaacagcggcccaaacgccgtgcaggccacacctgtccactaggtcacgctttccactccactgcttggccaccgtctgcagggctaagagcagtgcaggaggaggctgcggacaggtcgcatcaggtacctgagacgatccgcgccatctttgctga

SEQ ID NO: 97876 - DNA, 45 bp, Homo sapiens
  misc_feature 1..45: note = chr7:57259548-57259593
  misc_feature 1..45: note = hypo
  source 1..45: mol_type = genomic DNA
ctttggctttgaagccgtggcctgatattgacactttgtagatgt

SEQ ID NO: 97877 - DNA, 104 bp, Homo sapiens
  misc_feature 1..104: note = chr7:57259653-57259757
  misc_feature 1..104: note = hypo
  source 1..104: mol_type = genomic DNA
aacagtaccattgacttccaatcagtttcgacaacatccgaaaaagagtaattaacctgccctagcagtcaacaccctattagctctatcgctaatagttatta

SEQ ID NO: 97878 - DNA, 21 bp, Homo sapiens
  misc_feature 1..21: note = chr7:57655640-57655661
  misc_feature 1..21: note = hypo
  source 1..21: mol_type = genomic DNA
ccaccgcgcctggcccatata

SEQ ID NO: 97879 - DNA, 30 bp, Homo sapiens
  misc_feature 1..30: note = chr7:57832360-57832390
  misc_feature 1..30: note = hypo
  source 1..30: mol_type = genomic DNA
tgcccagaaggtgttcgggtgagtctcccc

SEQ ID NO: 97880 - DNA, 126 bp, Homo sapiens; identical to SEQ ID NO: 41036
  misc_feature 1..126: note = chr7:578922-579048
  misc_feature 1..126: note = hypo
  source 1..126: mol_type = genomic DNA

SEQ ID NO: 97881 - DNA, 17 bp, Homo sapiens
  misc_feature 1..17: note = chr7:57928223-57928240
  misc_feature 1..17: note = hyper
  source 1..17: mol_type = genomic DNA
accgggggaaaaagccg

SEQ ID NO: 97882 - DNA, 16 bp, Homo sapiens
  misc_feature 1..16: note = chr7:5862009-5862025
  misc_feature 1..16: note = hypo
  source 1..16: mol_type = genomic DNA
gcgcccaaccccaaaa

SEQ ID NO: 97883 - DNA, 30 bp, Homo sapiens
  misc_feature 1..30: note = chr7:5864832-5864862
  misc_feature 1..30: note = hypo
  source 1..30: mol_type = genomic DNA
cctaaatactgttgacgaccctttgtactc

SEQ ID NO: 97884 - DNA, 251 bp, Homo sapiens
  misc_feature 1..251: note = chr7:5896830-5897081
  misc_feature 1..251: note = hypo
  source 1..251: mol_type = genomic DNA
atggaggaaattacccgagcaagactaggggaaggaatcacacaatagaaacaggcagaataattccaaagtccacaaaaagctgggaaccgttcgtgtttccagcaggcaaagtgaaaaacctcataatacctggggcattgaatcaagtgttcagaggggcgttgccttcgtggtgcggcagaattggccctagactaagggttggtctagttctgcaagtctcaaaaggaccacgcatctgggtgcgg

SEQ ID NO: 97885 - DNA, 30 bp, Homo sapiens
  misc_feature 1..30: note = chr7:6060451-6060481
  misc_feature 1..30: note = hypo
  source 1..30: mol_type = genomic DNA
ccaggattgaaggcacgcagggctaagcta

SEQ ID NO: 97886 - DNA, 56 bp, Homo sapiens; identical to SEQ ID NO: 41180
  misc_feature 1..56: note = chr7:6060716-6060772
  misc_feature 1..56: note = hypo
  source 1..56: mol_type = genomic DNA

SEQ ID NO: 97887 - DNA, 147 bp, Homo sapiens
  misc_feature 1..147: note = chr7:6068145-6068292
  misc_feature 1..147: note = hypo
  source 1..147: mol_type = genomic DNA
gtgctgggattacaggcgtgagccactgcacccaaccctgtattgttatttaagactgcagaataagttgaatgaaagggcagaaagcaacaaatactaccttggcatcatactcagatccttccaactgttcgggtgaagcgtaca

SEQ ID NO: 97888 - DNA, 30 bp, Homo sapiens
  misc_feature 1..30: note = chr7:6068539-6068569
  misc_feature 1..30: note = hypo
  source 1..30: mol_type = genomic DNA
aaaacttactcttcccgtttctgttggtcc

SEQ ID NO: 97889 - DNA, 17 bp, Homo sapiens
  misc_feature 1..17: note = chr7:6099217-6099234
  misc_feature 1..17: note = hypo
  source 1..17: mol_type = genomic DNA
tatgccacaaaaaaacg

SEQ ID NO: 97890 - DNA, 94 bp, Homo sapiens; identical to SEQ ID NO: 41182
  misc_feature 1..94: note = chr7:6124620-6124714
  misc_feature 1..94: note = hypo
  source 1..94: mol_type = genomic DNA

SEQ ID NO: 97891 - DNA, 68 bp, Homo sapiens
  misc_feature 1..68: note = chr7:612677-612745
  misc_feature 1..68: note = hypo
  source 1..68: mol_type = genomic DNA
cctgtctgatgctgtcggtggccgccctggacgtgcggtccacagctggaaaccgcaataagctgcga

SEQ ID NO: 97892 - DNA, 33 bp, Homo sapiens
  misc_feature 1..33: note = chr7:6143243-6143276
  misc_feature 1..33: note = hypo
  source 1..33: mol_type = genomic DNA
gcatcaggtcttgggcggtggctccggagtgta

SEQ ID NO: 97893 - DNA, 30 bp, Homo sapiens
  misc_feature 1..30: note = chr7:6188726-6188756
  misc_feature 1..30: note = hypo
  source 1..30: mol_type = genomic DNA
aggagaatgtggagacgttgtggggcagtg

SEQ ID NO: 97894 - DNA, 32 bp, Homo sapiens
  misc_feature 1..32: note = chr7:6189029-6189061
  misc_feature 1..32: note = hypo
  source 1..32: mol_type = genomic DNA
cctgtggaaagtatgcgcgggtaggagggatt

SEQ ID NO: 97895 - DNA, 30 bp, Homo sapiens
  misc_feature 1..30: note = chr7:6203535-6203565
  misc_feature 1..30: note = hypo
  source 1..30: mol_type = genomic DNA
ctgacctgtatgaaacgctgccatgtgtgt

SEQ ID NO: 97896 - DNA, 64 bp, Homo sapiens; identical to SEQ ID NO: 41184
  misc_feature 1..64: note = chr7:6241990-6242054
  misc_feature 1..64: note = hypo
  source 1..64: mol_type = genomic DNA

SEQ ID NO: 97897 - DNA, 30 bp, Homo sapiens
  misc_feature 1..30: note = chr7:63020296-63020326
  misc_feature 1..30: note = hypo
  source 1..30: mol_type = genomic DNA
ggggttttagaggggcgatccggagaaggg

SEQ ID NO: 97898 - DNA, 24 bp, Homo sapiens
  misc_feature 1..24: note = chr7:63393338-63393362
  misc_feature 1..24: note = hypo
  source 1..24: mol_type = genomic DNA
gtgcctggccggtttggaagaaat

SEQ ID NO: 97899 - DNA, 30 bp, Homo sapiens
  misc_feature 1..30: note = chr7:63562154-63562184
  misc_feature 1..30: note = hypo
  source 1..30: mol_type = genomic DNA
cacaaaccgccttggcgattgatctgtcct

SEQ ID NO: 97900 - DNA, 46 bp, Homo sapiens
  misc_feature 1..46: note = chr7:63574716-63574762
  misc_feature 1..46: note = hypo
  source 1..46: mol_type = genomic DNA
cagcatcaacaagcacgaggatgcggacctgcgtttgtgctcctgg

SEQ ID NO: 97901 - DNA, 156 bp, Homo sapiens
  misc_feature 1..156: note = chr7:63652683-63652839
  misc_feature 1..156: note = hypo
  source 1..156: mol_type = genomic DNA
tggccaacacctccccggagctcctggagagcgaggcgaagaaagactcagccggcacaaggcaaaggttcagcgggttgagggttcaaggacacggaacgggtgcctgggtggaaagcggtcaccaggtgtgagtgtcaccgtggggccagtgcc

SEQ ID NO: 97902 - DNA, 180 bp, Homo sapiens
  misc_feature 1..180: note = chr7:63666583-63666763
  misc_feature 1..180: note = hypo
  source 1..180: mol_type = genomic DNA
acgagagagaaccgggaaggtggggaggggagatgtgccacatttttaaaccatcgggtatcttgagagctcccttattatcccaagaacaggatgaggataatccaccccaatgatccaatcacctcttacacagtccctaccgtgacacatgggaattacaattttttttttctttga

SEQ ID NO: 97903 - DNA, 30 bp, Homo sapiens
  misc_feature 1..30: note = chr7:63709605-63709635
  misc_feature 1..30: note = hypo
  source 1..30: mol_type = genomic DNA
ggacccaaacttcctcgcagtcagctccgg

SEQ ID NO: 97904 - DNA, 30 bp, Homo sapiens
  misc_feature 1..30: note = chr7:63767097-63767127
  misc_feature 1..30: note = hyper
  source 1..30: mol_type = genomic DNA
gcagcagggggtgagcgggcagcactgctt

SEQ ID NO: 97905 - DNA, 503 bp, Homo sapiens
  misc_feature 1..503: note = chr7:63767577-63768080
  misc_feature 1..503: note = hyper
  source 1..503: mol_type = genomic DNA
acaggcgaaaaccaccgcgccctgccgccctgccgccctgccgccctgcctctctttctaaagctatgcccaaaccccgagcccggagcatgccgggattgtagtcctgcagtcctgcaacctagggactgcgagaggttaagagactacatctctcagcatgtctagctaggcgcgcaccgccgtgtccccagggcttcgcaccgcccccagacttgcgcatgctgggattgtaatactgtcgccttgccaccaacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctcaacctgtgattgtgacatcacccctacctgaggaagcctcttccagcctgctcaaggttgccgtagttaggtttac

SEQ ID NO: 97906 - DNA, 30 bp, Homo sapiens
  misc_feature 1..30: note = chr7:63804386-63804416
  misc_feature 1..30: note = hypo
  source 1..30: mol_type = genomic DNA
aagaaatacaagggccgagcatggtggctc

SEQ ID NO: 97907 - DNA, 156 bp, Homo sapiens
  misc_feature 1..156: note = chr7:63813303-63813459
  misc_feature 1..156: note = hypo
  source 1..156: mol_type = genomic DNA
gtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtgg

SEQ ID NO: 97908 - DNA, 46 bp, Homo sapiens
  misc_feature 1..46: note = chr7:6386422-6386468
  misc_feature 1..46: note = hypo
  source 1..46: mol_type = genomic DNA
ttgatatggccaaaccgacgttagaaagggacggcacctgcagtgt

SEQ ID NO: 97909 - DNA, 40 bp, Homo sapiens
  misc_feature 1..40: note = chr7:63867671-63867711
  misc_feature 1..40: note = hypo
  source 1..40: mol_type = genomic DNA
ggccaagtgtgaggccggggcgtggcggctgatcccactg

SEQ ID NO: 97910 - DNA, 38 bp, Homo sapiens
  misc_feature 1..38: note = chr7:63931021-63931059
  misc_feature 1..38: note = hypo
  source 1..38: mol_type = genomic DNA
tgaagaatgtgtggccgggcacggtggctcacgcctgt

SEQ ID NO: 97911 - DNA, 111 bp, Homo sapiens
  misc_feature 1..111: note = chr7:64030481-64030592
  misc_feature 1..111: note = hyper
  source 1..111: mol_type = genomic DNA
aggtgtagaggccctcgtcgccgagccccacctcggtgacgaggatggagaactcctcgggggtgttgatgagcagccgcacccgcgggtccctggtcctgcggtcgttgc

SEQ ID NO: 97912 - DNA, 139 bp, Homo sapiens
  misc_feature 1..139: note = chr7:64030846-64030985
  misc_feature 1..139: note = hyper
  source 1..139: mol_type = genomic DNA
aagggggggccggtccggggcgcgcgaggcctggggggagaggggcaagggggagggggaagggggagggggaccccgcctgcggctgcaccggcccggggtcgggggagggggctggggggcgcgatccataattttt

SEQ ID NO: 97913 - DNA, 30 bp, Homo sapiens
  misc_feature 1..30: note = chr7:6431846-6431876
  misc_feature 1..30: note = hypo
  source 1..30: mol_type = genomic DNA
gttttgtgttttgagcgttaccagctgttc

SEQ ID NO: 97914 - DNA, 301 bp, Homo sapiens
  misc_feature 1..301: note = chr7:64330254-64330555
  misc_feature 1..301: note = hypo
  source 1..301: mol_type = genomic DNA
cgcctcctcctccagcgggatgaaccacggagacgccccaaagaggctgtactgtcgagacttctagggtcccacagtgggttgtcgcaggcagcctttttctttagatcagaccggctatgcccgtactattttcccctgcttaggcaggctgacatccctgacagctgggcgcccgagccggcctcgcgaatgcacatacgccagttgcggggcaccaggcacgagtggtgagctgcggctgtcgtcacagtgaacgccaccgttgcctggccacgggtccctgcggcttggcaaacca

SEQ ID NO: 97915 - DNA, 153 bp, Homo sapiens
  misc_feature 1..153: note = chr7:64337977-64338130
  misc_feature 1..153: note = hyper
  source 1..153: mol_type = genomic DNA
gccactgttgcctggcgacgggtccctgcgtcatggcggagaaggggacctctgtggacgtgcatcgccgttggactctcgcctgtcttctctgaaggatccatgggatagtcccgcgatcctagaagtgtgctggggcgacccagcctgaag

SEQ ID NO: 97916 - DNA, 30 bp, Homo sapiens
  misc_feature 1..30: note = chr7:64340264-64340294
  misc_feature 1..30: note = hypo
  source 1..30: mol_type = genomic DNA
gcaacgttgggggcccgcagtacttgttgc

SEQ ID NO: 97917 - DNA, 50 bp, Homo sapiens
  misc_feature 1..50: note = chr7:64345161-64345211
  misc_feature 1..50: note = hypo
  source 1..50: mol_type = genomic DNA
cccacctcacattctcgaatcgccttttcctccagcgggacccgactaat

SEQ ID NO: 97918 - DNA, 98 bp, Homo sapiens; identical to SEQ ID NO: 31301
  misc_feature 1..98: note = chr7:64349041-64349139
  misc_feature 1..98: note = hyper
  source 1..98: mol_type = genomic DNA

SEQ ID NO: 97919 - DNA, 55 bp, Homo sapiens
  misc_feature 1..55: note = chr7:64349409-64349464
  misc_feature 1..55: note = hyper
  source 1..55: mol_type = genomic DNA
ccacaaagcaggaagcgaagaacgtttctcctacctagagcgcagccgttttgcg

SEQ ID NO: 97920 - DNA, 36 bp, Homo sapiens
  misc_feature 1..36: note = chr7:64350000-64350036
  misc_feature 1..36: note = hyper
  source 1..36: mol_type = genomic DNA
ggggctgctgctgaccggagccgcctgggtctgttc

SEQ ID NO: 97921 - DNA, 78 bp, Homo sapiens
  misc_feature 1..78: note = chr7:64362694-64362772
  misc_feature 1..78: note = hypo
  source 1..78: mol_type = genomic DNA
agaagctaggaaggtcgtaaaatcggatattaaataatgttattatattttttccatttgttaatagccatataattg

SEQ ID NO: 97922 - DNA, 42 bp, Homo sapiens
  misc_feature 1..42: note = chr7:6438069-6438111
  misc_feature 1..42: note = hypo
  source 1..42: mol_type = genomic DNA
ctctgtcttcaccatcgttgaacttaacgcctgcttttgacc

SEQ ID NO: 97923 - DNA, 454 bp, Homo sapiens
  misc_feature 1..454: note = chr7:64407780-64408234
  misc_feature 1..454: note = hyper
  source 1..454: mol_type = genomic DNA
cgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgca

SEQ ID NO: 97924 - DNA, 17 bp, Homo sapiens
  misc_feature 1..17: note = chr7:64416654-64416671
  misc_feature 1..17: note = hypo
  source 1..17: mol_type = genomic DNA
gccgccagtgggctctt

SEQ ID NO: 97925 - DNA, 196 bp, Homo sapiens
  misc_feature 1..196: note = chr7:6443279-6443475
  misc_feature 1..196: note = hypo
  source 1..196: mol_type = genomic DNA
gtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcag

SEQ ID NO: 97926 - DNA, 30 bp, Homo sapiens
  misc_feature 1..30: note = chr7:6443689-6443719
  misc_feature 1..30: note = hypo
  source 1..30: mol_type = genomic DNA
cagtcattttcaatgcgtgtctccacacag

SEQ ID NO: 97927 - DNA, 34 bp, Homo sapiens; identical to SEQ ID NO: 41186
  misc_feature 1..34: note = chr7:6443956-6443990
  misc_feature 1..34: note = hypo
  source 1..34: mol_type = genomic DNA

SEQ ID NO: 97928 - DNA, 93 bp, Homo sapiens; identical to SEQ ID NO: 41187
  misc_feature 1..93: note = chr7:6444050-6444143
  misc_feature 1..93: note = hypo
  source 1..93: mol_type = genomic DNA

SEQ ID NO: 97929 - DNA, 29 bp, Homo sapiens
  misc_feature 1..29: note = chr7:64450761-64450790
  misc_feature 1..29: note = hypo
  source 1..29: mol_type = genomic DNA
tggccactggcccagcggattaacatcca

SEQ ID NO: 97930 - DNA, 131 bp, Homo sapiens
  misc_feature 1..131: note = chr7:64458258-64458389
  misc_feature 1..131: note = hypo
  source 1..131: mol_type = genomic DNA
ctggtaaataaaagtcggttgcccccccttgaacctgcccctgttcatcataatagataggtccccgtgtttcacggaggggcatctgccacactctggtgtggccaggtcgaaggcggcctgcttgatca

SEQ ID NO: 97931 - DNA, 79 bp, Homo sapiens
  misc_feature 1..79: note = chr7:64459087-64459166
  misc_feature 1..79: note = hypo
  source 1..79: mol_type = genomic DNA
tatgagtcctgaacccggaccaccacaatctataagttgtggggcacctccctaagccatatgccgtagccccaaagga

SEQ ID NO: 97932 - DNA, 39 bp, Homo sapiens
  misc_feature 1..39: note = chr7:64540683-64540722
  misc_feature 1..39: note = hypo
  source 1..39: mol_type = genomic DNA
caggcgtgagccaccatgcccagccgaaaatccatttta

SEQ ID NO: 97933 - DNA, 62 bp, Homo sapiens
  misc_feature 1..62: note = chr7:6456254-6456316
  misc_feature 1..62: note = hypo
  source 1..62: mol_type = genomic DNA
cacctccacagcccccggggtggggagaaggcgtagcacctgacctgcgggtaggcggctct

SEQ ID NO: 97934 - DNA, 428 bp, Homo sapiens
  misc_feature 1..428: note = chr7:64700283-64700711
  misc_feature 1..428: note = hyper
  source 1..428: mol_type = genomic DNA
ggtgggcaaagagggcggctccttacgtaggcgggcagagacagaagctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtctcctctcttaggagccttgacatggccctcttgacgggtggttggggga

SEQ ID NO: 97935 - DNA, 806 bp, Homo sapiens
  misc_feature 1..806: note = chr7:64712198-64713004
  misc_feature 1..806: note = hyper
  source 1..806: mol_type = genomic DNA
tgctgccttaagtcccgctgtccctgtcacccgtgttcccgtggctctgggcccctgccacgccaggcgtgctcttctgtttctggctgtcccaccggcgatgctgcgcttccacaccacccggcgcacaggcgttggtagatgtggaaggtaccaagagcggcaggaggaaggggcgcgcggacacccagccccttcccgcgcacccagagcaggaagagcagcgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 97936 - DNA, 642 bp, Homo sapiens
  misc_feature 1..642: note = chr7:64734196-64734838
  misc_feature 1..642: note = hyper
  source 1..642: mol_type = genomic DNA
tgtcagagtaggaaccgtcctatcaggcacgcagttggggaggagggcgtggcttccagcgtttggcgcggcctttgtctctggctcaggccggagcctgagatccatctctactgtcccgcgtgttgcccctcgggagcactaggtgactttgtcacatcctctgttgccctgagatctggaggtactgggaaatgcatagctaagatgccaggacatcctggaaaccaggaaatggtgagtacgcggggttgggcatcccaagaggggagagtgggctggttgaaaccagcggaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccagattgttcagggatgacagagggtcattagagcagaatcccgactcggtgggtgcgtgggaggagctgcggccagtggggtccccagtgtctcctgttaaaaaaatttttttttgagatgaagtctcgctgtcac

SEQ ID NO: 97937 - DNA, 22 bp, Homo sapiens
  misc_feature 1..22: note = chr7:64824069-64824091
  misc_feature 1..22: note = hypo
  source 1..22: mol_type = genomic DNA
ccgcacccggcaataaacactt

SEQ ID NO: 97938 - DNA, 180 bp, Homo sapiens
  misc_feature 1..180: note = chr7:64974268-64974448
  misc_feature 1..180: note = hyper
  source 1..180: mol_type = genomic DNA
gtcgggggctaaaagccgcaaaaagccgcggaggggggagcgaaaagcagtgggagctggggcaaaaaaccacaaaaagccgaggcagcggcggcagaaaacctcggcagcgggggcaaaaagctgcagcggcaaaaagcggcgacgggggcaaaaagccgcggtggcaaaaatgcgcgg

SEQ ID NO: 97939 - DNA, 480 bp, Homo sapiens
  misc_feature 1..480: note = chr7:64974508-64974988
  misc_feature 1..480: note = hyper
  source 1..480: mol_type = genomic DNA
accacaaaaagccgcggcagcggcggcagaaaacctcggcagcgggggcaaaaagccacggtggcgggggtaaaaagcagcggtggcaagaagccgcgacggtgggggcaagaagccgcggcggcccaggcaaaaggccgcaaaagccgcggcgacgggggcgaaaagccgcggcggcggaggcaaaaagccgcgacggcagggggcaaaaagctgcaaaagcctcggtgcgggtgaaaaaagtcgcggcgagaaaaagccgctgaggcgggggcaaaaagccgcggcggcaggggcgaaaaccagcaaaaagccgccgcggtgggggcaaaaagcagtgggagctggggtaaaaaaccacaaaaaaccgcggcagcggcggcagcaagccacggcggcgggggcaaaaagccgcggcggcaaaaacccggggtggcaaaaagccgcggcgccgggggacgaaaagcttcaaaggccgct

SEQ ID NO: 97940 - DNA, 264 bp, Homo sapiens
  misc_feature 1..264: note = chr7:6499118-6499382
  misc_feature 1..264: note = hypo
  source 1..264: mol_type = genomic DNA
atatgtactatgttacgctgcaaatggcttttaaagtgcagggacaaaaggaattgtttcaaaactggagaaacacccacagcacttccagcagattccaggctacagattccagttaacccagatagttgtgaggatggctgggtggtacgaggacagaggcacacagaaaacacccacgcagatccaatcaagctagcctcagatgggtggctgcttttggaaggtaccaaggagtcaatttctttcttttttttttttttt

SEQ ID NO: 97941 - DNA, 30 bp, Homo sapiens
  misc_feature 1..30: note = chr7:6501094-6501124
  misc_feature 1..30: note = hypo
  source 1..30: mol_type = genomic DNA
cctccttccacactccgaatcttcaagcag

SEQ ID NO: 97942 - DNA, 102 bp, Homo sapiens; identical to SEQ ID NO: 31309
  misc_feature 1..102: note = chr7:65037609-65037711
  misc_feature 1..102: note = hyper
  source 1..102: mol_type = genomic DNA

SEQ ID NO: 97943 - DNA, 23 bp, Homo sapiens
  misc_feature 1..23: note = chr7:65234809-65234832
  misc_feature 1..23: note = hypo
  source 1..23: mol_type = genomic DNA
attacaggcgtgagccaccatgc

SEQ ID NO: 97944 - DNA, 78 bp, Homo sapiens
  misc_feature 1..78: note = chr7:65236247-65236325
  misc_feature 1..78: note = hypo
  source 1..78: mol_type = genomic DNA
atccaagtgtacaaccgggagggactgcttaaagaacacatgaggctccctgggccgtgctatcccggcactttggga

SEQ ID NO: 97945 - DNA, 38 bp, Homo sapiens; identical to SEQ ID NO: 41189
  misc_feature 1..38: note = chr7:6524573-6524611
  misc_feature 1..38: note = hypo
  source 1..38: mol_type = genomic DNA

SEQ ID NO: 97946 - DNA, 180 bp, Homo sapiens; identical to SEQ ID NO: 41190
  misc_feature 1..180: note = chr7:6524911-6525091
  misc_feature 1..180: note = hypo
  source 1..180: mol_type = genomic DNA

SEQ ID NO: 97947 - DNA, 189 bp, Homo sapiens
  misc_feature 1..189: note = chr7:6543051-6543240
  misc_feature 1..189: note = hyper
  source 1..189: mol_type = genomic DNA
cagccctggccacagcgacagcccctgtggagccggccgaggcctcggggcggggttgtggtcgcggcacctgcaggacgaactggtccggctcgctgaggcggccgggcgcctcgcggaaggcctggtagcgctgctcctcgtcggcgtcgggcgcgaagagcagcagctgcgcgagatgtgcgggct

SEQ ID NO: 97948 - DNA, 30 bp, Homo sapiens
  misc_feature 1..30: note = chr7:65441788-65441818
  misc_feature 1..30: note = hypo
  source 1..30: mol_type = genomic DNA
gcgtgcttgcagccccggcagccccagcta

SEQ ID NO: 97949 - DNA, 91 bp, Homo sapiens
  misc_feature 1..91: note = chr7:65446021-65446112
  misc_feature 1..91: note = hyper
  source 1..91: mol_type = genomic DNA
actgtcaccttctcccgatccccgggcccagctctgtgcagtgcatgccgctgtggccagagtgtgtgggtggctcatgccagtaatcagc

SEQ ID NO: 97950 - DNA, 311 bp, Homo sapiens
  misc_feature 1..311: note = chr7:6545692-6546003
  misc_feature 1..311: note = hypo
  source 1..311: mol_type = genomic DNA
agaagccagatcatccgagtcaccgggtgctgagccagcgcctcctggggtcaatcgagactcaagacttggaacactactcgtgcagaagccagcaaggtgggactgcagcgggggcatgaaggagctgtgaagaggctagagccaagtaaggggctaccggaggtggctcaggggtctggctctgtcatcaggtctccttggagagcggtgagttcaccagggctgccctgggcagagtgagctggtgctgagagaactgcaactgtgacagcctaggggccagacgctggacacgtggctgtgatgaa

SEQ ID NO: 97951 - DNA, 139 bp, Homo sapiens
  misc_feature 1..139: note = chr7:65508904-65509043
  misc_feature 1..139: note = hyper
  source 1..139: mol_type = genomic DNA
tacctggacctgattcgtctctcctccacctactttcagggcggacagactcaggcctttacagcctgctaagtcccgggtcggataccaggctgggctccacccccgcactgtgacccagaaacgctggtaaatgaat

SEQ ID NO: 97952 - DNA, 30 bp, Homo sapiens
  misc_feature 1..30: note = chr7:65509512-65509542
  misc_feature 1..30: note = hyper
  source 1..30: mol_type = genomic DNA
tggggggggtgggggcgtgttcctgtatcc

SEQ ID NO: 97953 - DNA, 43 bp, Homo sapiens
  misc_feature 1..43: note = chr7:65553975-65554018
  misc_feature 1..43: note = hypo
  source 1..43: mol_type = genomic DNA
ggctgccttcctccccgtcccacccctccgccagacctggcca

SEQ ID NO: 97954 - DNA, 30 bp, Homo sapiens
  misc_feature 1..30: note = chr7:65554426-65554456
  misc_feature 1..30: note = hypo
  source 1..30: mol_type = genomic DNA
gcacacagctccatccgtggctgcccttga

SEQ ID NO: 97955 - DNA, 62 bp, Homo sapiens
  misc_feature 1..62: note = chr7:65575903-65575965
  misc_feature 1..62: note = hypo
  source 1..62: mol_type = genomic DNA
ccaatccctcggcctcgtgtgcttttccctcacccacttcaaaggcccgtggctttgggacg

SEQ ID NO: 97956 - DNA, 228 bp, Homo sapiens; identical to SEQ ID NO: 41192
  misc_feature 1..228: note = chr7:6560173-6560401
  misc_feature 1..228: note = hypo
  source 1..228: mol_type = genomic DNA

SEQ ID NO: 97957 - DNA, 185 bp, Homo sapiens
  misc_feature 1..185: note = chr7:6566051-6566236
  misc_feature 1..185: note = hyper
  source 1..185: mol_type = genomic DNA
ccagatgcccagccccgcccctacgccctctccccgggtctcggtcccgagcccacccgcagggaggcgcccgctgccagtgcctgtgagccccgcgtacctgcgcgcgcccccggggccggcgaggccgcccaccagcaaggaggccctgcgcgggggcggctcatcggggcggcgcggcgggg

SEQ ID NO: 97958 - DNA, 448 bp, Homo sapiens
  misc_feature 1..448: note = chr7:6566246-6566694
  misc_feature 1..448: note = hyper
  source 1..448: mol_type = genomic DNA
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagtctccccctcgctgctcggatttgcgcccccagctaggacttggcgtcctgctcgcttcacctcgggaatggcccgttcggaccgtcctccatgactctggccactgcagggcccgagcccctcaaagc

SEQ ID NO: 97959 - DNA, 409 bp, Homo sapiens; identical to SEQ ID NO: 31035
  misc_feature 1..409: note = chr7:6570454-6570863
  misc_feature 1..409: note = hyper
  source 1..409: mol_type = genomic DNA

SEQ ID NO: 97960 - DNA, 309 bp, Homo sapiens
  misc_feature 1..309: note = chr7:6570900-6571209
  misc_feature 1..309: note = hyper
  source 1..309: mol_type = genomic DNA
cgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagggctcagcaggagtcggccggctagaagaagcc

SEQ ID NO: 97961 - DNA, 64 bp, Homo sapiens
  misc_feature 1..64: note = chr7:6576033-6576097
  misc_feature 1..64: note = hyper
  source 1..64: mol_type = genomic DNA
gggggttccccctcccgcgccctgcccgacccgctgccgcagctgccggcggcttggggaccag

SEQ ID NO: 97962 - DNA, 22 bp, Homo sapiens
  misc_feature 1..22: note = chr7:65877882-65877904
  misc_feature 1..22: note = hypo
  source 1..22: mol_type = genomic DNA
tccgtctcgggggggaaaaaaa

SEQ ID NO: 97963 - DNA, 22 bp, Homo sapiens
  misc_feature 1..22: note = chr7:65879595-65879617
  misc_feature 1..22: note = hypo
  source 1..22: mol_type = genomic DNA
gtaaagtaattgggccggcccc

SEQ ID NO: 97964 - DNA, 81 bp, Homo sapiens; identical to SEQ ID NO: 41342
  misc_feature 1..81: note = chr7:65880043-65880124
  misc_feature 1..81: note = hypo
  source 1..81: mol_type = genomic DNA

SEQ ID NO: 97965 - DNA, 77 bp, Homo sapiens
  misc_feature 1..77: note = chr7:65969578-65969655
  misc_feature 1..77: note = hypo
  source 1..77: mol_type = genomic DNA
tgtgaagaggagaggcgcactgggcgtcaataactttaaaaaggggggaaaatatcagttcccgagtctccatgcgt

SEQ ID NO: 97966 - DNA, 30 bp, Homo sapiens
  misc_feature 1..30: note = chr7:65973031-65973061
  misc_feature 1..30: note = hypo
  source 1..30: mol_type = genomic DNA
accagacacgtaccccgcagagaactcaca

SEQ ID NO: 97967 - DNA, 17 bp, Homo sapiens
  misc_feature 1..17: note = chr7:66105665-66105682
  misc_feature 1..17: note = hypo
  source 1..17: mol_type = genomic DNA
gtagtccaggccactcg

SEQ ID NO: 97968 - DNA, 196 bp, Homo sapiens
  misc_feature 1..196: note = chr7:66105802-66105998
  misc_feature 1..196: note = hypo
  source 1..196: mol_type = genomic DNA
gggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcct

SEQ ID NO: 97969 - DNA, 30 bp, Homo sapiens
  misc_feature 1..30: note = chr7:66150814-66150844
  misc_feature 1..30: note = hypo
  source 1..30: mol_type = genomic DNA
gtttaatttctggcacgtggggttttattg

SEQ ID NO: 97970 - DNA, 97 bp, Homo sapiens
  misc_feature 1..97: note = chr7:66215014-66215111
  misc_feature 1..97: note = hypo
  source 1..97: mol_type = genomic DNA
ataactggtgtctcacgagataatacgtttgggtcctgtttagcaagttggattatatttttatttgtgtaaatttattggccgttgcagttggggt

SEQ ID NO: 97971 - DNA, 30 bp, Homo sapiens
  misc_feature 1..30: note = chr7:66293248-66293278
  misc_feature 1..30: note = hypo
  source 1..30: mol_type = genomic DNA
aggtgtgagccaccgcgcctggcttccacg

SEQ ID NO: 97972 - DNA, 400 bp, Homo sapiens
  misc_feature 1..400: note = chr7:6654761-6655161
  misc_feature 1..400: note = hyper
  source 1..400: mol_type = genomic DNA
ggcctctccagggcccgctcgggccgggcccggatggcgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagcccaccgagctgcggctgcctagagcggcggcggcgacggcggcggcggcggcgggggccggggcgc

SEQ ID NO: 97973 - DNA, 30 bp, Homo sapiens; identical to SEQ ID NO: 31039
  misc_feature 1..30: note = chr7:6655418-6655448
  misc_feature 1..30: note = hyper
  source 1..30: mol_type = genomic DNA

SEQ ID NO: 97974 - DNA, 186 bp, Homo sapiens
  misc_feature 1..186: note = chr7:6655668-6655854
  misc_feature 1..186: note = hyper
  source 1..186: mol_type = genomic DNA
cccggggtggccctgcgcctcctggctctttctggatggaggcgcctccggaaggagccggctgcacgccgtggccttcacctcgcagcctctgctgaccacacctccctagcgcagaggctgcccgggagcaggaaatgctccaccaggtgaggcccagggggtcgttggcgctgggcaaccggg

SEQ ID NO: 97975 - DNA, 30 bp, Homo sapiens
  misc_feature 1..30: note = chr7:67033662-67033692
  misc_feature 1..30: note = hypo
  source 1..30: mol_type = genomic DNA
aaagggtcccagacccggaccccaagagag

SEQ ID NO: 97976 - DNA, 220 bp, Homo sapiens
  misc_feature 1..220: note = chr7:6703488-6703708
  misc_feature 1..220: note = hyper
  source 1..220: mol_type = genomic DNA
agaaggtgtgccaggcgatggagggggtcggcgggggcggggcccgcactgtccccgccccatgtgggtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 97977 - DNA, 94 bp, Homo sapiens; identical to SEQ ID NO: 8858
  misc_feature 1..94: note = chr7:6703709-6703803
  misc_feature 1..94: note = hyper
  source 1..94: mol_type = genomic DNA

SEQ ID NO: 97978 - DNA, 66 bp, Homo sapiens; identical to SEQ ID NO: 8859
  misc_feature 1..66: note = chr7:6703804-6703870
  misc_feature 1..66: note = hyper
  source 1..66: mol_type = genomic DNA

SEQ ID NO: 97979 - DNA, 173 bp, Homo sapiens; identical to SEQ ID NO: 8860
  misc_feature 1..173: note = chr7:6703915-6704088
  misc_feature 1..173: note = hyper
  source 1..173: mol_type = genomic DNA

SEQ ID NO: 97980 - DNA, 40 bp, Homo sapiens; identical to SEQ ID NO: 41345
  misc_feature 1..40: note = chr7:67161739-67161779
  misc_feature 1..40: note = hypo
  source 1..40: mol_type = genomic DNA

SEQ ID NO: 97981 - DNA, 38 bp, Homo sapiens
  misc_feature 1..38: note = chr7:67478598-67478636
  misc_feature 1..38: note = hypo
  source 1..38: mol_type = genomic DNA
ctttgcagcactcagcgggcctgcgctgggacccaata

SEQ ID NO: 97982 - DNA, 17 bp, Homo sapiens
  misc_feature 1..17: note = chr7:67478991-67479008
  misc_feature 1..17: note = hypo
  source 1..17: mol_type = genomic DNA
gccggtatagggattgt

SEQ ID NO: 97983 - DNA, 30 bp, Homo sapiens
  misc_feature 1..30: note = chr7:67665226-67665256
  misc_feature 1..30: note = hypo
  source 1..30: mol_type = genomic DNA
ttcagtcatccatcacgcaggcccttccat

SEQ ID NO: 97984 - DNA, 120 bp, Homo sapiens
  misc_feature 1..120: note = chr7:68000314-68000434
  misc_feature 1..120: note = hypo
  source 1..120: mol_type = genomic DNA
cagctgctggcggaggtgctaagcccctccctgccagggctggcggggctggctggtggctccgactgtggggccctctgagcccacgcccacccgaaacttgtgctggcccgcaagcgc

SEQ ID NO: 97985 - DNA, 30 bp, Homo sapiens
  misc_feature 1..30: note = chr7:68149438-68149468
  misc_feature 1..30: note = hypo
  source 1..30: mol_type = genomic DNA
cagcacctgcctagccggcagatggctgcg

SEQ ID NO: 97986 - DNA, 30 bp, Homo sapiens
  misc_feature 1..30: note = chr7:68150297-68150327
  misc_feature 1..30: note = hypo
  source 1..30: mol_type = genomic DNA
accctctgattggcccgctttccttgaaca

SEQ ID NO: 97987 - DNA, 159 bp, Homo sapiens
  misc_feature 1..159: note = chr7:68191278-68191437
  misc_feature 1..159: note = hypo
  source 1..159: mol_type = genomic DNA
cgaataacgggacttcgcagggaggtccagagggaataaagatttacctaacaatttatgtcgctcttgacatgccatgcttttttccttgcccaggagtccgatagcacaaatacatgccttgccatgaaaaattcacaaccgcgcattagtcagata

SEQ ID NO: 97988 - DNA, 206 bp, Homo sapiens
  misc_feature 1..206: note = chr7:68204758-68204964
  misc_feature 1..206: note = hypo
  source 1..206: mol_type = genomic DNA
ttcagaagtgactttcgaggaaatttggtcccgttcccaagcaataaagccgtcgcatcataatcagcttagaacaatttgccaatgatagttttctgtgttgcgccatcagagattctgattcagcaagtcctcgttggatctcatacatctcaattaaaaatcaacaatagatcgggcgtggtggctcacgcctgtctgtcatc

SEQ ID NO: 97989 - DNA, 20 bp, Homo sapiens
  misc_feature 1..20: note = chr7:68237178-68237198
  misc_feature 1..20: note = hypo
  source 1..20: mol_type = genomic DNA
gactccgtctcaaaaaaaaa

SEQ ID NO: 97990 - DNA, 185 bp, Homo sapiens
  misc_feature 1..185: note = chr7:68238305-68238490
  misc_feature 1..185: note = hypo
  source 1..185: mol_type = genomic DNA
gcctcgacaagacagcgcaggtctgcaggagttcaagggttgtatgaatggcagatttcaatactttatgacaaagaagattcggtgactctaggaagatgcccaggaggtgttttcccctgcccaatctagtctcagggataaacaaggacacagaggaaaggtgggaacggctgcagaaggaa

SEQ ID NO: 97991 - DNA, 32 bp, Homo sapiens
  misc_feature 1..32: note = chr7:68358134-68358166
  misc_feature 1..32: note = hypo
  source 1..32: mol_type = genomic DNA
ttagaggcatgagccaccgcactccacccctt

SEQ ID NO: 97992 - DNA, 33 bp, Homo sapiens
  misc_feature 1..33: note = chr7:68527746-68527779
  misc_feature 1..33: note = hypo
  source 1..33: mol_type = genomic DNA
gtcggccttgcgggccgccggtgaactaccact

SEQ ID NO: 97993 - DNA, 30 bp, Homo sapiens
  misc_feature 1..30: note = chr7:68904116-68904146
  misc_feature 1..30: note = hypo
  source 1..30: mol_type = genomic DNA
tcagcatcggcttctcggagcctgttcata

SEQ ID NO: 97994 - DNA, 27 bp, Homo sapiens
  misc_feature 1..27: note = chr7:68982718-68982745
  misc_feature 1..27: note = hypo
  source 1..27: mol_type = genomic DNA
tgtgagccaccgcgcctggccattgct

SEQ ID NO: 97995 - DNA, 30 bp, Homo sapiens
  misc_feature 1..30: note = chr7:69033875-69033905
  misc_feature 1..30: note = hypo
  source 1..30: mol_type = genomic DNA
cgcagtaaaaaaacccgaagctggaattga

SEQ ID NO: 97996 - DNA, 42 bp, Homo sapiens; identical to SEQ ID NO: 15004
  misc_feature 1..42: note = chr7:69036110-69036152
  misc_feature 1..42: note = hypo
  source 1..42: mol_type = genomic DNA

SEQ ID NO: 97997 - DNA, 140 bp, Homo sapiens
  misc_feature 1..140: note = chr7:69048212-69048352
  misc_feature 1..140: note = hypo
  source 1..140: mol_type = genomic DNA
cactgtcaccagtttcgctgaagtcctgaatctccttgctactgatagacacgcatgtgacagtgggtttagtggggacaaatagcttgggcttcaatatggattaaacaatagcaacacaatagcagaaatccattcct

SEQ ID NO: 97998 - DNA, 679 bp, Homo sapiens
  misc_feature 1..679: note = chr7:69062359-69063038
  misc_feature 1..679: note = hyper
  source 1..679: mol_type = genomic DNA
aaagtaaaggaagcccgcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggcgccccctc

SEQ ID NO: 97999 - DNA, 93 bp, Homo sapiens
  misc_feature 1..93: note = chr7:69063459-69063552
  misc_feature 1..93: note = hyper
  source 1..93: mol_type = genomic DNA
cagtgcccgggctcccgctgcagccgcccggggacacgccgtgcaccctccggctcggggctttctcggcggcggcggcggcagcagcagcag

SEQ ID NO: 98000 - DNA, 30 bp, Homo sapiens
  misc_feature 1..30: note = chr7:69063870-69063900
  misc_feature 1..30: note = hyper
  source 1..30: mol_type = genomic DNA
ctccttcccttcctccgcctcccttctcct

SEQ ID NO: 98001 - DNA, 590 bp, Homo sapiens
  misc_feature 1..590: note = chr7:69064182-69064772
  misc_feature 1..590: note = hyper
  source 1..590: mol_type = genomic DNA
tcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccggg

SEQ ID NO: 98002 - DNA, 328 bp, Homo sapiens; identical to SEQ ID NO: 31314
  misc_feature 1..328: note = chr7:69064833-69065161
  misc_feature 1..328: note = hyper
  source 1..328: mol_type = genomic DNA

SEQ ID NO: 98003 - DNA, 16 bp, Homo sapiens
  misc_feature 1..16: note = chr7:69092470-69092486
  misc_feature 1..16: note = hypo
  source 1..16: mol_type = genomic DNA
ccgtctcaaaaaaacc

SEQ ID NO: 98004 - DNA, 30 bp, Homo sapiens
  misc_feature 1..30: note = chr7:69206297-69206327
  misc_feature 1..30: note = hypo
  source 1..30: mol_type = genomic DNA
aactccaccccacctcgaaccccgatttgg

SEQ ID NO: 98005 - DNA, 30 bp, Homo sapiens
  misc_feature 1..30: note = chr7:69217444-69217474
  misc_feature 1..30: note = hypo
  source 1..30: mol_type = genomic DNA
ttctgaaccagatgccgtgaataactgccc

SEQ ID NO: 98006 - DNA, 215 bp, Homo sapiens
  misc_feature 1..215: note = chr7:69313658-69313873
  misc_feature 1..215: note = hypo
  source 1..215: mol_type = genomic DNA
tacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttc

SEQ ID NO: 98007 - DNA, 86 bp, Homo sapiens
  misc_feature 1..86: note = chr7:69499763-69499849
  misc_feature 1..86: note = hypo
  source 1..86: mol_type = genomic DNA
attggtagttgagcacgtcttgagtgtgagtgtcatactcagaacaattctaattttttaaaaattacttttttagaggctgtctc

SEQ ID NO: 98008 - DNA, 25 bp, Homo sapiens
  misc_feature 1..25: note = chr7:69499909-69499934
  misc_feature 1..25: note = hypo
  source 1..25: mol_type = genomic DNA
tgggcccaagcgatcctctcacctt

SEQ ID NO: 98009 - DNA, 30 bp, Homo sapiens
  misc_feature 1..30: note = chr7:69510019-69510049
  misc_feature 1..30: note = hypo
  source 1..30: mol_type = genomic DNA
tattctgcttggacacgctagacttgtgaa

SEQ ID NO: 98010 - DNA, 48 bp, Homo sapiens
  misc_feature 1..48: note = chr7:6966936-6966984
  misc_feature 1..48: note = hypo
  source 1..48: mol_type = genomic DNA
tgggaggtacagggacgatgtgtcaaacagcgtcgcttctcccagtga

SEQ ID NO: 98011 - DNA, 146 bp, Homo sapiens
  misc_feature 1..146: note = chr7:69696309-69696455
  misc_feature 1..146: note = hypo
  source 1..146: mol_type = genomic DNA
gacatgtccagcacccgttaatctttccttcctagccttctagtttcatcccagagttaaccactgtcctgacctctgtcattacagattactttttgtaatctgtgtggtttttttgttttttgttttttgtttttgagacagag

SEQ ID NO: 98012 - DNA, 30 bp, Homo sapiens; identical to SEQ ID NO: 41352
  misc_feature 1..30: note = chr7:69698849-69698879
  misc_feature 1..30: note = hypo
  source 1..30: mol_type = genomic DNA

SEQ ID NO: 98013 - DNA, 136 bp, Homo sapiens
  misc_feature 1..136: note = chr7:69745578-69745714
  misc_feature 1..136: note = hypo
  source 1..136: mol_type = genomic DNA
gccaaataagggaaactttttagaggatctttggcttcagtcatggagaaaaagaagaaactataaacacttggaggtctgaacagttcattgattgttaagaacccaaacaaaaacactccgtccccaaccccga

SEQ ID NO: 98014 - DNA, 227 bp, Homo sapiens
  misc_feature 1..227: note = chr7:69897720-69897947
  misc_feature 1..227: note = hypo
  source 1..227: mol_type = genomic DNA
gggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcact

SEQ ID NO: 98015 - DNA, 134 bp, Homo sapiens
  misc_feature 1..134: note = chr7:70061015-70061149
  misc_feature 1..134: note = hyper
  source 1..134: mol_type = genomic DNA
gcaggtgacctcccccgggcccgggaataaattgtcaagtttccccaccgtgggtgtctttgctagccggcgagttgcagtcttctgagctaattaggagacggtcatgaggagcgaggcgggccggggcgctc

SEQ ID NO: 98016 - DNA, 141 bp, Homo sapiens
  misc_feature 1..141: note = chr7:7019112-7019253
  misc_feature 1..141: note = hypo
  source 1..141: mol_type = genomic DNA
ccttgacgccctcctcggccagatggtccaggttgggggtgtccacatcctcatcctagttccagcggaagccctggaaggtgatcagcagcagctgtgagtgctcttcttccctgggacggggtggccacccagtaggac

SEQ ID NO: 98017 - DNA, 30 bp, Homo sapiens
  misc_feature 1..30: note = chr7:70311103-70311133
  misc_feature 1..30: note = hypo
  source 1..30: mol_type = genomic DNA
aaaaaaaaaacaaaacggctgtacctccct

SEQ ID NO: 98018 - DNA, 269 bp, Homo sapiens; identical to SEQ ID NO: 31315
  misc_feature 1..269: note = chr7:70596147-70596416
  misc_feature 1..269: note = hyper
  source 1..269: mol_type = genomic DNA

SEQ ID NO: 98019 - DNA, 258 bp, Homo sapiens; identical to SEQ ID NO: 31316
  misc_feature 1..258: note = chr7:70596453-70596711
  misc_feature 1..258: note = hyper
  source 1..258: mol_type = genomic DNA

SEQ ID NO: 98020 - DNA, 168 bp, Homo sapiens
  misc_feature 1..168: note = chr7:70597490-70597658
  misc_feature 1..168: note = hyper
  source 1..168: mol_type = genomic DNA
aaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgagg

SEQ ID NO: 98021 - DNA, 134 bp, Homo sapiens
  misc_feature 1..134: note = chr7:70597990-70598124
  misc_feature 1..134: note = hyper
  source 1..134: mol_type = genomic DNA
cgctgctggaggacatcgtgtaccggcagctgaatggtaaggacgcacgccggcgcctccggggctcgacgcgggcgggccgggcacagggtgagccccagggtccttgcgcgctgcgccctgtgcctgggagc

SEQ ID NO: 98022 - DNA, 346 bp, Homo sapiens; identical to SEQ ID NO: 31318
  misc_feature 1..346: note = chr7:70598169-70598515
  misc_feature 1..346: note = hyper
  source 1..346: mol_type = genomic DNA

SEQ ID NO: 98023 - DNA, 30 bp, Homo sapiens
  misc_feature 1..30: note = chr7:70699941-70699971
  misc_feature 1..30: note = hypo
  source 1..30: mol_type = genomic DNA
gttcggtctgttcagcggggcgcggtggct

SEQ ID NO: 98024 - DNA, 39 bp, Homo sapiens
  misc_feature 1..39: note = chr7:70728615-70728654
  misc_feature 1..39: note = hypo
  source 1..39: mol_type = genomic DNA
cctcagtgatctggccgggagcggtggctcatgcctgta

SEQ ID NO: 98025 - DNA, 30 bp, Homo sapiens
  misc_feature 1..30: note = chr7:70802549-70802579
  misc_feature 1..30: note = hypo
  source 1..30: mol_type = genomic DNA
ttgccttttaaaaagcgtgaggctggcagg

SEQ ID NO: 98026 - DNA, 138 bp, Homo sapiens
  misc_feature 1..138: note = chr7:70840301-70840439
  misc_feature 1..138: note = hypo
  source 1..138: mol_type = genomic DNA
tcatttctctgctgacgttgcagggtaacaacttttaggaccagtttggagctctgtaaagggccaaagaggttggagggtgagacattgagtgagagcaaagggttttatggccttcagagatggtctcgctctgtt

SEQ ID NO: 98027 - DNA, 97 bp, Homo sapiens
  misc_feature 1..97: note = chr7:7097210-7097307
  misc_feature 1..97: note = hypo
  source 1..97: mol_type = genomic DNA
cattactccccacatcgcagggaatgaaagcccccttaagatatggactgtaacatccagagagggagagaataatattactccccatatcgcaggg

SEQ ID NO: 98028 - DNA, 217 bp, Homo sapiens
  misc_feature 1..217: note = chr7:7097367-7097584
  misc_feature 1..217: note = hypo
  source 1..217: mol_type = genomic DNA
ccatatcaaaggggatgtacacctcactctggtattgtccgtaatatctagggagggggagaggatgatgcaactccccaaatccaggggcacacccctgcgatattgtgtgtaaagtccgggggtggagagaaggtgtacacacccctgcgattttgtccataatatccagaaagggagacgatgatgtatctctccatatcgcaggaggtgtaca

SEQ ID NO: 98029 - DNA, 80 bp, Homo sapiens
  misc_feature 1..80: note = chr7:7098076-7098156
  misc_feature 1..80: note = hypo
  source 1..80: mol_type = genomic DNA
ccccctttccccccccggctactacgatccacatcgcagggggctgcacacaccccaccgtgatgcggggagtagtagca

SEQ ID NO: 98030 - DNA, 93 bp, Homo sapiens
  misc_feature 1..93: note = chr7:7099482-7099575
  misc_feature 1..93: note = hypo
  source 1..93: mol_type = genomic DNA
ttcttcgatattggtagtaatatcaacctctcccccttggatatatgaaacaatatgacaggcggggtggacacacctcgccatatagggagt

SEQ ID NO: 98031 - DNA, 51 bp, Homo sapiens
  misc_feature 1..51: note = chr7:7101398-7101449
  misc_feature 1..51: note = hypo
  source 1..51: mol_type = genomic DNA
tattactcccaatatcgaaggaggtgtacaccctcccgtgacagtgtcctc

SEQ ID NO: 98032 - DNA, 45 bp, Homo sapiens
  misc_feature 1..45: note = chr7:7101778-7101823
  misc_feature 1..45: note = hypo
  source 1..45: mol_type = genomic DNA
cattgtacccaatatcgcagggggtgtgcaccccccctgcgatat

SEQ ID NO: 98033 - DNA, 45 bp, Homo sapiens
  misc_feature 1..45: note = chr7:7101883-7101928
  misc_feature 1..45: note = hypo
  source 1..45: mol_type = genomic DNA
ccccacttgtgatactgttcttaatatttacggggggagacaatg

SEQ ID NO: 98034 - DNA, 30 bp, Homo sapiens
  misc_feature 1..30: note = chr7:7102527-7102557
  misc_feature 1..30: note = hypo
  source 1..30: mol_type = genomic DNA
tattactcaaaacagcgcaggaggtgtaca

SEQ ID NO: 98035 - DNA, 30 bp, Homo sapiens; identical to SEQ ID NO: 14975
  misc_feature 1..30: note = chr7:7102938-7102968
  misc_feature 1..30: note = hypo
  source 1..30: mol_type = genomic DNA

SEQ ID NO: 98036 - DNA, 37 bp, Homo sapiens
  misc_feature 1..37: note = chr7:7105793-7105830
  misc_feature 1..37: note = hypo
  source 1..37: mol_type = genomic DNA
cgttgctcccagtatcgaagggcgtgtaccccctctc

SEQ ID NO: 98037 - DNA, 30 bp, Homo sapiens
  misc_feature 1..30: note = chr7:7106198-7106228
  misc_feature 1..30: note = hypo
  source 1..30: mol_type = genomic DNA
aatatcaaaggtggacgatgatactactct

SEQ ID NO: 98038 - DNA, 61 bp, Homo sapiens; identical to SEQ ID NO: 41195
  misc_feature 1..61: note = chr7:7109343-7109404
  misc_feature 1..61: note = hypo
  source 1..61: mol_type = genomic DNA

SEQ ID NO: 98039 - DNA, 162 bp, Homo sapiens
  misc_feature 1..162: note = chr7:7110642-7110804
  misc_feature 1..162: note = hypo
  source 1..162: mol_type = genomic DNA
caacaattatgtaactcccactatcgcagacggtgtaccctctcagtgatattattcgtaataaccaagggggagatgacgttactctcagtatcacgggggtgaaccgcctgtgaaatggttcataatatccaagctggaagaggacgttactcccaatat

SEQ ID NO: 98040 - DNA, 360 bp, Homo sapiens
  misc_feature 1..360: note = chr7:7111756-7112116
  misc_feature 1..360: note = hypo
  source 1..360: mol_type = genomic DNA
ttcgtaatatccctgcggggaagagatgacgttacttttaataatatcgtaaggggtgtaccccctctgcgagattcttcgtaatatcccaatggggaggagatgatgttactcgtaaaaatatcgtggggtgtaccccctctgcgagattatttgtaatatcccgggggagaggatgatattactcttaataatatctcagtgtgtgtaccccaactgcgagatttttcataatatccccgggggaggtgacattacccctcataatatcgcaggggggtgtaccttcactgtgagattcttcgtaatatcccagaagggagatgatattaatcctaataatatcgcagggggtgtaca

SEQ ID NO: 98041 - DNA, 42 bp, Homo sapiens; identical to SEQ ID NO: 41197
  misc_feature 1..42: note = chr7:7113636-7113678
  misc_feature 1..42: note = hypo
  source 1..42: mol_type = genomic DNA

SEQ ID NO: 98042 - DNA, 39 bp, Homo sapiens
  misc_feature 1..39: note = chr7:71211002-71211041
  misc_feature 1..39: note = hypo
  source 1..39: mol_type = genomic DNA
cctcggatatgtctttatcagcatcgtgaaaacagacaa

SEQ ID NO: 98043 - DNA, 245 bp, Homo sapiens
  misc_feature 1..245: note = chr7:71217033-71217278
  misc_feature 1..245: note = hyper
  source 1..245: mol_type = genomic DNA
atgcagaagataaaacgtttcgcagcaccgggtccaaggaagtgcaatacaacagcaaaatgcaatggccgcagcagctcagtgatgggccgagactcgtcccgtgtggcggagatgctggcatcccccctgtggctccaagcgctgagcttggcggcggggacctggcggccccggctcggctcgggacaggcaggtgtggggagccggcgggttggagggcgttttgacgctagagggcgctc

SEQ ID NO: 98044 - DNA, 30 bp, Homo sapiens
  misc_feature 1..30: note = chr7:71252818-71252848
  misc_feature 1..30: note = hypo
  source 1..30: mol_type = genomic DNA
aggccatagcaaaggcgcatatgaggctct

SEQ ID NO: 98045 - DNA, 30 bp, Homo sapiens
  misc_feature 1..30: note = chr7:71265604-71265634
  misc_feature 1..30: note = hypo
  source 1..30: mol_type = genomic DNA
aatataatatgctttcgtcggcaatgaaat

SEQ ID NO: 98046 - DNA, 150 bp, Homo sapiens
  misc_feature 1..150: note = chr7:71296028-71296178
  misc_feature 1..150: note = hypo
  source 1..150: mol_type = genomic DNA
cataaatgcagaccccgagttcaggagctaatggactcataatctaggatggattctgccactaactagttgcgtaccctgaagcaggtcatttaatgacttggaatctgtttcctcatacatttaatagataatcctaatgataaaaag

SEQ ID NO: 98047 - DNA, 79 bp, Homo sapiens
  misc_feature 1..79: note = chr7:71299737-71299816
  misc_feature 1..79: note = hypo
  source 1..79: mol_type = genomic DNA
gacaaatgcagactgcgtttaagccatagtcactggggcacatatatggtgtatgggaatgtggtacaggactctgttt

SEQ ID NO: 98048 - DNA, 30 bp, Homo sapiens
  misc_feature 1..30: note = chr7:71398187-71398217
  misc_feature 1..30: note = hypo
  source 1..30: mol_type = genomic DNA
aagaagacaagatggcgccagttaagtggg

SEQ ID NO: 98049 - DNA, 34 bp, Homo sapiens
  misc_feature 1..34: note = chr7:71416278-71416312
  misc_feature 1..34: note = hypo
  source 1..34: mol_type = genomic DNA
aaagaatagcagaaacggccgggcgcatggctca

SEQ ID NO: 98050 - DNA, 216 bp, Homo sapiens
  misc_feature 1..216: note = chr7:71420713-71420929
  misc_feature 1..216: note = hypo
  source 1..216: mol_type = genomic DNA
ggaactcaggagatccgtcctggaaggagtcagattccaacatgacctgactatgatgcacttatttcagaccaagcagacagacaacctcctctgggaggaaagtcagaagtagaatgtactctaagagggcttgagggctgaagattgaaaagccgctatttagtctggcacctgggtggtacctggtgatctcagagccggcagtttcactga

SEQ ID NO: 98051 - DNA, 143 bp, Homo sapiens
  misc_feature 1..143: note = chr7:71472525-71472668
  misc_feature 1..143: note = hypo
  source 1..143: mol_type = genomic DNA
tgtctcaaaacacaaaacaaaacgaacaaaacaacttaatattatctgaaatttccttattcattatcaatttatttaatgcctatctttctcctaccccttacactaaaatgtaaattccatgagtgcgagagccttgttta

SEQ ID NO: 98052 - DNA, 41 bp, Homo sapiens
  misc_feature 1..41: note = chr7:71643690-71643731
  misc_feature 1..41: note = hypo
  source 1..41: mol_type = genomic DNA
aaagaaaaggttatttgacaaactcccgctttatttttcac

SEQ ID NO: 98053 - DNA, 76 bp, Homo sapiens
  misc_feature 1..76: note = chr7:71669270-71669346
  misc_feature 1..76: note = hypo
  source 1..76: mol_type = genomic DNA
cacccagccaaagccaagaggactcttttttaatgttaattgtattcaactatacacagttcgttgttgcctttgt

SEQ ID NO: 98054 - DNA, 198 bp, Homo sapiens
  misc_feature 1..198: note = chr7:71737907-71738105
  misc_feature 1..198: note = hypo
  source 1..198: mol_type = genomic DNA
cctaggatgaccaaacgtacaagagtagcttgggaatgggaaggagagaaggagagaggaagaacaaacaacatagatggagaattctgtggcatagggcgcaaagacagcaggaacaaccaccgagacccccacctctgcccagagccatgggctacatgaatgtcttctggaaactggagacggcatgcatatcaa

SEQ ID NO: 98055 - DNA, 39 bp, Homo sapiens
  misc_feature 1..39: note = chr7:71775955-71775994
  misc_feature 1..39: note = hypo
  source 1..39: mol_type = genomic DNA
taaacaatatgacattgaaaggcacgggtgtacttatgc

SEQ ID NO: 98056 - DNA, 126 bp, Homo sapiens; identical to SEQ ID NO: 3053
  misc_feature 1..126: note = chr7:71800631-71800757
  misc_feature 1..126: note = hyper
  source 1..126: mol_type = genomic DNA

SEQ ID NO: 98057 - DNA, 172 bp, Homo sapiens; identical to SEQ ID NO: 31321
  misc_feature 1..172: note = chr7:71800933-71801105
  misc_feature 1..172: note = hyper
  source 1..172: mol_type = genomic DNA

SEQ ID NO: 98058 - DNA, 141 bp, Homo sapiens; identical to SEQ ID NO: 31322
  misc_feature 1..141: note = chr7:71802206-71802347
  misc_feature 1..141: note = hyper
  source 1..141: mol_type = genomic DNA

SEQ ID NO: 98059 - skipped

SEQ ID NO: 98060 - DNA, 67 bp, Homo sapiens
  misc_feature 1..67: note = chr7:71802456-71802523
  misc_feature 1..67: note = hyper
  source 1..67: mol_type = genomic DNA
cacgcggggggcgagcaggcgcttggcagacggtgctccttccttcccttcccaaagaggctgccca

SEQ ID NO: 98061 - DNA, 204 bp, Homo sapiens
  misc_feature 1..204: note = chr7:71802577-71802781
  misc_feature 1..204: note = hyper
  source 1..204: mol_type = genomic DNA
cgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagcgatcccactcctcc

SEQ ID NO: 98062 - DNA, 30 bp, Homo sapiens
  misc_feature 1..30: note = chr7:71871052-71871082
  misc_feature 1..30: note = hypo
  source 1..30: mol_type = genomic DNA
ctggtgccctcactgcggcactcgcgatgt

SEQ ID NO: 98063 - DNA, 25 bp, Homo sapiens
  misc_feature 1..25: note = chr7:71877300-71877325
  misc_feature 1..25: note = hypo
  source 1..25: mol_type = genomic DNA
cggatagcaccccagcgagcttccc

SEQ ID NO: 98064 - DNA, 30 bp, Homo sapiens; identical to SEQ ID NO: 41356
  misc_feature 1..30: note = chr7:71880817-71880847
  misc_feature 1..30: note = hypo
  source 1..30: mol_type = genomic DNA

SEQ ID NO: 98065 - DNA, 183 bp, Homo sapiens
  misc_feature 1..183: note = chr7:71912763-71912946
  misc_feature 1..183: note = hypo
  source 1..183: mol_type = genomic DNA
acacacatgcctgctcgtgtatatgcatacacattcctatgtacacacatacccacccgtgtacacacacattcctgcccatgcacacacacatgcctgcccataccacacacacgtgcctgcccatgtacacacatacacacacgcttgcccatgtacacacacagacgcctgcctaggtat

SEQ ID NO: 98066 - DNA, 30 bp, Homo sapiens
  misc_feature 1..30: note = chr7:7284851-7284881
  misc_feature 1..30: note = hypo
  source 1..30: mol_type = genomic DNA
agtaatttcttttttcggagactgtctcac

SEQ ID NO: 98067 - DNA, 30 bp, Homo sapiens
  misc_feature 1..30: note = chr7:746995-747025
  misc_feature 1..30: note = hypo
  source 1..30: mol_type = genomic DNA
ataacacattattgtcggcaaccctttcga

SEQ ID NO: 98068 - skipped

SEQ ID NO: 98069 - DNA, 163 bp, Homo sapiens; identical to SEQ ID NO: 2953
  misc_feature 1..163: note = chr7:751986-752149
  misc_feature 1..163: note = hyper
  source 1..163: mol_type = genomic DNA

SEQ ID NO: 98070 - DNA, 156 bp, Homo sapiens; identical to SEQ ID NO: 30968
  misc_feature 1..156: note = chr7:752150-752306
  misc_feature 1..156: note = hyper
  source 1..156: mol_type = genomic DNA

SEQ ID NO: 98071 - DNA, 129 bp, Homo sapiens
  misc_feature 1..129: note = chr7:752350-752479
  misc_feature 1..129: note = hyper
  source 1..129: mol_type = genomic DNA
cgccccccgccccctccactcagactctgagtcgcccactccagccggtgcaggccgcggggccgcctctgatggcctgggcaccccccactcccgccccgttcacgaccaccgcggctgcctgagctg

SEQ ID NO: 98072 - DNA, 30 bp, Homo sapiens; identical to SEQ ID NO: 41357
  misc_feature 1..30: note = chr7:75975426-75975456
  misc_feature 1..30: note = hypo
  source 1..30: mol_type = genomic DNA

SEQ ID NO: 98073 - DNA, 30 bp, Homo sapiens
  misc_feature 1..30: note = chr7:76033259-76033289
  misc_feature 1..30: note = hypo
  source 1..30: mol_type = genomic DNA
gtgagtcaccgagcccggccttcttcttat

SEQ ID NO: 98074 - DNA, 279 bp, Homo sapiens; identical to SEQ ID NO: 41198
  misc_feature 1..279: note = chr7:7605145-7605424
  misc_feature 1..279: note = hypo
  source 1..279: mol_type = genomic DNA

SEQ ID NO: 98075 - DNA, 158 bp, Homo sapiens; identical to SEQ ID NO: 41199
  misc_feature 1..158: note = chr7:7605664-7605822
  misc_feature 1..158: note = hypo
  source 1..158: mol_type = genomic DNA

SEQ ID NO: 98076 - DNA, 94 bp, Homo sapiens
  misc_feature 1..94: note = chr7:7606031-7606125
  misc_feature 1..94: note = hypo
  source 1..94: mol_type = genomic DNA
ccgacaccgagcgggcgtccctcctgtgtagcactgtgttagccctaccaagtcaaggctctccttgcctgtttcctgccggaaccatgtcttt

SEQ ID NO: 98077 - DNA, 49 bp, Homo sapiens; identical to SEQ ID NO: 41358
  misc_feature 1..49: note = chr7:76106331-76106380
  misc_feature 1..49: note = hypo
  source 1..49: mol_type = genomic DNA

SEQ ID NO: 98078 - DNA, 185 bp, Homo sapiens
  misc_feature 1..185: note = chr7:76145361-76145546
  misc_feature 1..185: note = hyper
  source 1..185: mol_type = genomic DNA
gtgcaaaacctcaagcgtccatctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcagga

SEQ ID NO: 98079 - DNA, 30 bp, Homo sapiens
  misc_feature 1..30: note = chr7:76604327-76604357
  misc_feature 1..30: note = hypo
  source 1..30: mol_type = genomic DNA
tttagctgaagtcctcgcctatatttccca

SEQ ID NO: 98080 - DNA, 93 bp, Homo sapiens
  misc_feature 1..93: note = chr7:76631511-76631604
  misc_feature 1..93: note = hypo
  source 1..93: mol_type = genomic DNA
agcgtctggatacagcgatgtgactgacagcaaggcaatcgggcccctggctgtgggctgcctcaccaagtgcagccacgccttccacctgct

SEQ ID NO: 98081 - DNA, 40 bp, Homo sapiens
  misc_feature 1..40: note = chr7:76751676-76751716
  misc_feature 1..40: note = hyper
  source 1..40: mol_type = genomic DNA
ccctttcgctaaggccgacgggatacgtagttctaaagcg

SEQ ID NO: 98082 - DNA, 20 bp, Homo sapiens
  misc_feature 1..20: note = chr7:77051320-77051340
  misc_feature 1..20: note = hypo
  source 1..20: mol_type = genomic DNA
accaccgtgcccagccaaca

SEQ ID NO: 98083 - DNA, 28 bp, Homo sapiens
  misc_feature 1..28: note = chr7:77309374-77309402
  misc_feature 1..28: note = hypo
  source 1..28: mol_type = genomic DNA
tggagtgcagtggtccgcctcccgggtt

SEQ ID NO: 98084 - DNA, 28 bp, Homo sapiens
  misc_feature 1..28: note = chr7:77309582-77309610
  misc_feature 1..28: note = hypo
  source 1..28: mol_type = genomic DNA
aggcgtgagccatcgtgcccggccagac

SEQ ID NO: 98085 - DNA, 93 bp, Homo sapiens
  misc_feature 1..93: note = chr7:77315389-77315482
  misc_feature 1..93: note = hypo
  source 1..93: mol_type = genomic DNA
taaacacttaatatacgtgaaaaataagaaaaagtagacttattgggttagctttaaaagttaaataaaagagtggttaggcccggcgcggtg

SEQ ID NO: 98086 - DNA, 35 bp, Homo sapiens
  misc_feature 1..35: note = chr7:77324362-77324397
  misc_feature 1..35: note = hypo
  source 1..35: mol_type = genomic DNA
acatccataaataatcgccaacgaatttttcctgg

SEQ ID NO: 98087 - DNA, 30 bp, Homo sapiens
  misc_feature 1..30: note = chr7:77413267-77413297
  misc_feature 1..30: note = hypo
  source 1..30: mol_type = genomic DNA
gaaattcagaacttacgcatctatgttgtt

SEQ ID NO: 98088 - DNA, 28 bp, Homo sapiens
  misc_feature 1..28: note = chr7:77928410-77928438
  misc_feature 1..28: note = hypo
  source 1..28: mol_type = genomic DNA
aggcgtgagctaccgtgcctggctataa

SEQ ID NO: 98089 - DNA, 97 bp, Homo sapiens
  misc_feature 1..97: note = chr7:78598432-78598529
  misc_feature 1..97: note = hypo
  source 1..97: mol_type = genomic DNA
gtgtcggggtcatggcgcaggacaagtaaagccatctgtgcaggtgtactggcgaccacctggtagtagctgtatttgcacagtaaaagattagggt

SEQ ID NO: 98090 - DNA, 36 bp, Homo sapiens
  misc_feature 1..36: note = chr7:78598589-78598625
  misc_feature 1..36: note = hypo
  source 1..36: mol_type = genomic DNA
ggccttatgtaaatcaatcaccgcctcttcaagcct

SEQ ID NO: 98091 - DNA, 147 bp, Homo sapiens
  misc_feature 1..147: note = chr7:79081745-79081892
  misc_feature 1..147: note = hyper
  source 1..147: mol_type = genomic DNA
gaagacccgtcaaagcgcccaaagcaatttgtcccttcttttcttcgccagcggtggctcacggatccctaagggacagctggggacccaggcgcccccagcccagccccagaaacgctggacgcagttctccgctcaccccaccac

SEQ ID NO: 98092 - DNA, 420 bp, Homo sapiens; identical to SEQ ID NO: 31327
  misc_feature 1..420: note = chr7:79082159-79082579
  misc_feature 1..420: note = hyper
  source 1..420: mol_type = genomic DNA

SEQ ID NO: 98093 - DNA, 15 bp, Homo sapiens
  misc_feature 1..15: note = chr7:79083020-79083035
  misc_feature 1..15: note = hyper
  source 1..15: mol_type = genomic DNA
cactcctgcgtggtg

SEQ ID NO: 98094 - DNA, 821 bp, Homo sapiens
  misc_feature 1..821: note = chr7:79083190-79084011
  misc_feature 1..821: note = hyper
  source 1..821: mol_type = genomic DNA
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggc

SEQ ID NO: 98095 - DNA, 56 bp, Homo sapiens
  misc_feature 1..56: note = chr7:79764157-79764213
  misc_feature 1..56: note = hyper
  source 1..56: mol_type = genomic DNA
ggcttggcgaggctgcggcgcggccaccggcgggagtgcagcggccactgtaccca

SEQ ID NO: 98096 - DNA, 241 bp, Homo sapiens
  misc_feature 1..241: note = chr7:79764471-79764712
  misc_feature 1..241: note = hyper
  source 1..241: mol_type = genomic DNA
gcaccatgggctgcacgctgagcgccgaggacaaggcggcggtggagcggagtaagatgatcgaccgcaacctccgtgaggacggcgagaaggcggcgcgcgaggtcaagctgctgctgctcggtaagggcggccgggtcggggcccgggggtcggcgggggaccgggtgcggcgctgcgcggccctcggcgtttggaaacccggagggaagggggaggaagcgcccgaggaggcttctga

SEQ ID NO: 98097 - DNA, 285 bp, Homo sapiens
  misc_feature 1..285: note = chr7:79764928-79765213
  misc_feature 1..285: note = hyper
  source 1..285: mol_type = genomic DNA
agatgaaggggcattcgcggctagaaaatgaaaacacccccccccccgcgccaccaaccccctcccggaaaacccttcttcgtgtgcggtgtaggttgtgtttcgactgtggttttctcatgcccagagtgccacgtttggtgaaatcagtgcaccttttgtggggcctctgagatggggctgaagcgtctttcctgttaacttcctatggcgactccttaagtggtcaaggagcgctgattacattccccctgcgctgagaaaaggctgcgctggatgcttgat

SEQ ID NO: 98098 - DNA, 42 bp, Homo sapiens
  misc_feature 1..42: note = chr7:80134959-80135001
  misc_feature 1..42: note = hypo
  source 1..42: mol_type = genomic DNA
gcgtgagccactgcgcctggcagagagcgatatttctagata

SEQ ID NO: 98099 - DNA, 183 bp, Homo sapiens
  misc_feature 1..183: note = chr7:80135488-80135671
  misc_feature 1..183: note = hypo
  source 1..183: mol_type = genomic DNA
tcgaatgaaaatatgcgaatataaatatgttctgtaatattactagagagcttgttaaactgtagttagcaagagtcattgtcagcaagccagaattttcaacctccttagcaaatactatcatttggctaagtgtggaatgttttactaaatggtttgcatcttttacgcgagtgccttacg

SEQ ID NO: 98100 - DNA, 368 bp, Homo sapiens
  misc_feature 1..368: note = chr7:803247-803615
  misc_feature 1..368: note = hypo
  source 1..368: mol_type = genomic DNA
gtctcgccctgcacccgcggctctcgctctcctgcaccctgggcggggctccctgtggcagcctccctcccgattatcctggcaggcccggcctgtgtggttcttacgcgtgagggggatagtgagtcccagcaggcaggcaggcttgagccctgagtgttggaattgtctcagtctctgacttgtaacctccaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggtga

SEQ ID NO: 98101 - DNA, 37 bp, Homo sapiens
  misc_feature 1..37: note = chr7:80702421-80702458
  misc_feature 1..37: note = hypo
  source 1..37: mol_type = genomic DNA
tagaagcatatctcacgcctgtaatcccagcactttg

SEQ ID NO: 98102 - DNA, 120 bp, Homo sapiens
  misc_feature 1..120: note = chr7:80790105-80790225
  misc_feature 1..120: note = hypo
  source 1..120: mol_type = genomic DNA
tgcgcccagccgcttttctcactcttaagaaaagtcacaaacacatttcaactttgctgactttggagatgcgtggaaatcgtttttaggactaggagaagatctgccagagagaaaaaa

SEQ ID NO: 98103 - DNA, 49 bp, Homo sapiens
  misc_feature 1..49: note = chr7:808528-808577
  misc_feature 1..49: note = hypo
  source 1..49: mol_type = genomic DNA
ctgggtcagaagcagcgtggttctcgtggcagggcggcacttggcccaa

SEQ ID NO: 98104 - DNA, 30 bp, Homo sapiens
  misc_feature 1..30: note = chr7:808818-808848
  misc_feature 1..30: note = hypo
  source 1..30: mol_type = genomic DNA
cgaggtccccagcaacggctcaaggtgact

SEQ ID NO: 98105 - DNA, 30 bp, Homo sapiens
  misc_feature 1..30: note = chr7:80896305-80896335
  misc_feature 1..30: note = hypo
  source 1..30: mol_type = genomic DNA
tgacggaccactgcacgagcccgcaatggg

SEQ ID NO: 98106 - DNA, 37 bp, Homo sapiens
  misc_feature 1..37: note = chr7:81644079-81644116
  misc_feature 1..37: note = hypo
  source 1..37: mol_type = genomic DNA
tctttcatggccagacgcagtggctcacgctcgtaat

SEQ ID NO: 98107 - DNA, 30 bp, Homo sapiens
  misc_feature 1..30: note = chr7:81928003-81928033
  misc_feature 1..30: note = hypo
  source 1..30: mol_type = genomic DNA
agcaggggctataggcgcatgctaccacac

SEQ ID NO: 98108 - DNA, 298 bp, Homo sapiens
  misc_feature 1..298: note = chr7:819400-819698
  misc_feature 1..298: note = hypo
  source 1..298: mol_type = genomic DNA
tcaggggtcccaggtcgccaggagcaccttgcatgtggctcgggatgcacggagtctcccgtgaggtgtgggtttcttaggaccccagggcaggtgtcccatgggagtatgaactaaatgcctttgtggacgtttagacgtgaaatgtctgctctagactcacacacctgtctcgctccctccttccagaactcttaaaacgcctagatgacgtgtccaacgatgtgaggatggcagccgcctccaccttggtcacctggctgcagtgtgtcaagggtgccaacgcaaaatcctacta

SEQ ID NO: 98109 - DNA, 556 bp, Homo sapiens; identical to SEQ ID NO: 31332
  misc_feature 1..556: note = chr7:82072006-82072562
  misc_feature 1..556: note = hyper
  source 1..556: mol_type = genomic DNA

SEQ ID NO: 98110 - DNA, 57 bp, Homo sapiens
  misc_feature 1..57: note = chr7:82072646-82072703
  misc_feature 1..57: note = hyper
  source 1..57: mol_type = genomic DNA
cggccggcgctccctgcccggcccgccgacttacgtgacggccgaagggaacggctc

SEQ ID NO: 98111 - DNA, 44 bp, Homo sapiens
  misc_feature 1..44: note = chr7:82073054-82073098
  misc_feature 1..44: note = hyper
  source 1..44: mol_type = genomic DNA
agacctcggcgagcccgccggcgctcgcgcgctctcgctctccc

SEQ ID NO: 98112 - DNA, 59 bp, Homo sapiens; identical to SEQ ID NO: 31334
  misc_feature 1..59: note = chr7:82791978-82792037
  misc_feature 1..59: note = hyper
  source 1..59: mol_type = genomic DNA

SEQ ID NO: 98113 - DNA, 34 bp, Homo sapiens; identical to SEQ ID NO: 31335
  misc_feature 1..34: note = chr7:83277925-83277959
  misc_feature 1..34: note = hyper
  source 1..34: mol_type = genomic DNA

SEQ ID NO: 98114 - DNA, 53 bp, Homo sapiens
  misc_feature 1..53: note = chr7:83278217-83278270
  misc_feature 1..53: note = hyper
  source 1..53: mol_type = genomic DNA
agaaaaaaacaaaaccgagcacacgcactcccttctcccgtggaggtcctctc

SEQ ID NO: 98115 - DNA, 570 bp, Homo sapiens
  misc_feature 1..570: note = chr7:834303-834873
  misc_feature 1..570: note = hypo
  source 1..570: mol_type = genomic DNA
ctgtgggctccatcccgggatgcaggacagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccgcggactctaacctggacccaggcagggcagggtccatccacacccacagaatctaacctggactggggcagggcctaaacccagggactctaacctggacccgggcaggggaagggtccacacccgcagactctaacct

SEQ ID NO: 98116 - DNA, 40 bp, Homo sapiens
  misc_feature 1..40: note = chr7:8343744-8343784
  misc_feature 1..40: note = hypo
  source 1..40: mol_type = genomic DNA
tattcggccatcttgcctcctcccccggaattttcttaat

SEQ ID NO: 98117 - DNA, 71 bp, Homo sapiens; identical to SEQ ID NO: 31337
  misc_feature 1..71: note = chr7:83824239-83824310
  misc_feature 1..71: note = hyper
  source 1..71: mol_type = genomic DNA

SEQ ID NO: 98118 - DNA, 39 bp, Homo sapiens
  misc_feature 1..39: note = chr7:8391330-8391369
  misc_feature 1..39: note = hypo
  source 1..39: mol_type = genomic DNA
aaacttaggattgggcggggggtgggggaggagccaaga

SEQ ID NO: 98119 - DNA, 386 bp, Homo sapiens
  misc_feature 1..386: note = chr7:8473070-8473456
  misc_feature 1..386: note = hyper
  source 1..386: mol_type = genomic DNA
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctccggcccggcagccacaggtcggaggcgcccggcgtcggcgctcgaggccggcaggggcgccctgcaccctcccgcgcccttccccgccctacgcgactcccggctgctcttcccgccactcccctgggctttgcgatcttccctacgccccccgggaaggggg

SEQ ID NO: 98120 - DNA, 763 bp, Homo sapiens
  misc_feature 1..763: note = chr7:8473479-8474242
  misc_feature 1..763: note = hyper
  source 1..763: mol_type = genomic DNA
cgggagccacttgtccctgtgggcccagcccgcgagagcctgagagccggatctgtttacacagggtactaattagtctttgaggaatcattcacccacgtgccaaagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagc

SEQ ID NO: 98121 - DNA, 925 bp, Homo sapiens
  misc_feature 1..925: note = chr7:8474515-8475440
  misc_feature 1..925: note = hyper
  source 1..925: mol_type = genomic DNA
cggaggaggcttcttctctagaagttagcgaccggctgtaccctttggctcgaaaaaagtagtgctagagatgtgactgtgagcattcgtgggtatctctgtgtgcgccaggggttcgaatgggtaaactgatccctgctttcctgtatgcaaattgcattctctttccccacccccacttcaccgaacgtgttgaggtacctagcacctaatcgcggtcagttctacctacctcttcctctcaccgcgcccccctcgctcaatctctctctctccctttatctttcccctctatctctctctgctggtgtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtaagtcttggaaggttcggggctttcgcatttttaccccggc

SEQ ID NO: 98122 - DNA, 445 bp, Homo sapiens
  misc_feature 1..445: note = chr7:8476305-8476750
  misc_feature 1..445: note = hyper
  source 1..445: mol_type = genomic DNA
ttgtgttcagtgtcccgacccccatagcccatcctgggctgcgggagtgcaccgagggctcgctatgttctgtctaggggtgaggtgcgctaaagcagcccgaactctctgatgggctacacctctgattggaggtgatactggcgctcctcaatcccaagagccttagatagaacccataagcctgaaagaattgccatccctacaattgacagcgtttctcggccgttgccctggtgcatgtggctgcaaagctgcgagttgtgtgaattctgtgtatgtgagtgacacgtatatatatgtgtgtgtgaatgtgtatttaaccgatttcagcttcaatccaagaaccctcaatgttgcctgtctttgcccctttatcgcctgaccgtagcagccgcggacgccagagggcgctgcgcatcagcgtcctcgcccacaggacacc

SEQ ID NO: 98123 - DNA, 30 bp, Homo sapiens
  misc_feature 1..30: note = chr7:84773311-84773341
  misc_feature 1..30: note = hypo
  source 1..30: mol_type = genomic DNA
gcaccgagcctggcccgagacttgtaattt

SEQ ID NO: 98124 - DNA, 30 bp, Homo sapiens
  misc_feature 1..30: note = chr7:8477418-8477448
  misc_feature 1..30: note = hyper
  source 1..30: mol_type = genomic DNA
tgctgattcaattaccgtttagttacagac

SEQ ID NO: 98125 - DNA, 329 bp, Homo sapiens
  misc_feature 1..329: note = chr7:8480721-8481050
  misc_feature 1..329: note = hyper
  source 1..329: mol_type = genomic DNA
tgggcaaccattgtccgttaggggcttcagatctcattttaagaccttaacagtcctcgccgttctaattaaggaaaggcaggcgagcctgccagccgagagcggttgggtcagcggcttcatggtgcagccgagtctcaaagcgggtctgcactctcgcctccctctgcattctcttagccactatttgcctggtcccgtcgcgtgtgtgcaggaagtttcagtcttgatttatccactagtcaagttcccgaccagctctttttctggatgtcagcactaaccccctcccggagcttggtaaacacagcgcgcgcatttttctgcct

SEQ ID NO: 98126 - DNA, 988 bp, Homo sapiens
  misc_feature 1..988: note = chr7:8481310-8482298
  misc_feature 1..988: note = hyper
  source 1..988: mol_type = genomic DNA
caagctttccaagagcggctttttattgagataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 98127 - DNA, 302 bp, Homo sapiens
  misc_feature 1..302: note = chr7:84814630-84814932
  misc_feature 1..302: note = hyper
  source 1..302: mol_type = genomic DNA
ggagatcctccccctcgtctctgcgcgcccccaccccgccatcccccgctagcgcacacatgcaggagaaccctttttaggctaaaccggaaagtttaggtcttctcccctcttcttttgcttgtgcaaatagcactaagctaaacggaaagtggtggggttttggtgatgaaataagagtccacgcacagaagcttgccttttattaccgcttcgctcgaggcgaaatcgctgaaagttcggctatttaactcctgtccccataactcggaatcccggacaccagcggccccagctgctgg

SEQ ID NO: 98128 - DNA, 54 bp, Homo sapiens
  misc_feature 1..54: note = chr7:84814985-84815039
  misc_feature 1..54: note = hyper
  source 1..54: mol_type = genomic DNA
cgtctcctcctcctgtcaacttccctccttgcactgtgacggaggcaaagcaac

SEQ ID NO: 98129 - DNA, 55 bp, Homo sapiens
  misc_feature 1..55: note = chr7:84815396-84815451
  misc_feature 1..55: note = hyper
  source 1..55: mol_type = genomic DNA
cgcccattcctcttccaaaacgctacaacaaaaaccaccacgcttcccttccttc

SEQ ID NO: 98130 - DNA, 737 bp, Homo sapiens
  misc_feature 1..737: note = chr7:84815717-84816454
  misc_feature 1..737: note = hyper
  source 1..737: mol_type = genomic DNA
ctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcggagagcaaggcaccagctggagctttggggaggagagggtggcgaggaaaggcacgctccaaacaggagggcggcttttaagtttgtggtgtgaccgcagcagctgtcctgggagagactcagtctttctaaaaagaggatgctgaaaacgccggggattacctttccccttccgatctcctcccccagccctcgccccctccttccactgc

SEQ ID NO: 98131 - DNA, 33 bp, Homo sapiens
  misc_feature 1..33: note = chr7:84816455-84816488
  misc_feature 1..33: note = hyper
  source 1..33: mol_type = genomic DNA
cacgccagaactcccaagcgtgcagaagttcat

SEQ ID NO: 98132 - DNA, 156 bp, Homo sapiens; identical to SEQ ID NO: 2965
  misc_feature 1..156: note = chr7:8482669-8482825
  misc_feature 1..156: note = hyper
  source 1..156: mol_type = genomic DNA

SEQ ID NO: 98133 - DNA, 1139 bp, Homo sapiens
  misc_feature 1..1139: note = chr7:8482884-8484023
  misc_feature 1..1139: note = hyper
  source 1..1139: mol_type = genomic DNA
cgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctgaggccctggcgagatttcggcctttagcttaa

SEQ ID NO: 98134 - DNA, 23 bp, Homo sapiens
  misc_feature 1..23: note = chr7:84936791-84936814
  misc_feature 1..23: note = hypo
  source 1..23: mol_type = genomic DNA
accgcgctcggccttgtttacca

SEQ ID NO: 98135 - DNA, 28 bp, Homo sapiens
  misc_feature 1..28: note = chr7:85220892-85220920
  misc_feature 1..28: note = hypo
  source 1..28: mol_type = genomic DNA
gatctaggccgggagcggtggctcacgc

SEQ ID NO: 98136 - DNA, 207 bp, Homo sapiens
  misc_feature 1..207: note = chr7:852590-852797
  misc_feature 1..207: note = hyper
  source 1..207: mol_type = genomic DNA
tctgttacagctctccggcaagttcctttcaccactccccacagtctcacacactgaaaccacagcaggggccgccctcactcaccgcaggggacaaccacccaccaaaaaccatttcctctgcggatgcttcccgcccaaagaaggaaccagaagcaggcaggatggggaagcagctggtggagaagccaaattgtttccttaaga

SEQ ID NO: 98137 - DNA, 27 bp, Homo sapiens
  misc_feature 1..27: note = chr7:86228129-86228156
  misc_feature 1..27: note = hypo
  source 1..27: mol_type = genomic DNA
aggaggctgaatccacggggctgagca

SEQ ID NO: 98138 - DNA, 510 bp, Homo sapiens; identical to SEQ ID NO: 3058
  misc_feature 1..510: note = chr7:86273208-86273718
  misc_feature 1..510: note = hyper
  source 1..510: mol_type = genomic DNA

SEQ ID NO: 98139 - DNA, 398 bp, Homo sapiens
  misc_feature 1..398: note = chr7:86273719-86274117
  misc_feature 1..398: note = hyper
  source 1..398: mol_type = genomic DNA
gcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcc

SEQ ID NO: 98140 - DNA, 189 bp, Homo sapiens
  misc_feature 1..189: note = chr7:86274257-86274446
  misc_feature 1..189: note = hyper
  source 1..189: mol_type = genomic DNA
cgtggggcaggcgcagccgggaaagttgaggtagagcatggaccagtccctacagtcctgactggagtgggaagggtggagggcagaggcgatgtgggtgtgcatgagtgagagtttgtgtgtgtgcgcccacgtctgtgtctgggaggagggagatttcagggcatagatctgcggccagggtgcgag

SEQ ID NO: 98141 - DNA, 42 bp, Homo sapiens; identical to SEQ ID NO: 41364
  misc_feature 1..42: note = chr7:86416083-86416125
  misc_feature 1..42: note = hypo
  source 1..42: mol_type = genomic DNA

SEQ ID NO: 98142 - DNA, 102 bp, Homo sapiens
  misc_feature 1..102: note = chr7:86688425-86688527
  misc_feature 1..102: note = hyper
  source 1..102: mol_type = genomic DNA
cagaaaagcatcccccgagagacagcgaagccacacaccctctccgggccagctaccagggcgggcaacttcacccctcgaagcaaacgaaagcccctgttc

SEQ ID NO: 98143 - DNA, 627 bp, Homo sapiens
  misc_feature 1..627: note = chr7:87104741-87105368
  misc_feature 1..627: note = hyper
  source 1..627: mol_type = genomic DNA
ggcgccaggctgttccgttctttgccgcctcaagatccatctcagcctgaggagaaaccacagcctcagaaccaagtacaccctctccggcggcccggcgcacgagtcgcggggcccgggggcactgggtggaggtccggccactcccgccccgcgccccacgtcccgggtctcccttcgaggccagacgcgcccggacctctctcacctcgaacctcgcgcgtgtctggcagggcctctggacgcgcgggcgctgcagcagaggggcctggactttgctcgccgcggcctcgcccccgcccccgcccccgccccccacgcgcgtccggcccgggaaacgcctaccgttgcagccagggcgagggccgcggcccgcgagagcagctcccgccgcccgcccagctctctccccaggctaggcgcgggccaggggcgcagcctgccgctcttgccgccggggcgcccggctggggccgccgcccaccctggcgacccgccagaaccagcccggtcgcaggataagaccgagatcaggctggagcctcgggtgccgagaaagcctcgcctgatgggccacccaagcccctgcagatgactgtcacaccccatgggcgctcagttttgttt

SEQ ID NO: 98144 - DNA, 812 bp, Homo sapiens
  misc_feature 1..812: note = chr7:87229377-87230189
  misc_feature 1..812: note = hyper
  source 1..812: mol_type = genomic DNA
aaattactcaaatctcgcaactatgtaaactatgaaaatgaaacaagctagttaccttttattgttcagtttaaaaaagttcttcttctttgctcctccattgcggtccccttcaagatccattccgacctgaagagaaaccgcagctcattagccaaatgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagcc

SEQ ID NO: 98145 - DNA, 154 bp, Homo sapiens; identical to SEQ ID NO: 31349
  misc_feature 1..154: note = chr7:87230190-87230344
  misc_feature 1..154: note = hyper
  source 1..154: mol_type = genomic DNA

SEQ ID NO: 98146 - DNA, 178 bp, Homo sapiens; identical to SEQ ID NO: 3062
  misc_feature 1..178: note = chr7:87230345-87230523
  misc_feature 1..178: note = hyper
  source 1..178: mol_type = genomic DNA

SEQ ID NO: 98147 - DNA, 162 bp, Homo sapiens
  misc_feature 1..162: note = chr7:87256912-87257074
  misc_feature 1..162: note = hyper
  source 1..162: mol_type = genomic DNA
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttactattcccagacccggactcccgattcc

SEQ ID NO: 98148 - DNA, 820 bp, Homo sapiens
  misc_feature 1..820: note = chr7:87257075-87257895
  misc_feature 1..820: note = hyper
  source 1..820: mol_type = genomic DNA
gagtcacggcccaggacgcgaaaagactctacactggcaccacgctcctccttaggcgggccgtcagtcccgggtgcgggctgcgctggaggctgaggtgggagcgacatggtgtggaggggcaagaaatgtcggcactagacgcgccaagaaggagattctacgagcaattcccccctcgggccattgtgttgctgtttattagcccctgggagggcgtcaggacaaaaggaaccctcctcccttcttagtacttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtg

SEQ ID NO: 98149 - DNA, 443 bp, Homo sapiens
  misc_feature 1..443: note = chr7:87257955-87258398
  misc_feature 1..443: note = hyper
  source 1..443: mol_type = genomic DNA
agggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggtacggcagcgcagggcgaggggaaccagcctcccgccggggctgagagctctgggcttccgcgcgggtccttgggggtcccgggcatgatgggctgccgcccagtgcccccgcctatgttgcgccagccaaatctg

SEQ ID NO: 98150 - DNA, 30 bp, Homo sapiens
  misc_feature 1..30: note = chr7:87564329-87564359
  misc_feature 1..30: note = hyper
  source 1..30: mol_type = genomic DNA
cctgcctggaggagacgcctcattgatgga

SEQ ID NO: 98151 - DNA, 49 bp, Homo sapiens
  misc_feature 1..49: note = chr7:87564603-87564652
  misc_feature 1..49: note = hyper
  source 1..49: mol_type = genomic DNA
aaatgagttgggtcccgatgcgagtcatgcatggcgctccctgtgcaaa

SEQ ID NO: 98152 - DNA, 30 bp, Homo sapiens
  misc_feature 1..30: note = chr7:87850928-87850958
  misc_feature 1..30: note = hypo
  source 1..30: mol_type = genomic DNA
ggataaacggctatacgaattggcatatca

SEQ ID NO: 98153 - DNA, 86 bp, Homo sapiens
  misc_feature 1..86: note = chr7:87936120-87936206
  misc_feature 1..86: note = hyper
  source 1..86: mol_type = genomic DNA
cttccaaggaggaagcgtccagcgccaacggtgcgcgccgcgggccgggcgggtagagggaagtttcgccgcgcctgcagctcagc

SEQ ID NO: 98154 - DNA, 58 bp, Homo sapiens
  misc_feature 1..58: note = chr7:88387729-88387787
  misc_feature 1..58: note = hyper
  source 1..58: mol_type = genomic DNA
actggggagaattagcgcattggcggtagcctttcaattccagcgctgaagcaacaga

SEQ ID NO: 98155 - DNA, 42 bp, Homo sapiens
  misc_feature 1..42: note = chr7:88387989-88388031
  misc_feature 1..42: note = hyper
  source 1..42: mol_type = genomic DNA
ttaaattacggtaaacgaaataaggtccgttaaaaaccactt

SEQ ID NO: 98156 - DNA, 364 bp, Homo sapiens
  misc_feature 1..364: note = chr7:88388282-88388646
  misc_feature 1..364: note = hyper
  source 1..364: mol_type = genomic DNA
gctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggc

SEQ ID NO: 98157 - DNA, 255 bp, Homo sapiens; identical to SEQ ID NO: 3064
  misc_feature 1..255: note = chr7:88388647-88388902
  misc_feature 1..255: note = hyper
  source 1..255: mol_type = genomic DNA

SEQ ID NO: 98158 - DNA, 250 bp, Homo sapiens
  misc_feature 1..250: note = chr7:88389046-88389296
  misc_feature 1..250: note = hyper
  source 1..250: mol_type = genomic DNA
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggct

SEQ ID NO: 98159 - DNA, 30 bp, Homo sapiens
  misc_feature 1..30: note = chr7:88719-88749
  misc_feature 1..30: note = hypo
  source 1..30: mol_type = genomic DNA
ctctggcgccatggccgtaaagagaaaacc

SEQ ID NO: 98160 - DNA, 283 bp, Homo sapiens
  misc_feature 1..283: note = chr7:89748011-89748294
  misc_feature 1..283: note = hyper
  source 1..283: mol_type = genomic DNA
cgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggc

SEQ ID NO: 98161 - DNA, 268 bp, Homo sapiens; identical to SEQ ID NO: 31362
  misc_feature 1..268: note = chr7:89748295-89748563
  misc_feature 1..268: note = hyper
  source 1..268: mol_type = genomic DNA

SEQ ID NO: 98162 - DNA, 41 bp, Homo sapiens
  misc_feature 1..41: note = chr7:89748925-89748966
  misc_feature 1..41: note = hyper
  source 1..41: mol_type = genomic DNA
ctcccccttcccccccgcctccgccccggagccggaggtag

SEQ ID NO: 98163 - DNA, 15 bp, Homo sapiens
  misc_feature 1..15: note = chr7:89841157-89841172
  misc_feature 1..15: note = hyper
  source 1..15: mol_type = genomic DNA
tcccctggctgttcg

SEQ ID NO: 98164 - DNA, 183 bp, Homo sapiens
  misc_feature 1..183: note = chr7:89841213-89841396
  misc_feature 1..183: note = hyper
  source 1..183: mol_type = genomic DNA
cgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcg

SEQ ID NO: 98165 - DNA, 539 bp, Homo sapiens; identical to SEQ ID NO: 31364
  misc_feature 1..539: note = chr7:89950183-89950722
  misc_feature 1..539: note = hyper
  source 1..539: mol_type = genomic DNA

SEQ ID NO: 98166 - DNA, 312 bp, Homo sapiens
  misc_feature 1..312: note = chr7:90225745-90226057
  misc_feature 1..312: note = hyper
  source 1..312: mol_type = genomic DNA
cggcccaggccggagcggagcctgccgtcctccgcctgcctgctgctcgcctccctagacctgcgcgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattggtgagtagcgcgctgcccccggccc

SEQ ID NO: 98167 - DNA, 16 bp, Homo sapiens
  misc_feature 1..16: note = chr7:90226268-90226284
  misc_feature 1..16: note = hyper
  source 1..16: mol_type = genomic DNA
ggttctcccctcctcc

SEQ ID NO: 98168 - DNA, 461 bp, Homo sapiens
  misc_feature 1..461: note = chr7:90226285-90226746
  misc_feature 1..461: note = hyper
  source 1..461: mol_type = genomic DNA
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgttcagtctcgaggtctctgaatcttcccgctgctggagagaaatgcgcgctgtggagttgtctggacatttaggaatgtctctcgaacttgttccatttaatagagctcaggggctgttgtctttaaaccaaacaacaaaccaactgaccaacagtgtttaggacagtgacgaataaatgcatgt

SEQ ID NO: 98169 - DNA, 76 bp, Homo sapiens
  misc_feature 1..76: note = chr7:90269559-90269635
  misc_feature 1..76: note = hypo
  source 1..76: mol_type = genomic DNA
ctattcggccatcttggctcctccctctcttccttatgtttaataactatcacagtaaacacgctttttgtttaat

SEQ ID NO: 98170 - DNA, 146 bp, Homo sapiens
  misc_feature 1..146: note = chr7:90558629-90558775
  misc_feature 1..146: note = hypo
  source 1..146: mol_type = genomic DNA
agctgttcctattcggccatcttggaacctctggaacctgttttaaatggactgatttttaaatcattgtcttgcatatttcatggtgatggttatttgactattttaaagtataattactgggcaagggacgattttaaaaatag

SEQ ID NO: 98171 - DNA, 30 bp, Homo sapiens
  misc_feature 1..30: note = chr7:90720178-90720208
  misc_feature 1..30: note = hypo
  source 1..30: mol_type = genomic DNA
ctaagctctgtcactcgtcacctgtttgta

SEQ ID NO: 98172 - DNA, 30 bp, Homo sapiens; identical to SEQ ID NO: 41041
  misc_feature 1..30: note = chr7:907656-907686
  misc_feature 1..30: note = hypo
  source 1..30: mol_type = genomic DNA

SEQ ID NO: 98173 - DNA, 89 bp, Homo sapiens; identical to SEQ ID NO: 31367
  misc_feature 1..89: note = chr7:90894938-90895027
  misc_feature 1..89: note = hyper
  source 1..89: mol_type = genomic DNA

SEQ ID NO: 98174 - DNA, 130 bp, Homo sapiens
  misc_feature 1..130: note = chr7:90895028-90895158
  misc_feature 1..130: note = hyper
  source 1..130: mol_type = genomic DNA
cgccctcaaggtgccctcctacctcaactaccacttcctgggggagaaggactgcggcgcaccttgtgagccgaccaaggtgtatgggctcatgtacttcgggcccgaggagctgcgcttctcgcgcacc

SEQ ID NO: 98175 - DNA, 45 bp, Homo sapiens
  misc_feature 1..45: note = chr7:91510048-91510093
  misc_feature 1..45: note = hyper
  source 1..45: mol_type = genomic DNA
gaaaagactaacttccggcctcgggtcgcgcgcagaggtgatgtc

SEQ ID NO: 98176 - DNA, 48 bp, Homo sapiens
  misc_feature 1..48: note = chr7:91510834-91510882
  misc_feature 1..48: note = hypo
  source 1..48: mol_type = genomic DNA
attaattgtgtctgtcgagttatcctcaggagacgatggtgatttggt

SEQ ID NO: 98177 - DNA, 63 bp, Homo sapiens
  misc_feature 1..63: note = chr7:915323-915386
  misc_feature 1..63: note = hypo
  source 1..63: mol_type = genomic DNA
cagggaaggaccgcaggtggcctttcaaagaggaggaacgcccctcagcgatcctaagaggtt

SEQ ID NO: 98178 - DNA, 467 bp, Homo sapiens
  misc_feature 1..467: note = chr7:91808202-91808669
  misc_feature 1..467: note = hyper
  source 1..467: mol_type = genomic DNA
ttcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggccatcggtcacactgggatactcgaggaggaggcctggggcctgcattcaattccctaagagggacccgcgctggccgctgcaggcgggtggagaacgggcgtctgagtctttggctttcgtaccggaatctccccggg

SEQ ID NO: 98179 - DNA, 30 bp, Homo sapiens
  misc_feature 1..30: note = chr7:91889676-91889706
  misc_feature 1..30: note = hypo
  source 1..30: mol_type = genomic DNA
tcaccttctttagctcgttgatgaaacgtc

SEQ ID NO: 98180 - DNA, 25 bp, Homo sapiens
  misc_feature 1..25: note = chr7:92076443-92076468
  misc_feature 1..25: note = hypo
  source 1..25: mol_type = genomic DNA
tgagccaccacgccagacctggatt

SEQ ID NO: 98181 - DNA, 62 bp, Homo sapiens
  misc_feature 1..62: note = chr7:920918-920980
  misc_feature 1..62: note = hypo
  source 1..62: mol_type = genomic DNA
acacagaagataccacggcactgtggggctctgcaaccaggcctcctcgcccccactcccac

SEQ ID NO: 98182 - DNA, 30 bp, Homo sapiens
  misc_feature 1..30: note = chr7:92439285-92439315
  misc_feature 1..30: note = hyper
  source 1..30: mol_type = genomic DNA
tccttttctcagtaacgcagggtaggtcat

SEQ ID NO: 98183 - DNA, 193 bp, Homo sapiens
  misc_feature 1..193: note = chr7:92466288-92466481
  misc_feature 1..193: note = hyper
  source 1..193: mol_type = genomic DNA
aaaatttccggctttcgctgaaactgtagtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 98184 - DNA, 464 bp, Homo sapiens
  misc_feature 1..464: note = chr7:92689310-92689774
  misc_feature 1..464: note = hypo
  source 1..464: mol_type = genomic DNA
attgttttgtgatttcggcaattagaaatgatgctacaggagactcgttctcacctaaggagattttgcttcctaggagacattggtcaacgttttgagacttttcttattgtaacaactggcaagtgctactggcatctagtaggtagaagttggagtcctgctaaacgatctacaacgcacaggacagccacccatgacaaagaattaacacacctataaagtcaatagtgctgagcttgacaaaccctgctctgggttatattgttgggagagaaattgctggctgataaagtatatttatcttcaaacttatacaatactaccattctgttttctagagtgattgtatcaatttacactgccatcatcagagtgggaggcttcccgatgctgtatatctgcaccagcgctaaatatcaccagcttaaaaatattttgctccaggcacggtggctcacgcc

SEQ ID NO: 98185 - DNA, 30 bp, Homo sapiens
  misc_feature 1..30: note = chr7:92731846-92731876
  misc_feature 1..30: note = hypo
  source 1..30: mol_type = genomic DNA
ccgcctttttgacttcggatacaatctttc

SEQ ID NO: 98186 - DNA, 30 bp, Homo sapiens
  misc_feature 1..30: note = chr7:92732475-92732505
  misc_feature 1..30: note = hypo
  source 1..30: mol_type = genomic DNA
agtagttcccacattcgatgacctctgttt

SEQ ID NO: 98187 - DNA, 30 bp, Homo sapiens; identical to SEQ ID NO: 41367
  misc_feature 1..30: note = chr7:93055830-93055860
  misc_feature 1..30: note = hypo
  source 1..30: mol_type = genomic DNA

SEQ ID NO: 98188 - DNA, 235 bp, Homo sapiens
  misc_feature 1..235: note = chr7:93203561-93203796
  misc_feature 1..235: note = hyper
  source 1..235: mol_type = genomic DNA
caaatcgttaagtcccgctcatttccaaacgctccttacctggaattctgtcactgggcggctgggcacagctcaatagaagcaaagggtgttcgcaggtgtggctccagggactcaggcgctcaagcttcagcgcccatctcctgggcaggagatgtcagccgcagggtgaggtgcggacgtgcgcacttctccaacccgggaaggtccgccagccgcgcggcgcagcccaccc

SEQ ID NO: 98189 - DNA, 15 bp, Homo sapiens
  misc_feature 1..15: note = chr7:93204217-93204232
  misc_feature 1..15: note = hyper
  source 1..15: mol_type = genomic DNA
cgagctggtgagctc

SEQ ID NO: 98190 - DNA, 816 bp, Homo sapiens
  misc_feature 1..816: note = chr7:93204298-93205114
  misc_feature 1..816: note = hyper
  source 1..816: mol_type = genomic DNA
cgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctaggtagtgaaagtggggtgaggacgtgggaagacggctggctaagagctggggtgctaaaaggaaaaaagtgctgagaggaaggagatgagaagagacaccttgggggtcaggcaagccctgggaaagcgtccggagttgggcggctgtaggctggaggcataacttggatttggagaaagagtgccctccgtgtaggggactgctggtgggcacagtgttttagggtgaatgaaaacagagaggatggcgagggaagacggggatatggggtgcctgacttggtgccggacactgcgactcctcttctttccccctaaagccctcgatgtcagcaggagtccgggacaatccaataccaggcggggcgcagcggaggctggcaggcacgccctgggaggcaggcaagttgattccaaggacgagtcaccctcaacctcttttagcccacaactgggtggatcaaggcaggagccaacacttttttccctaactctgtttaggcggtgttggactaag

SEQ ID NO: 98191 - DNA, 29 bp, Homo sapiens
  misc_feature 1..29: note = chr7:933292-933321
  misc_feature 1..29: note = hypo
  source 1..29: mol_type = genomic DNA
gttgggcgcaggcgcggtggtttgtgcag

SEQ ID NO: 98192 - DNA, 146 bp, Homo sapiens
  misc_feature 1..146: note = chr7:93511549-93511695
  misc_feature 1..146: note = hypo
  source 1..146: mol_type = genomic DNA
agtgcgatgtaacatcgatgtaaagtgcgatgtaaattccttaaagtgcgatgatgattaggatgtacatcctaatcatctggagttgttgtttaaaatgtgcatctttgagtgccaactcaaacccactacgtaaaaacccctgg

SEQ ID NO: 98193 - DNA, 562 bp, Homo sapiens; identical to SEQ ID NO: 31375
  misc_feature 1..562: note = chr7:93519204-93519766
  misc_feature 1..562: note = hyper
  source 1..562: mol_type = genomic DNA

SEQ ID NO: 98194 - DNA, 170 bp, Homo sapiens; identical to SEQ ID NO: 9105
  misc_feature 1..170: note = chr7:93519854-93520024
  misc_feature 1..170: note = hyper
  source 1..170: mol_type = genomic DNA

SEQ ID NO: 98195 - DNA, 441 bp, Homo sapiens
  misc_feature 1..441: note = chr7:93520025-93520466
  misc_feature 1..441: note = hyper
  source 1..441: mol_type = genomic DNA
tccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaatggacct

SEQ ID NO: 98196 - DNA, 28 bp, Homo sapiens
  misc_feature 1..28: note = chr7:93520878-93520906
  misc_feature 1..28: note = hypo
  source 1..28: mol_type = genomic DNA
actccagtctgggcggcagagtggaact

SEQ ID NO: 98197 - DNA, 534 bp, Homo sapiens
  misc_feature 1..534: note = chr7:93550996-93551530
  misc_feature 1..534: note = hyper
  source 1..534: mol_type = genomic DNA
aaaggagcgggggtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaag

SEQ ID NO: 98198 - DNA, 33 bp, Homo sapiens
  misc_feature 1..33: note = chr7:93605811-93605844
  misc_feature 1..33: note = hypo
  source 1..33: mol_type = genomic DNA
ctagtcaagcttgaacgccggcaggatctctga

SEQ ID NO: 98199 - DNA, 37 bp, Homo sapiens
  misc_feature 1..37: note = chr7:93641681-93641718
  misc_feature 1..37: note = hypo
  source 1..37: mol_type = genomic DNA
ccgaggaggagccaatagcgagcgagagctgccagca

SEQ ID NO: 98200 - DNA, 30 bp, Homo sapiens; identical to SEQ ID NO: 31379
  misc_feature 1..30: note = chr7:94024050-94024080
  misc_feature 1..30: note = hyper
  source 1..30: mol_type = genomic DNA

SEQ ID NO: 98201 - DNA, 39 bp, Homo sapiens
  misc_feature 1..39: note = chr7:94138061-94138100
  misc_feature 1..39: note = hypo
  source 1..39: mol_type = genomic DNA
caaaacattaaccaacgttagtagcggggatgattgtca

SEQ ID NO: 98202 - DNA, 783 bp, Homo sapiens
  misc_feature 1..783: note = chr7:94284364-94285147
  misc_feature 1..783: note = hyper
  source 1..783: mol_type = genomic DNA
catagtacaaatgcacgcaaatatttgtggccgaatctcggcaacccgctggaaaggattaaacgtgcggttgccgtgactaaacgcattcattcaccctacaagatttaggaaaatgtaacgttgcaagggaagcaaggtctctgtgtaaacctcgtaatcgccaccaaaagtcggtagctgggagccttcaaagcccgccaaacacactggaagcatccacagctgttttaaattggttttggtttctggaaatagcgcactcggtacggcagcatctctggcctccagccggggttaaccctgacctgaacgccctgtttagctcccagcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaaggccaggggtcaagcctggggagagagaagctgggccggggaaatggggta

SEQ ID NO: 98203 - DNA, 751 bp, Homo sapiens
  misc_feature 1..751: note = chr7:94536847-94537598
  misc_feature 1..751: note = hyper
  source 1..751: mol_type = genomic DNA
gccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccgccgaaacggcccggcgtggcgaccgcacgtgggccaaaccccttccccggccggcacccctggccccaggccggcccgagcgtgcgggcgcgtcgctgctcgggccgccgcccgcccgcaatggcgttggggagcgcagcgcgcctcccggggccgcccgccgcgggcagggagcgcctgggggccgacgcgcgagtggaagcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcgggtaagggggaggctgagcgcggggcgaggagttggggagggtggagaggaggaaaaaatcggcttgtacaaaggctgagttgcaggctgggggtgggggtgggttgtggtggaggagcaataggttgaagatcggaggcattatcag

SEQ ID NO: 98204 - DNA, 30 bp, Homo sapiens
  misc_feature 1..30: note = chr7:94537877-94537907
  misc_feature 1..30: note = hyper
  source 1..30: mol_type = genomic DNA
accgggcttgggaatcggctgcctctcaag

SEQ ID NO: 98205 - DNA, 385 bp, Homo sapiens
  misc_feature 1..385: note = chr7:95225822-95226207
  misc_feature 1..385: note = hyper
  source 1..385: mol_type = genomic DNA
agtcttcccaccagccgccgccgcccgaggttttatttgtctccccgcactctccccccgagtcccaaacaggaggagtcactggaacttggaaacgcgtcctgaactccaggtcgcgccaatcagatcagagaaagaactatgggctccgcccctccagccgcggtcatcacagaatggcctggcacggtgaccacggagtgccctggcaccggtgcccgcggctgtgacggaaaaagggtgggaagaacagggaagaggaagcagaaacaggtatctggggcaacgtgggcttaagattagcctcttgggacggggctccgagtcgcgtgggctggggtcccgcccaggctcgcccttgtttacaactcggaggctgtctcaa

SEQ ID NO: 98206 - DNA, 48 bp, Homo sapiens
  misc_feature 1..48: note = chr7:95401676-95401724
  misc_feature 1..48: note = hyper
  source 1..48: mol_type = genomic DNA
aggtctaagtcctaccgacgttagagggatagacgaattgacctttcc

SEQ ID NO: 98207 - DNA, 420 bp, Homo sapiens
  misc_feature 1..420: note = chr7:95402025-95402445
  misc_feature 1..420: note = hyper
  source 1..420: mol_type = genomic DNA
ccgcccaggagccgccgccggctcggggagcccagttccgccgctgccgagcgcgtccaggtaaactggagcgggatgtcgccgctccccggacggccgcctccgcacctctccccaaccctccccaccccggtgtcgtctgcgctgggaaccaggctggagccgaggcccctgcagccgcagccggacccttgtcctggccccctgcccaggctcctgcgtgctccgctgagcccgaaggcggccaaagccccccagtgacacccccctctcggcagagccgagagactagggcagagaaggaagggtcgtggtgtcaccacctggtcgcccaccttgtgggctgggaagggcgtcccagtgcgccccgcctcggtcttccccgggggagcagtgggcgagcggcgctgaaatctgcac

SEQ ID NO: 98208 - DNA, 396 bp, Homo sapiens
  misc_feature 1..396: note = chr7:959576-959972
  misc_feature 1..396: note = hypo
  source 1..396: mol_type = genomic DNA
aggccccaccccacccgggtggcctcacctgccgagtagggctcctgcttctccgggtagatgaactcctgtcgctcgtacttggcccggatccactgctctcgaaggagcctgtggggagaggagagactgagccactgggccaaggcggcctccgacccagcacacgccgctctctggcccggaccctggacatctcaagaggctcatagggacccccggcagactcgagccgcccctctgggcacaagatcccggaagaaatgcagggtcagcctcctgcccgggacgcttctcactctgatattagtttattggtttcttgtgcgttcggcccccggagcatcaggcctcacgttctgcacaagcgttcccggtggacgggctggtgcctcc

SEQ ID NO: 98209 - DNA, 37 bp, Homo sapiens
  misc_feature 1..37: note = chr7:965972-966009
  misc_feature 1..37: note = hypo
  source 1..37: mol_type = genomic DNA
ccagccccaccccagcgccccccgccccagaaccaaa

SEQ ID NO: 98210 - DNA, 30 bp, Homo sapiens
  misc_feature 1..30: note = chr7:96619573-96619603
  misc_feature 1..30: note = hyper
  source 1..30: mol_type = genomic DNA
agcggtgtcctatcacggggaaacagtcat

SEQ ID NO: 98211 - DNA, 634 bp, Homo sapiens
  misc_feature 1..634: note = chr7:96621715-96622349
  misc_feature 1..634: note = hyper
  source 1..634: mol_type = genomic DNA
ctgtgattccaggagcgcgtgtgggcgcggtcctcgccgcgacgccgcgcgcgggtcaggctcaactgcgaaccttgccaccgagctttcccgcgggaggcttcgaatataaccttgcctatttctcgcctactgagatttctttccagaaaaggacattctcctgctccgaggagatggatccctgaggtccccatgcccgcacagggtgtcctggaggagtttagaggacactcctggggcccttccctgtgtagtacgcttattcccgaggtgggggctgagaatcgaagagcagcgccccccacactgggattgggggtggtcgaggggctacagatgcccgcattgggcttcttagcggcctaggctgatgcctggaggtaggggggattgggtttggctggcgactagctttaatgcccatcgagttcctgggacacccaagttcagcacttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 98212 - DNA, 642 bp, Homo sapiens
  misc_feature 1..642: note = chr7:96625570-96626212
  misc_feature 1..642: note = hyper
  source 1..642: mol_type = genomic DNA
gattctggagtccaccggcgcttgggcaggtagcaagcagagctagctgcacgttgccccggccggcgttttcaaacaacttgaattacaggctacatcttgaatatgaattagccttccgcactggtgtgaattcgctttgaaactcaacttgtcaagtatggttttaattaaacatcttccggcctcgaaagattacatgttttgtaaaatatattctagcatgaaatttacttccacgatctgaaattagttttttggtaaatgttttcataaaaaagaaatacgaggtgtgtgtgtgtgtgtgtgtgtgtgtgtgtgtgtcagagagagagaagagaaggggggtatgaagtagtttatattcactgccttcctttaaaacgtcctaccagctggacttggagcctgacaggtcccgggtcccaggtcccaggcagccccggccggggcagggccaagaccgcgtgcccaggacaagtaagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 98213 - DNA, 126 bp, Homo sapiens
  misc_feature 1..126: note = chr7:96627308-96627434
  misc_feature 1..126: note = hyper
  source 1..126: mol_type = genomic DNA
agtactcagttgccacgtctcgcaggaactttggagcaagttttcagctcccaggtgtccaacctttaaaaggaaaagcataataatactaacctttctttcacgaccacgcgaaacgcaaaggat

SEQ ID NO: 98214 - DNA, 36 bp, Homo sapiens
  misc_feature 1..36: note = chr7:96628041-96628077
  misc_feature 1..36: note = hyper
  source 1..36: mol_type = genomic DNA
ttttactattaaaaacgctgccgagcaacacattga

SEQ ID NO: 98215 - DNA, 144 bp, Homo sapiens
  misc_feature 1..144: note = chr7:96631691-96631835
  misc_feature 1..144: note = hyper
  source 1..144: mol_type = genomic DNA
gagagaaatgactgtcggaagaggccctgcggtaaatagcctctgagccgcgaactctatgcgccgtggccggtggcagaggccacacctggcagccactcgtggcgcgccaccttggcatgttgtgtgcgggtcacactatct

SEQ ID NO: 98216 - DNA, 30 bp, Homo sapiens
  misc_feature 1..30: note = chr7:96632234-96632264
  misc_feature 1..30: note = hyper
  source 1..30: mol_type = genomic DNA
tccgaggccctgccacgacatactctaatt

SEQ ID NO: 98217 - DNA, 30 bp, Homo sapiens
  misc_feature 1..30: note = chr7:96632789-96632819
  misc_feature 1..30: note = hyper
  source 1..30: mol_type = genomic DNA
ggagggggagaggagcgcaaacgccgctga

SEQ ID NO: 98218 - DNA, 500 bp, Homo sapiens
  misc_feature 1..500: note = chr7:96633044-96633544
  misc_feature 1..500: note = hyper
  source 1..500: mol_type = genomic DNA
agttaaaggggcaagcggcaccttttctctatttctcagtttccttcggtcctgtaacttatggagtccagaagaagtaggatatacagaagtcctcagtagttttcccaaagggagacactgtctccttcccgcaacctccagacactgcagtacagggttgttagatattagatagtacgtttctccgtgtgggcaaaggctcgcggcttaggtctctaagcagatcgaaagtcggggtccagaccgagaggatcttcaggtctcgtccacccaatctcaagcctctggaagggcgggctgccggcgacctcctccagtcccgggacccggaacccgggaccctggacgccggtgcgggcgggcctgccctcctctgtgcctggcccccagtctggccctcctacctgttgaccaggcctgaaccacgcaccggggctccgctgtctctgcttggctgccttaacctgcgtgggtctggagaccggagggagaaaggc

SEQ ID NO: 98219 - DNA, 50 bp, Homo sapiens; identical to SEQ ID NO: 31392
  misc_feature 1..50: note = chr7:96634276-96634326
  misc_feature 1..50: note = hyper
  source 1..50: mol_type = genomic DNA

SEQ ID NO: 98220 - DNA, 267 bp, Homo sapiens
  misc_feature 1..267: note = chr7:96634652-96634919
  misc_feature 1..267: note = hyper
  source 1..267: mol_type = genomic DNA
gcatcggcggccggccgggcagaggcgcctccctccccaacggccccgggcgccacacagcgcggcccccggctgcagctccggctgggattggaactgcggaaggtaggcgaagaactctgcaagtcgcgcacacgccagtagaagccgtgcgcctgtgacgtcagggggcgactgaccaatggggaggcactgccctttggagacaaaccattcgactcgtggcgtctgcatcaagtctgaaagcagacgcgcaactttcgcaga

SEQ ID NO: 98221 - DNA, 248 bp, Homo sapiens; identical to SEQ ID NO: 31394
  misc_feature 1..248: note = chr7:96635204-96635452
  misc_feature 1..248: note = hyper
  source 1..248: mol_type = genomic DNA

SEQ ID NO: 98222 - DNA, 104 bp, Homo sapiens; identical to SEQ ID NO: 9117
  misc_feature 1..104: note = chr7:96635486-96635590
  misc_feature 1..104: note = hyper
  source 1..104: mol_type = genomic DNA

SEQ ID NO: 98223 - DNA, 353 bp, Homo sapiens; identical to SEQ ID NO: 31396
  misc_feature 1..353: note = chr7:96635619-96635972
  misc_feature 1..353: note = hyper
  source 1..353: mol_type = genomic DNA

SEQ ID NO: 98224 - DNA, 774 bp, Homo sapiens; identical to SEQ ID NO: 31397
  misc_feature 1..774: note = chr7:96636033-96636807
  misc_feature 1..774: note = hyper
  source 1..774: mol_type = genomic DNA

SEQ ID NO: 98225 - DNA, 55 bp, Homo sapiens
  misc_feature 1..55: note = chr7:96641698-96641753
  misc_feature 1..55: note = hyper
  source 1..55: mol_type = genomic DNA
gaattattcaaattacgttagggagaatgctaccatacatcgaaaccaacactaa

SEQ ID NO: 98226 - DNA, 106 bp, Homo sapiens
  misc_feature 1..106: note = chr7:96642021-96642127
  misc_feature 1..106: note = hyper
  source 1..106: mol_type = genomic DNA
tggtaagcggattcccgagggagggattggtaggaggggcgtgggcgaaaggcatcgcccagtggtggtgcctacgacgcctccccacgttcggacttctccagag

SEQ ID NO: 98227 - DNA, 60 bp, Homo sapiens
  misc_feature 1..60: note = chr7:96642748-96642808
  misc_feature 1..60: note = hyper
  source 1..60: mol_type = genomic DNA
gcctttgcaaatgtccgcatacctgtggttctaaaggagccccgtcgcgagctccgtttg

SEQ ID NO: 98228 - DNA, 1720 bp, Homo sapiens
  misc_feature 1..1720: note = chr7:96645617-96647337
  misc_feature 1..1720: note = hyper
  source 1..1720: mol_type = genomic DNA
agatgcaacagaaaacgctgggggttggcgcgggggggaagagacagggctgcgtagaaaatatttaaccaatcccacatgtgccaccgctatttgggctatttttaaggcccagagttcgctgcgactgggctgaggttgaaaaaaaccaagcactgtgtgcaaagaccgcgggcaacctgggagcgcgagccgaggccgagagcaagccgcagcgccccctccccaagctctggagcggcgggagcctccaccggctactgtgggagggggtgcttaagggtggaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttgcagggatggggcggagaggaggggcggttgggtagcctaaaggtccctctcccagaatacaaggaagcgctaagaaggaggatgtgggggcagtgttccagcaggcatcccaggctcttccggctggagagctcaggagactgagcggtgtcaaggctggagtgagctatagggtgcgctgggaggaggtgagcgcagcctggctttggcgcgctgtgggtgactcccaggacggcgcggccaggacgccgcgagccgtggggcgtccggtgggatcaaaggaaccagaggaggccagccgacgcgtctgggattgtgggataaggggcgggagagaggagattgacatgggcggggagatcctggcctggcctgtgtcaccggagggggttgtgtgcgtttgtgtctttgtgcggatcaacgctctcgggcctgaggccgtgccctgggtggatccgagtgtgagtggacaggctcccgggtgggtgcccagacgggagggagagcgagcgagcgagatcaagggcagcgaggtctgcgggttcctctgtgtgtgtgtctcaggccctgtggctcagcactggagccgcctggcacccacaggaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaatggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 98229 - DNA, 769 bp, Homo sapiens
  misc_feature 1..769: note = chr7:96647540-96648309
  misc_feature 1..769: note = hyper
  source 1..769: mol_type = genomic DNA
ttctctagaagaatccgaaccctcccttccctcagctcggccgcgcccggtgaatagggatgaggaagggatcccccttcttttccaccagtaatggggctggggagttgatagggacagctggaaaaatatctgccctctttgtgtgcacaaaggaaaacagtatgttccaagcacattcttgccactcacaggcagccagtaggtgagaaatattggaggtgtgcagtgggtgcgccctcacccccaaccttcccaaacacgcaccccttggcagggagaggcgtccgcgcaggggaaagccaggcgctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcggagccaggctgcgggatatgtctaaagagcggtcaaaatactgattcctccaagaagcaagctgttccacactggcgggcctggtaactc

SEQ ID NO: 98230 - DNA, 16 bp, Homo sapiens
  misc_feature 1..16: note = chr7:96650421-96650437
  misc_feature 1..16: note = hyper
  source 1..16: mol_type = genomic DNA
tcgcccgcgccttccc

SEQ ID NO: 98231 - DNA, 326 bp, Homo sapiens
  misc_feature 1..326: note = chr7:96650751-96651077
  misc_feature 1..326: note = hyper
  source 1..326: mol_type = genomic DNA
cgcgagcccggcggggaaggggcgtggggcgggctacgcgcgcctgtggtcagaaaaaggagcgagctcccaacctcccgtcctactcccttcactccctctgcagctcagagaggccagaatctgactgcagctcttggcggcgactcgaacattctttatgcttccgtaggccccagctgggttggaggagtaaaaggaatgggacaatccaggaagacttctcacgtacaatagcgccccccacctcgcgacccttcggtggccgtggcctgaagctcccgtaggctcagggcacgacccttcagtttctccgctccaggcga

SEQ ID NO: 98232 - DNA, 366 bp, Homo sapiens
  misc_feature 1..366: note = chr7:96651136-96651502
  misc_feature 1..366: note = hyper
  source 1..366: mol_type = genomic DNA
cgaggaggctctacattgttaagaaaaccagatagctgctctgggctgcctaggccgccctagaaataaccctccgcttgctttcaacccgcgaaattggccccacagctccggaggcccgctacggggtgggggcggggggcgcggttagtgggaggtatctccagaccgctgatgaataccatccccaccgtctcaaggcctgactcaccgagttaaagcataggggctgatgtctttgggtctgttagtttctcacgggtactgtcaaaacagctccagtcccatcgagactgaaccgcgcgacccaaccagacgtgcagctcaggcaggtctagtgcatggcagcgccgtatttacctgtgt

SEQ ID NO: 98233 - DNA, 118 bp, Homo sapiens; identical to SEQ ID NO: 31404
  misc_feature 1..118: note = chr7:96651845-96651963
  misc_feature 1..118: note = hyper
  source 1..118: mol_type = genomic DNA

SEQ ID NO: 98234 - DNA, 413 bp, Homo sapiens
  misc_feature 1..413: note = chr7:96652017-96652430
  misc_feature 1..413: note = hyper
  source 1..413: mol_type = genomic DNA
cgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagttcaaagacccacaagcaaactgctccttcacttcagcagcaagcggtcggggccgccgcagacagagggtcgattatgcaacccccataatctcgctgcagatctgcgagggcacagatgtgtctggtttcttttacaaatagacttaatatgttcttggcaaaaaaaaaaaaaaaaaaaagaaatcttccacttatgcacggaatacagagagagtgaaagaaacgtagacacctcaacccggggctctctttta

SEQ ID NO: 98235 - DNA, 30 bp, Homo sapiens
  misc_feature 1..30: note = chr7:96652891-96652921
  misc_feature 1..30: note = hyper
  source 1..30: mol_type = genomic DNA
gacgaaaaaggaggacggaaagacaaattg

SEQ ID NO: 98236 - DNA, 638 bp, Homo sapiens
  misc_feature 1..638: note = chr7:96653182-96653820
  misc_feature 1..638: note = hyper
  source 1..638: mol_type = genomic DNA
cgcaccaacccagcacgcttaccaaaattcccaagtaaccttctctttgttacgcaaacgccaggagctgcttgattctttcttctctccacccctatcccctttccagcctagccggcttcctggccgggcaagctgggaattcagcgactgaagggccttggaaggtgccggaggggagagacgctagttcgaacctccacagggctctcctactaaaaatccctaaaatgctggcccgagaaactctctttgttggagggtctgagtcctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 98237 - DNA, 304 bp, Homo sapiens
  misc_feature 1..304: note = chr7:96653862-96654166
  misc_feature 1..304: note = hyper
  source 1..304: mol_type = genomic DNA
cggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggaggaagaggaggaggagagaaggaggaggcggcggccgcggcgaggaggagactgggagtcgtgaagtctctgtctccggccggctgactgctggctgaggcgcagcacagccttg

SEQ ID NO: 98238 - DNA, 83 bp, Homo sapiens; identical to SEQ ID NO: 31408
  misc_feature 1..83: note = chr7:96656775-96656858
  misc_feature 1..83: note = hyper
  source 1..83: mol_type = genomic DNA

SEQ ID NO: 98239 - DNA, 221 bp, Homo sapiens
  misc_feature 1..221: note = chr7:966840-967061
  misc_feature 1..221: note = hypo
  source 1..221: mol_type = genomic DNA
gggagaaggaaacggcgccgtgaaggaggggaggtgctgcaggaggctgtcgttccaggaggctcgtgctccaggaggctgtcacgcacactgtgctcctggcaggcgcaaaggccctgagggtggacgctggcaatgaccctgccgccagccaggtatggtgagccttgagcagcaggaggggccgccacaccccacgccagccccgagggcatgggaga

SEQ ID NO: 98240 - DNA, 39 bp, Homo sapiens
  misc_feature 1..39: note = chr7:96747112-96747151
  misc_feature 1..39: note = hyper
  source 1..39: mol_type = genomic DNA
cctcaaatccctgggcgaccagtacgtgaaagacgaatt

SEQ ID NO: 98241 - DNA, 22 bp, Homo sapiens
  misc_feature 1..22: note = chr7:96968265-96968287
  misc_feature 1..22: note = hypo
  source 1..22: mol_type = genomic DNA
gccaccgcgcctggccctattt

SEQ ID NO: 98242 - DNA, 26 bp, Homo sapiens
  misc_feature 1..26: note = chr7:97234138-97234164
  misc_feature 1..26: note = hypo
  source 1..26: mol_type = genomic DNA
gccaccgcgcccggccaatacaatga

SEQ ID NO: 98243 - DNA, 418 bp, Homo sapiens; identical to SEQ ID NO: 31409
  misc_feature 1..418: note = chr7:97361005-97361423
  misc_feature 1..418: note = hyper
  source 1..418: mol_type = genomic DNA

SEQ ID NO: 98244 - DNA, 261 bp, Homo sapiens; identical to SEQ ID NO: 31410
  misc_feature 1..261: note = chr7:97361520-97361781
  misc_feature 1..261: note = hyper
  source 1..261: mol_type = genomic DNA

SEQ ID NO: 98245 - DNA, 518 bp, Homo sapiens; identical to SEQ ID NO: 31411
  misc_feature 1..518: note = chr7:97362187-97362705
  misc_feature 1..518: note = hyper
  source 1..518: mol_type = genomic DNA

SEQ ID NO: 98246 - DNA, 610 bp, Homo sapiens
  misc_feature 1..610: note = chr7:97362706-97363316
  misc_feature 1..610: note = hyper
  source 1..610: mol_type = genomic DNA
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaag

SEQ ID NO: 98247 - DNA, 120 bp, Homo sapiens
  misc_feature 1..120: note = chr7:97589532-97589652
  misc_feature 1..120: note = hypo
  source 1..120: mol_type = genomic DNA
gatattacgtgtcatattctctagaaatattactcgtatgtcacaggtcctatacaccctttaatattcttcataatattgtaggaataggtgactactaatgtcacagggcgagtcgga

SEQ ID NO: 98248 - DNA, 242 bp, Homo sapiens
  misc_feature 1..242: note = chr7:97591231-97591473
  misc_feature 1..242: note = hypo
  source 1..242: mol_type = genomic DNA
aggggctgtacaccccgtgatattattcataatatcttaaagaaatattaccactaatatcacaggtggtgtacaccctgtggtattattcccgatgttgtagggtgatgttactcctaatgttacagatggtattcacattctgataatactcgtcataccctaaagggatgttactactgatgtcacaatgcacgtacacaatctgatattatttcttatatcctcgggcaatgttgctt

SEQ ID NO: 98249 - DNA, 136 bp, Homo sapiens
  misc_feature 1..136: note = chr7:97600089-97600225
  misc_feature 1..136: note = hypo
  source 1..136: mol_type = genomic DNA
cttagctattgaaaacgctaagttcagtgtcgacctcttgtgtcgcacatgctaatgacaaaaccaaagaaaaaccggttttagaaaaacaggaattgtaatcctagcactttgagaggccgaggtgagaggatca

SEQ ID NO: 98250 - DNA, 76 bp, Homo sapiens
  misc_feature 1..76: note = chr7:97600285-97600361
  misc_feature 1..76: note = hypo
  source 1..76: mol_type = genomic DNA
aataataacaggaattatctcatcattgtgcaaatactgcccaacagtcagaaggcaatttcgatagtcaataagt

SEQ ID NO: 98251 - DNA, 25 bp, Homo sapiens
  misc_feature 1..25: note = chr7:97602847-97602872
  misc_feature 1..25: note = hypo
  source 1..25: mol_type = genomic DNA
tctccgcctgattgacggaatgaac

SEQ ID NO: 98252 - DNA, 78 bp, Homo sapiens
  misc_feature 1..78: note = chr7:97627595-97627673
  misc_feature 1..78: note = hypo
  source 1..78: mol_type = genomic DNA
gtaatctgtgggctccggtgcacggtgaaaatgcaagtcctgccgggcgcggtggctggtgtctgtagttccagctac

SEQ ID NO: 98253 - DNA, 30 bp, Homo sapiens
  misc_feature 1..30: note = chr7:9766521-9766551
  misc_feature 1..30: note = hypo
  source 1..30: mol_type = genomic DNA
agcttctgattgacccgccccggtatatcc

SEQ ID NO: 98254 - DNA, 151 bp, Homo sapiens
  misc_feature 1..151: note = chr7:97680597-97680748
  misc_feature 1..151: note = hyper
  source 1..151: mol_type = genomic DNA
cccacttccgggatccggtttggctccgcccccgccctgctgtatccatggtaaccaggtctccttcgcaaggctggaccagtcgccacgacgagctccggggcgccaccggtggcctctctgatggcccgctcggcgaggggtccccagc

SEQ ID NO: 98255 - DNA, 30 bp, Homo sapiens
  misc_feature 1..30: note = chr7:97689387-97689417
  misc_feature 1..30: note = hypo
  source 1..30: mol_type = genomic DNA
gacacatcaaaccctcgtaatgtggaacat

SEQ ID NO: 98256 - DNA, 22 bp, Homo sapiens
  misc_feature 1..22: note = chr7:9772342-9772364
  misc_feature 1..22: note = hypo
  source 1..22: mol_type = genomic DNA
ttacaggcgtgagccaccgtgc

SEQ ID NO: 98257 - DNA, 30 bp, Homo sapiens
  misc_feature 1..30: note = chr7:97738118-97738148
  misc_feature 1..30: note = hypo
  source 1..30: mol_type = genomic DNA
tatattttgaagtatcgattctttatagga

SEQ ID NO: 98258 - DNA, 102 bp, Homo sapiens
  misc_feature 1..102: note = chr7:97797696-97797798
  misc_feature 1..102: note = hypo
  source 1..102: mol_type = genomic DNA
cgaggccccgggcttcgcggaggcgtggcggcgtcagctgccccagtctgcatgtcttctatttcattagcagaagcgggggtgttgcgctgtctatatcat

SEQ ID NO: 98259 - DNA, 30 bp, Homo sapiens; identical to SEQ ID NO: 41372
  misc_feature 1..30: note = chr7:97804272-97804302
  misc_feature 1..30: note = hypo
  source 1..30: mol_type = genomic DNA

SEQ ID NO: 98260 - DNA, 30 bp, Homo sapiens; identical to SEQ ID NO: 41373
  misc_feature 1..30: note = chr7:97807742-97807772
  misc_feature 1..30: note = hypo
  source 1..30: mol_type = genomic DNA

SEQ ID NO: 98261 - DNA, 134 bp, Homo sapiens
  misc_feature 1..134: note = chr7:97834167-97834301
  misc_feature 1..134: note = hypo
  source 1..134: mol_type = genomic DNA
gctcttcagcaggctcgtaagagcacttgacccctggacttgggaccagcccacatgccctctggtgctgcccctggaatgttggttttgctgctgagtcttggtcctggtgtggctcccgagggcggggtggg

SEQ ID NO: 98262 - DNA, 41 bp, Homo sapiens
  misc_feature 1..41: note = chr7:97839783-97839824
  misc_feature 1..41: note = hypo
  source 1..41: mol_type = genomic DNA
aaaaacaaacaaacaaacaaaacaggcgttcccaaggactg

SEQ ID NO: 98263 - DNA, 30 bp, Homo sapiens
  misc_feature 1..30: note = chr7:97844525-97844555
  misc_feature 1..30: note = hypo
  source 1..30: mol_type = genomic DNA
agagctccgaaggcgcgatccccatcccca

SEQ ID NO: 98264 - DNA, 144 bp, Homo sapiens
  misc_feature 1..144: note = chr7:97844894-97845038
  misc_feature 1..144: note = hypo
  source 1..144: mol_type = genomic DNA
tcagcagcgagaggacgcgtcactctgccgttctgcagggtgacgccctccccgtacctcgctgagagccacctgcagacacagcaggccacagcagaatgcacaggtcactgttgtaggggaacaaatcgtaatgcccagaga

SEQ ID NO: 98265 - DNA, 57 bp, Homo sapiens
  misc_feature 1..57: note = chr7:97846981-97847038
  misc_feature 1..57: note = hypo
  source 1..57: mol_type = genomic DNA
caaggccgcgggccccgctcaccccgatgccgtagtcccagccgtggcccttgggct

SEQ ID NO: 98266 - DNA, 87 bp, Homo sapiens
  misc_feature 1..87: note = chr7:97852229-97852316
  misc_feature 1..87: note = hypo
  source 1..87: mol_type = genomic DNA
gggtctgagccctgccggactccagagcaaaggtctcatttcaagaagaatctgtctggccccggcactcaccgcagggttgagctc

SEQ ID NO: 98267 - DNA, 30 bp, Homo sapiens
  misc_feature 1..30: note = chr7:97852802-97852832
  misc_feature 1..30: note = hypo
  source 1..30: mol_type = genomic DNA
acatttactcagattcggcttccctcttca

SEQ ID NO: 98268 - DNA, 31 bp, Homo sapiens
  misc_feature 1..31: note = chr7:97869134-97869165
  misc_feature 1..31: note = hypo
  source 1..31: mol_type = genomic DNA
gtgactggccaggcacggtggctcatgcctg

SEQ ID NO: 98269 - DNA, 330 bp, Homo sapiens
  misc_feature 1..330: note = chr7:97869405-97869735
  misc_feature 1..330: note = hypo
  source 1..330: mol_type = genomic DNA
gcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgctgcatttgggtaccagcgtgtgggtggaagaggattttacggcacaaaacgtcctggagattggcaacaatttcagcaacaaacaatgcatggtgctcagctggtgccggatttgttctaat

SEQ ID NO: 98270 - DNA, 30 bp, Homo sapiens
  misc_feature 1..30: note = chr7:978819-978849
  misc_feature 1..30: note = hypo
  source 1..30: mol_type = genomic DNA
gtgatggagactctacggccctaaaatatt

SEQ ID NO: 98271 - DNA, 42 bp, Homo sapiens; identical to SEQ ID NO: 41377
  misc_feature 1..42: note = chr7:97882348-97882390
  misc_feature 1..42: note = hypo
  source 1..42: mol_type = genomic DNA

SEQ ID NO: 98272 - DNA, 77 bp, Homo sapiens
  misc_feature 1..77: note = chr7:97899729-97899806
  misc_feature 1..77: note = hypo
  source 1..77: mol_type = genomic DNA
ctgtccagttcctcccgggcctcccaacgcccccgatggctccttccccctggccatctgtccggtccctccttcat

SEQ ID NO: 98273 - DNA, 30 bp, Homo sapiens
  misc_feature 1..30: note = chr7:97917070-97917100
  misc_feature 1..30: note = hypo
  source 1..30: mol_type = genomic DNA
ggaggctggtgtgggcggggcccccaggca

SEQ ID NO: 98274 - DNA, 65 bp, Homo sapiens
  misc_feature 1..65: note = chr7:97925156-97925221
  misc_feature 1..65: note = hypo
  source 1..65: mol_type = genomic DNA
cgcagcaagaagcaccgactcctgccaggaggactgaggaggaaaaagaacgcttaagatgacag

SEQ ID NO: 98275 - DNA, 30 bp, Homo sapiens
  misc_feature 1..30: note = chr7:98088677-98088707
  misc_feature 1..30: note = hypo
  source 1..30: mol_type = genomic DNA
tgctgggccccgcaccgtgttccccagcca

SEQ ID NO: 98276 - DNA, 22 bp, Homo sapiens
  misc_feature 1..22: note = chr7:98121341-98121363
  misc_feature 1..22: note = hypo
  source 1..22: mol_type = genomic DNA
agaaattaacagggccgggcgc

SEQ ID NO: 98277 - DNA, 62 bp, Homo sapiens
  misc_feature 1..62: note = chr7:98121881-98121943
  misc_feature 1..62: note = hypo
  source 1..62: mol_type = genomic DNA
ttttgcttggagcatcgacttataaccccagcccgagagagccgtggcgtccttgtgtgggt

SEQ ID NO: 98278 - DNA, 30 bp, Homo sapiens
  misc_feature 1..30: note = chr7:98122148-98122178
  misc_feature 1..30: note = hypo
  source 1..30: mol_type = genomic DNA
cctcgtggctccttgcgaatacagcggacc

SEQ ID NO: 98279 - DNA, 198 bp, Homo sapiens; identical to SEQ ID NO: 15009
  misc_feature 1..198: note = chr7:98183080-98183278
  misc_feature 1..198: note = hypo
  source 1..198: mol_type = genomic DNA

SEQ ID NO: 98280 - DNA, 223 bp, Homo sapiens; identical to SEQ ID NO: 695
  misc_feature 1..223: note = chr7:98245856-98246079
  misc_feature 1..223: note = hyper
  source 1..223: mol_type = genomic DNA

SEQ ID NO: 98281 - DNA, 204 bp, Homo sapiens; identical to SEQ ID NO: 696
  misc_feature 1..204: note = chr7:98246304-98246508
  misc_feature 1..204: note = hyper
  source 1..204: mol_type = genomic DNA

SEQ ID NO: 98282 - DNA, 1315 bp, Homo sapiens; identical to SEQ ID NO: 31416
  misc_feature 1..1315: note = chr7:98246533-98247848
  misc_feature 1..1315: note = hyper
  source 1..1315: mol_type = genomic DNA

SEQ ID NO: 98283 - DNA, 102 bp, Homo sapiens
  misc_feature 1..102: note = chr7:986234-986336
  misc_feature 1..102: note = hypo
  source 1..102: mol_type = genomic DNA
atggcgggaaccccacggtgaaggccatccccagtcctccctggacccaccctgtcccggagcccactctctggggcccccaccccgcgcccctccaggctc

SEQ ID NO: 98284 - DNA, 109 bp, Homo sapiens
  misc_feature 1..109: note = chr7:98635920-98636029
  misc_feature 1..109: note = hypo
  source 1..109: mol_type = genomic DNA
gcaggcctcacacagcgaaggagctacagcaactaaatgcaggctcagccgcgccccaggcacctggccgtccccgacaggtggcattaccggacgtattctttcttat

SEQ ID NO: 98285 - DNA, 30 bp, Homo sapiens
  misc_feature 1..30: note = chr7:98964581-98964611
  misc_feature 1..30: note = hypo
  source 1..30: mol_type = genomic DNA
ggaggccctggggcccggtgcccacagcat

SEQ ID NO: 98286 - DNA, 30 bp, Homo sapiens
  misc_feature 1..30: note = chr7:98966380-98966410
  misc_feature 1..30: note = hypo
  source 1..30: mol_type = genomic DNA
gcccactccagtcaccgcagccagaagccc

SEQ ID NO: 98287 - DNA, 95 bp, Homo sapiens
  misc_feature 1..95: note = chr7:98970776-98970871
  misc_feature 1..95: note = hypo
  source 1..95: mol_type = genomic DNA
actaccctagggggtcgaattcagtggaaaagagagcggcggctaagggcacctccaatggggagggtgtcggggcaaagcgacctgagaccccc

SEQ ID NO: 98288 - DNA, 80 bp, Homo sapiens
  misc_feature 1..80: note = chr7:98971520-98971600
  misc_feature 1..80: note = hypo
  source 1..80: mol_type = genomic DNA
ccaccgcgaccggccgaggtaaggttttcactggggtctcttccatctgcctggccgccaggccacgtatccactgaaga

SEQ ID NO: 98289 - DNA, 316 bp, Homo sapiens
  misc_feature 1..316: note = chr7:98991466-98991782
  misc_feature 1..316: note = hypo
  source 1..316: mol_type = genomic DNA
catttgcctgcacctcgcatgccactgtccccaaggcagaactgacttctaagcccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccag

SEQ ID NO: 98290 - DNA, 403 bp, Homo sapiens
  misc_feature 1..403: note = chr7:99020763-99021166
  misc_feature 1..403: note = hypo
  source 1..403: mol_type = genomic DNA
ttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaacagagtgggaagggggaggggagactttcatcccaggtcagagcggcagccagctgggcatgtctgagggccacttaagcagagacctccaggaaaagtgggtgccacctgaggcagcgggaacaccaatcccgaagcaggcaagaggttggtggcctctgcgaactgacagaagg

SEQ ID NO: 98291 - DNA, 31 bp, Homo sapiens
  misc_feature 1..31: note = chr7:99101324-99101355
  misc_feature 1..31: note = hypo
  source 1..31: mol_type = genomic DNA
agagcactgggaggtcgatgcgggcgcatca

SEQ ID NO: 98292 - DNA, 185 bp, Homo sapiens
  misc_feature 1..185: note = chr7:99103865-99104050
  misc_feature 1..185: note = hypo
  source 1..185: mol_type = genomic DNA
gctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatat

SEQ ID NO: 98293 - DNA, 35 bp, Homo sapiens
  misc_feature 1..35: note = chr7:99104258-99104293
  misc_feature 1..35: note = hypo
  source 1..35: mol_type = genomic DNA
gtagaagacaatctgcgatcttatttattttttaa

SEQ ID NO: 98294 - DNA, 247 bp, Homo sapiens
  misc_feature 1..247: note = chr7:99149175-99149422
  misc_feature 1..247: note = hyper
  source 1..247: mol_type = genomic DNA
cggacactggcttaacgagcccatccgaataaaacaaattataaggccaatggcacttggtatcgtgtaagatcgccagaattttacaactcggggtacccaggaaaccagaaaagcccccaccacaagaaaaaccagtgggcacaactggggagcacagatatctgactggggtcattttgtccgcgcgtctttggggtaaaacaccaggactgggggtccagaagggacacgcagaccgcctctc

SEQ ID NO: 98295 - DNA, 63 bp, Homo sapiens
  misc_feature 1..63: note = chr7:99155751-99155814
  misc_feature 1..63: note = hyper
  source 1..63: mol_type = genomic DNA
gacctactgagatttcgatcccacaacttagtgggtcccatctcacccaggccccgcaatcct

SEQ ID NO: 98296 - DNA, 195 bp, Homo sapiens; identical to SEQ ID NO: 9139
  misc_feature 1..195: note = chr7:99155931-99156126
  misc_feature 1..195: note = hyper
  source 1..195: mol_type = genomic DNA

SEQ ID NO: 98297 - DNA, 473 bp, Homo sapiens
  misc_feature 1..473: note = chr7:99156127-99156600
  misc_feature 1..473: note = hyper
  source 1..473: mol_type = genomic DNA
ggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 98298 - DNA, 167 bp, Homo sapiens
  misc_feature 1..167: note = chr7:99156815-99156982
  misc_feature 1..167: note = hyper
  source 1..167: mol_type = genomic DNA
ccgctcaaacctgttcgaaccgcagctcttacctgcgttgctctcaggattccgggaaaaggccggtctagctggtctgagttagcgaagggcctgaccccaaaagtggagttttattcgccaagcccgtgtagtaaatcggagtgggctgacggtgttaccaagac

SEQ ID NO: 98299 - DNA, 589 bp, Homo sapiens; identical to SEQ ID NO: 31423
  misc_feature 1..589: note = chr7:99177694-99178283
  misc_feature 1..589: note = hyper
  source 1..589: mol_type = genomic DNA

SEQ ID NO: 98300 - DNA, 95 bp, Homo sapiens
  misc_feature 1..95: note = chr7:994535-994630
  misc_feature 1..95: note = hyper
  source 1..95: mol_type = genomic DNA
cctgggtgggaccctcgtgccgccgcgcgcggtgggacggagcctgcacacctactgtggggggcgcagagggcacctgccgagccccccaagac

SEQ ID NO: 98301 - DNA, 23 bp, Homo sapiens
  misc_feature 1..23: note = chr7:9955375-9955398
  misc_feature 1..23: note = hypo
  source 1..23: mol_type = genomic DNA
actgtgcccggccatgttgatga

SEQ ID NO: 98302 - DNA, 31 bp, Homo sapiens
  misc_feature 1..31: note = chr7:99591731-99591762
  misc_feature 1..31: note = hypo
  source 1..31: mol_type = genomic DNA
tgcactccagcttgggcgacagagactctgg

SEQ ID NO: 98303 - DNA, 153 bp, Homo sapiens
  misc_feature 1..153: note = chr7:99595183-99595336
  misc_feature 1..153: note = hyper
  source 1..153: mol_type = genomic DNA
cttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggc

SEQ ID NO: 98304 - DNA, 182 bp, Homo sapiens
  misc_feature 1..182: note = chr7:99595462-99595644
  misc_feature 1..182: note = hyper
  source 1..182: mol_type = genomic DNA
cgccagtctccggctgttgcgccctgggcgccgcctctctccggcccccctttgtttcctgagccagctgggaagactaaaagggtgggtcctgggagcggcccatggttcgacccttcttttcaggcatccttggagcatgcaggctgcagatttcaggccgaccccgctagcaccaaagt

SEQ ID NO: 98305 - DNA, 21 bp, Homo sapiens
  misc_feature 1..21: note = chr7:99648525-99648546
  misc_feature 1..21: note = hypo
  source 1..21: mol_type = genomic DNA
atttgtgtggccgggcgcggt

SEQ ID NO: 98306 - DNA, 24 bp, Homo sapiens
  misc_feature 1..24: note = chr7:99649202-99649226
  misc_feature 1..24: note = hypo
  source 1..24: mol_type = genomic DNA
ccacggcgccgggccccctaggga

SEQ ID NO: 98307 - DNA, 43 bp, Homo sapiens; identical to SEQ ID NO: 41387
  misc_feature 1..43: note = chr7:99691859-99691902
  misc_feature 1..43: note = hypo
  source 1..43: mol_type = genomic DNA

SEQ ID NO: 98308 - DNA, 85 bp, Homo sapiens
  misc_feature 1..85: note = chr7:99700198-99700283
  misc_feature 1..85: note = hypo
  source 1..85: mol_type = genomic DNA
actagtaagaggcatcgggatccgagctcaggtctcctgggttctgatcactccacctccctttttttaacgcctctcttctccc

SEQ ID NO: 98309 - DNA, 156 bp, Homo sapiens
  misc_feature 1..156: note = chr7:99723084-99723240
  misc_feature 1..156: note = hypo
  source 1..156: mol_type = genomic DNA
ctcaattttctatatcgctattaaacttttttctttttttctaaaaactagctgggcccaaagtttcaaacaacagccgggcacacatagctagctggtcgatgaggcagcacccagaatggccgctgtcttgttaagctcaagctccagcctgag

SEQ ID NO: 98310 - DNA, 49 bp, Homo sapiens
  misc_feature 1..49: note = chr7:99725588-99725637
  misc_feature 1..49: note = hyper
  source 1..49: mol_type = genomic DNA
ggagatgtgtttgagcgagatggggacgaggattcgtggcaggcactga

SEQ ID NO: 98311 - DNA, 30 bp, Homo sapiens
  misc_feature 1..30: note = chr7:99736081-99736111
  misc_feature 1..30: note = hypo
  source 1..30: mol_type = genomic DNA
tctctgttccccagccgtgagtgcccttct

SEQ ID NO: 98312 - DNA, 30 bp, Homo sapiens
  misc_feature 1..30: note = chr7:99745367-99745397
  misc_feature 1..30: note = hypo
  source 1..30: mol_type = genomic DNA
accaccacattgtcccggactgaatctggg

SEQ ID NO: 98313 - DNA, 30 bp, Homo sapiens
  misc_feature 1..30: note = chr7:99751448-99751478
  misc_feature 1..30: note = hypo
  source 1..30: mol_type = genomic DNA
ttccctctcctggggcgggggaaggtgtgt

SEQ ID NO: 98314 - DNA, 41 bp, Homo sapiens; identical to SEQ ID NO: 41390
  misc_feature 1..41: note = chr7:99839918-99839959
  misc_feature 1..41: note = hypo
  source 1..41: mol_type = genomic DNA

SEQ ID NO: 98315 - DNA, 30 bp, Homo sapiens
  misc_feature 1..30: note = chr7:998684-998714
  misc_feature 1..30: note = hypo
  source 1..30: mol_type = genomic DNA
gaccagcagggtcctcgggggccggaatca

SEQ ID NO: 98316 - DNA, 25 bp, Homo sapiens
  misc_feature 1..25: note = chr7:99934958-99934983
  misc_feature 1..25: note = hypo
  source 1..25: mol_type = genomic DNA
tgagccaccacgcccagctgccttg

SEQ ID NO: 98317 - DNA, 154 bp, Homo sapiens
  misc_feature 1..154: note = chr8:100026613-100026767
  misc_feature 1..154: note = hypo
  source 1..154: mol_type = genomic DNA
gggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactca

SEQ ID NO: 98318 - DNA, 159 bp, Homo sapiens
  misc_feature 1..159: note = chr8:10005422-10005581
  misc_feature 1..159: note = hypo
  source 1..159: mol_type = genomic DNA
cgaaactccaaagagcgggaaaacgactttagagggaccggaaaggggaagcgagtctcccatggtttgaggtgttgctgcccgtacctgtgcacttggccacagtccaaagtgactccattgcgggcacagccgtggggctgacgtgagaccccagcc

SEQ ID NO: 98319 - DNA, 44 bp, Homo sapiens
  misc_feature 1..44: note = chr8:1000543-1000587
  misc_feature 1..44: note = hypo
  source 1..44: mol_type = genomic DNA
aggaagtaaccccattataagccaaggagcgcctgtccctgaat

SEQ ID NO: 98320 - DNA, 35 bp, Homo sapiens
  misc_feature 1..35: note = chr8:10019317-10019352
  misc_feature 1..35: note = hypo
  source 1..35: mol_type = genomic DNA
gaccttcgtgaatcccgccccgcccctgataacca

SEQ ID NO: 98321 - DNA, 156 bp, Homo sapiens
  misc_feature 1..156: note = chr8:10022508-10022664
  misc_feature 1..156: note = hypo
  source 1..156: mol_type = genomic DNA
ccctgggcgacagagtgaaaaaacaacacaaaaaactgtattgatgtctgggctgcatcctagaccaattaaatcagactcttggagagtgaagtccgggtgttaatattttaaaaaggctccccaggtaattctaatgtgcggcctaggttgaga

SEQ ID NO: 98322 - DNA, 36 bp, Homo sapiens; identical to SEQ ID NO: 41867
  misc_feature 1..36: note = chr8:100245127-100245163
  misc_feature 1..36: note = hypo
  source 1..36: mol_type = genomic DNA

SEQ ID NO: 98323 - DNA, 101 bp, Homo sapiens
  misc_feature 1..101: note = chr8:100359726-100359827
  misc_feature 1..101: note = hypo
  source 1..101: mol_type = genomic DNA
cccaatttctacacccgtgttcagattatcatcaggccaatgtatgagatgggctgtatgctaggctgctggtactccacagtacgcgtgtgccaccttca

SEQ ID NO: 98324 - DNA, 145 bp, Homo sapiens
  misc_feature 1..145: note = chr8:100519073-100519218
  misc_feature 1..145: note = hypo
  source 1..145: mol_type = genomic DNA
ggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaa

SEQ ID NO: 98325 - DNA, 103 bp, Homo sapiens; identical to SEQ ID NO: 41869
  misc_feature 1..103: note = chr8:100904181-100904284
  misc_feature 1..103: note = hypo
  source 1..103: mol_type = genomic DNA

SEQ ID NO: 98326 - DNA, 216 bp, Homo sapiens; identical to SEQ ID NO: 41870
  misc_feature 1..216: note = chr8:100906569-100906785
  misc_feature 1..216: note = hypo
  source 1..216: mol_type = genomic DNA

SEQ ID NO: 98327 - DNA, 29 bp, Homo sapiens
  misc_feature 1..29: note = chr8:100961902-100961931
  misc_feature 1..29: note = hypo
  source 1..29: mol_type = genomic DNA
cctaaagatttcttcgtacatagtaaact

SEQ ID NO: 98328 - DNA, 30 bp, Homo sapiens
  misc_feature 1..30: note = chr8:1010325-1010355
  misc_feature 1..30: note = hypo
  source 1..30: mol_type = genomic DNA
gggcgttggtccctccgctgagtgcttgtg

SEQ ID NO: 98329 - DNA, 486 bp, Homo sapiens; identical to SEQ ID NO: 32203
  misc_feature 1..486: note = chr8:101118005-101118491
  misc_feature 1..486: note = hyper
  source 1..486: mol_type = genomic DNA

SEQ ID NO: 98330 - DNA, 150 bp, Homo sapiens; identical to SEQ ID NO: 41871
  misc_feature 1..150: note = chr8:101156747-101156897
  misc_feature 1..150: note = hypo
  source 1..150: mol_type = genomic DNA

SEQ ID NO: 98331 - DNA, 48 bp, Homo sapiens
  misc_feature 1..48: note = chr8:101158248-101158296
  misc_feature 1..48: note = hyper
  source 1..48: mol_type = genomic DNA
tttgggaagcattaccgtatttaggaatgctaacgtggcctacagtgg

SEQ ID NO: 98332 - DNA, 23 bp, Homo sapiens
  misc_feature 1..23: note = chr8:101241341-101241364
  misc_feature 1..23: note = hypo
  source 1..23: mol_type = genomic DNA
aatgaggaagtaggccgggcgtg

SEQ ID NO: 98333 - DNA, 39 bp, Homo sapiens
  misc_feature 1..39: note = chr8:101257404-101257443
  misc_feature 1..39: note = hypo
  source 1..39: mol_type = genomic DNA
attacaggcgtgagccaccgtgcccgaccccagcagcct

SEQ ID NO: 98334 - DNA, 30 bp, Homo sapiens; identical to SEQ ID NO: 41873
  misc_feature 1..30: note = chr8:101299821-101299851
  misc_feature 1..30: note = hypo
  source 1..30: mol_type = genomic DNA

SEQ ID NO: 98335 - DNA, 30 bp, Homo sapiens
  misc_feature 1..30: note = chr8:101300280-101300310
  misc_feature 1..30: note = hypo
  source 1..30: mol_type = genomic DNA
tctgaacccatttgccgatgtaaactcatg

SEQ ID NO: 98336 - DNA, 30 bp, Homo sapiens
  misc_feature 1..30: note = chr8:101428824-101428854
  misc_feature 1..30: note = hypo
  source 1..30: mol_type = genomic DNA
aggagcagcagcgagcggctgctcagcaag

SEQ ID NO: 98337 - DNA, 30 bp, Homo sapiens; identical to SEQ ID NO: 41874
  misc_feature 1..30: note = chr8:101438141-101438171
  misc_feature 1..30: note = hypo
  source 1..30: mol_type = genomic DNA

SEQ ID NO: 98338 - DNA, 79 bp, Homo sapiens; identical to SEQ ID NO: 32204
  misc_feature 1..79: note = chr8:101661840-101661919
  misc_feature 1..79: note = hyper
  source 1..79: mol_type = genomic DNA

SEQ ID NO: 98339 - DNA, 274 bp, Homo sapiens
  misc_feature 1..274: note = chr8:101693763-101694037
  misc_feature 1..274: note = hypo
  source 1..274: mol_type = genomic DNA
ccacttttcacatatcgagtgacggatgcagacttgcgagggtttgctaagttcttgtaaaggggcaggggtggctgcaagtttcgtcatgcagaggatggatgcaaagtcaaatgctctatctagcaggtcaatttgttttcttgcttgtttgttttttttttccaaaatactgtttaaaaaaaaaatctgttggaaatagtttgagcagtcaagaaaaacaaaagcaaactcagggaaagacaatatactgtctacacgataccaaaacagg

SEQ ID NO: 98340 - DNA, 30 bp, Homo sapiens; identical to SEQ ID NO: 41876
  misc_feature 1..30: note = chr8:101717092-101717122
  misc_feature 1..30: note = hypo
  source 1..30: mol_type = genomic DNA

SEQ ID NO: 98341 - DNA, 36 bp, Homo sapiens
  misc_feature 1..36: note = chr8:101726909-101726945
  misc_feature 1..36: note = hypo
  source 1..36: mol_type = genomic DNA
tcacgtgactgcactccagcccgggtgacagagcaa

SEQ ID NO: 98342 - DNA, 42 bp, Homo sapiens; identical to SEQ ID NO: 41877
  misc_feature 1..42: note = chr8:101729504-101729546
  misc_feature 1..42: note = hypo
  source 1..42: mol_type = genomic DNA

SEQ ID NO: 98343 - DNA, 40 bp, Homo sapiens
  misc_feature 1..40: note = chr8:101736275-101736315
  misc_feature 1..40: note = hypo
  source 1..40: mol_type = genomic DNA
actgcactccagcctggtgacagaacgagactcaaataaa

SEQ ID NO: 98344 - DNA, 27 bp, Homo sapiens
  misc_feature 1..27: note = chr8:101766351-101766378
  misc_feature 1..27: note = hypo
  source 1..27: mol_type = genomic DNA
cctcaagcgatccgcctcagcctctct

SEQ ID NO: 98345 - DNA, 173 bp, Homo sapiens; identical to SEQ ID NO: 32205
  misc_feature 1..173: note = chr8:101821973-101822146
  misc_feature 1..173: note = hyper
  source 1..173: mol_type = genomic DNA

SEQ ID NO: 98346 - DNA, 140 bp, Homo sapiens
  misc_feature 1..140: note = chr8:101872139-101872279
  misc_feature 1..140: note = hypo
  source 1..140: mol_type = genomic DNA
cctggaaaatgaatacgtgaatgaatgaatgaatgaatgaagtgagtaaatgtatcctccttattctaactacaaccacgctccagggcctccctggctttccgtcctacctcgcacccgtttcacgaggcagttgggcg

SEQ ID NO: 98347 - DNA, 78 bp, Homo sapiens
  misc_feature 1..78: note = chr8:10192879-10192957
  misc_feature 1..78: note = hypo
  source 1..78: mol_type = genomic DNA
accttggccatgccccgtggctccaaagccgcgaggacagcactccattgcgacgtctactcccgagcctgaatgttt

SEQ ID NO: 98348 - DNA, 68 bp, Homo sapiens
  misc_feature 1..68: note = chr8:102039492-102039560
  misc_feature 1..68: note = hypo
  source 1..68: mol_type = genomic DNA
cttcaggtcactaaccgccccattggagagggttcacgcagctcacgtgtaaacggacccctctttcc

SEQ ID NO: 98349 - DNA, 153 bp, Homo sapiens
  misc_feature 1..153: note = chr8:102092984-102093137
  misc_feature 1..153: note = hyper
  source 1..153: mol_type = genomic DNA
tgagtcacccacctgcgtggtgagtcaggggaggaggccgagaaggcaggtgggcggcgcggcagggcgccgggcttcgcggggaggggagcgctgtctccccacgcgcccctcccccacgagcggcttccagaaacccgtttgcccatcccc

SEQ ID NO: 98350 - DNA, 75 bp, Homo sapiens
  misc_feature 1..75: note = chr8:10210850-10210925
  misc_feature 1..75: note = hypo
  source 1..75: mol_type = genomic DNA
tgaaagaaattgctacgctgatctggtactgaagaccaccagggccgtccgtggcgtgtacggaggagggacctg

SEQ ID NO: 98351 - DNA, 213 bp, Homo sapiens; identical to SEQ ID NO: 41880
  misc_feature 1..213: note = chr8:102155655-102155868
  misc_feature 1..213: note = hypo
  source 1..213: mol_type = genomic DNA

SEQ ID NO: 98352 - DNA, 100 bp, Homo sapiens
  misc_feature 1..100: note = chr8:10218064-10218164
  misc_feature 1..100: note = hypo
  source 1..100: mol_type = genomic DNA
gacagggccccttgccgaacgtctgacggcacttcacatattgttctgtgtgcaacatggattcgataaatgtttgtagcatacacgaaactgtctaact

SEQ ID NO: 98353 - DNA, 39 bp, Homo sapiens
  misc_feature 1..39: note = chr8:10224220-10224259
  misc_feature 1..39: note = hypo
  source 1..39: mol_type = genomic DNA
tcctgctagactcctcgtggtcggcggctgtcttaactg

SEQ ID NO: 98354 - DNA, 30 bp, Homo sapiens
  misc_feature 1..30: note = chr8:10248245-10248275
  misc_feature 1..30: note = hypo
  source 1..30: mol_type = genomic DNA
actccattccaaaggcgaagacattaagga

SEQ ID NO: 98355 - DNA, 32 bp, Homo sapiens
  misc_feature 1..32: note = chr8:102504728-102504760
  misc_feature 1..32: note = hyper
  source 1..32: mol_type = genomic DNA
gatccaggaggactccgcgccgcccggccgcc

SEQ ID NO: 98356 - DNA, 446 bp, Homo sapiens; identical to SEQ ID NO: 32206
  misc_feature 1..446: note = chr8:102505540-102505986
  misc_feature 1..446: note = hyper
  source 1..446: mol_type = genomic DNA

SEQ ID NO: 98357 - DNA, 38 bp, Homo sapiens
  misc_feature 1..38: note = chr8:102506405-102506443
  misc_feature 1..38: note = hyper
  source 1..38: mol_type = genomic DNA
gtcatggagaagtggcggggacccgtcccaagttgagg

SEQ ID NO: 98358 - DNA, 30 bp, Homo sapiens
  misc_feature 1..30: note = chr8:102517511-102517541
  misc_feature 1..30: note = hypo
  source 1..30: mol_type = genomic DNA
aaagtctaaatgggccgggcgtggtggctc

SEQ ID NO: 98359 - DNA, 148 bp, Homo sapiens
  misc_feature 1..148: note = chr8:10261838-10261986
  misc_feature 1..148: note = hypo
  source 1..148: mol_type = genomic DNA
ctttctccccagccccgtgacaaacgacagtcaagcttgctgccagggaggcagggaagtgacgatcccgtcaccaccccccaaccctccgtggggaggggcaggcgggtgtgggatccatcacgcccgcccacgtggatggcttcaa

SEQ ID NO: 98360 - DNA, 624 bp, Homo sapiens
  misc_feature 1..624: note = chr8:103135899-103136523
  misc_feature 1..624: note = hyper
  source 1..624: mol_type = genomic DNA
tgcagaccacttcctcgtccgtgttcaaccagcgcctttcggcctctcccttggccccctccccagacgcccacgccccgcactcgcctcctgtggcctttccgggcagactccgcaggcccgggatccagcgggtgccccggcccccggccccggccccggcccccggggcgggatgctccagaggtccccgggccgccaggctcaccaacgcccccttctgcccagcgcgccccatcccgccggccccacgcgcctctgcgcggccctctgcaaagttgctctctccttttctgccgcccaccctcaaggtctgtaattttgttttgttttccctcagaggcactgggggaatgacagaggaattgacagggtgaactgcacccaggagggagctgctggaaccaggttcccagaaccgcgcgctcctcgaacccacccctgcgcccgcggcgcaccgagcgcacgggtcccccccagcagccgcccccggcacacccgccccggctgcaactccgactccgctctggctcccgagaagcggagggaaggcgctgcgactcaccgcctcggccgctcccagcgtctgtgtcgcttcgggcgaggcggcggcagcagcggcag

SEQ ID NO: 98361 - DNA, 30 bp, Homo sapiens; identical to SEQ ID NO: 41881
  misc_feature 1..30: note = chr8:103403324-103403354
  misc_feature 1..30: note = hypo
  source 1..30: mol_type = genomic DNA

SEQ ID NO: 98362 - DNA, 90 bp, Homo sapiens
  misc_feature 1..90: note = chr8:103613211-103613301
  misc_feature 1..90: note = hyper
  source 1..90: mol_type = genomic DNA
ggggccacgggacagcgtggagggctctgcgcgcagggcagagactgcagttcactgccctgcggttttgcacttcgccccggccctgct

SEQ ID NO: 98363 - DNA, 94 bp, Homo sapiens
  misc_feature 1..94: note = chr8:103618015-103618109
  misc_feature 1..94: note = hypo
  source 1..94: mol_type = genomic DNA
attttagaacattttcgttactctaaaaggaatcctgttgcacccgttagaaattgccccccgtttctctgccctaccccgccccctgaagccc

SEQ ID NO: 98364 - DNA, 41 bp, Homo sapiens; identical to SEQ ID NO: 41882
  misc_feature 1..41: note = chr8:103629841-103629882
  misc_feature 1..41: note = hypo
  source 1..41: mol_type = genomic DNA

SEQ ID NO: 98365 - DNA, 214 bp, Homo sapiens
  misc_feature 1..214: note = chr8:103768734-103768948
  misc_feature 1..214: note = hypo
  source 1..214: mol_type = genomic DNA
tcggaaaacaatatccggcaagttcaggttttagtgggaaaaaaatgttttggaaatcaagattaaattagagacctgtctgtatttatcttcatttgaagcaaccctctcaagcagatgtcagcaggccaccgagggcagggacccagcagtatggcccagggccttcctacctggtgagaacatgctccctgacccccgccttgtcccgaca

SEQ ID NO: 98366 - DNA, 851 bp, Homo sapiens
  misc_feature 1..851: note = chr8:104152711-104153562
  misc_feature 1..851: note = hyper
  source 1..851: mol_type = genomic DNA
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagac

SEQ ID NO: 98367 - DNA, 15 bp, Homo sapiens
  misc_feature 1..15: note = chr8:104153681-104153696
  misc_feature 1..15: note = hyper
  source 1..15: mol_type = genomic DNA
cgtacccagccgggt

SEQ ID NO: 98368 - DNA, 20 bp, Homo sapiens
  misc_feature 1..20: note = chr8:104235237-104235257
  misc_feature 1..20: note = hypo
  source 1..20: mol_type = genomic DNA
tttaaaactttttggcgggc

SEQ ID NO: 98369 - DNA, 93 bp, Homo sapiens
  misc_feature 1..93: note = chr8:104310870-104310963
  misc_feature 1..93: note = hyper
  source 1..93: mol_type = genomic DNA
gtggaggtggcttcccggccccgcagccggacctcggcaccccgagcccgttcaccggggccgggtcctggcgggccgcggagtgaggccggg

SEQ ID NO: 98370 - DNA, 72 bp, Homo sapiens
  misc_feature 1..72: note = chr8:104311349-104311421
  misc_feature 1..72: note = hyper
  source 1..72: mol_type = genomic DNA
aacggcgggacggcccgcacctgagtttcctcggaagcgggaaccggctctgaaaggcgatgccggggcccc

SEQ ID NO: 98371 - DNA, 165 bp, Homo sapiens; identical to SEQ ID NO: 41884
  misc_feature 1..165: note = chr8:104382635-104382800
  misc_feature 1..165: note = hypo
  source 1..165: mol_type = genomic DNA

SEQ ID NO: 98372 - DNA, 207 bp, Homo sapiens
  misc_feature 1..207: note = chr8:1043858-1044065
  misc_feature 1..207: note = hypo
  source 1..207: mol_type = genomic DNA
gggtctcaaaggtgacgatgggtgccagccgaggggtctgtctgcatctgaggaagcggggctgaagtccatgcctctctgtgtgcaggtgcttgtggatggattgaagtccatgcaggcgctcgtggatggagggcagctccccggtggagggagggcagcttcgcggtgggtggagggagggcagctccgcggtggagggagggc

SEQ ID NO: 98373 - DNA, 23 bp, Homo sapiens
  misc_feature 1..23: note = chr8:104488605-104488628
  misc_feature 1..23: note = hypo
  source 1..23: mol_type = genomic DNA
actgcgcccggcccataatatat

SEQ ID NO: 98374 - DNA, 574 bp, Homo sapiens
  misc_feature 1..574: note = chr8:104510980-104511554
  misc_feature 1..574: note = hyper
  source 1..574: mol_type = genomic DNA
attgcttgcccagggcgcctggaagagctggcgagcccgcccagctctgttcacccggccccgccccgccccctccgggagggctctccgggcggcgcccagccccgagcagagcaaaggacggcggcggccacctccgttctccggccgctggtttctcgtctttcctcgtcctttcattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgttccccactcgctccaacctccctcccccgctatccccacttg

SEQ ID NO: 98375 - DNA, 1926 bp, Homo sapiens
  misc_feature 1..1926: note = chr8:104511983-104513909
  misc_feature 1..1926: note = hyper
  source 1..1926: mol_type = genomic DNA
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 98376 - DNA, 16 bp, Homo sapiens
  misc_feature 1..16: note = chr8:104513910-104513926
  misc_feature 1..16: note = hyper
  source 1..16: mol_type = genomic DNA
gcgagtgctaacaccc

SEQ ID NO: 98377 - DNA, 246 bp, Homo sapiens
  misc_feature 1..246: note = chr8:1048526-1048772
  misc_feature 1..246: note = hypo
  source 1..246: mol_type = genomic DNA
ggaggacaggcacagcgggctggccccaccctgcgatggccacccacagacgccgcgacccacaccaggctcccggccgcccacgggcgccgccacccacgccaggctcccggccgcccacggacgccgccacccacgccaggctcccggccgcccacgggcgccgccacccacgccaggctcccggccgcccacgggcgccgccacccacgccaggctcccggccgcccacgggcgccgccaccc

SEQ ID NO: 98378 - DNA, 84 bp, Homo sapiens
  misc_feature 1..84: note = chr8:10509949-10510033
  misc_feature 1..84: note = hypo
  source 1..84: mol_type = genomic DNA
gcaccagacacttgacgaatgcgatgtcatctaactctaatattccttcctgctgggtataaccagccccgcagtatcttaaag

SEQ ID NO: 98379 - DNA, 140 bp, Homo sapiens
  misc_feature 1..140: note = chr8:1051534-1051674
  misc_feature 1..140: note = hypo
  source 1..140: mol_type = genomic DNA
gggggcatttcatggcggcagacgctcagtctgggaagatggaagagttccggagatggtgacacgacaatgggaaggtcctcatcacccctgagccaaacatgacacgacgatgggaaggtcctcgtcacccctgagcc

SEQ ID NO: 98380 - DNA, 253 bp, Homo sapiens; identical to SEQ ID NO: 3356
  misc_feature 1..253: note = chr8:105235249-105235502
  misc_feature 1..253: note = hyper
  source 1..253: mol_type = genomic DNA

SEQ ID NO: 98381 - DNA, 161 bp, Homo sapiens; identical to SEQ ID NO: 32215
  misc_feature 1..161: note = chr8:105235643-105235804
  misc_feature 1..161: note = hyper
  source 1..161: mol_type = genomic DNA

SEQ ID NO: 98382 - DNA, 260 bp, Homo sapiens
  misc_feature 1..260: note = chr8:105235863-105236123
  misc_feature 1..260: note = hyper
  source 1..260: mol_type = genomic DNA
cgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctctatctgtttagaaagtcggtggctggagggttggccggggcagagagaactccacgtagcagtgtccca

SEQ ID NO: 98383 - DNA, 142 bp, Homo sapiens; identical to SEQ ID NO: 41704
  misc_feature 1..142: note = chr8:10528983-10529125
  misc_feature 1..142: note = hypo
  source 1..142: mol_type = genomic DNA

SEQ ID NO: 98384 - DNA, 30 bp, Homo sapiens
  misc_feature 1..30: note = chr8:1053744-1053774
  misc_feature 1..30: note = hypo
  source 1..30: mol_type = genomic DNA
gacggtgatgactggcggggccttggttga

SEQ ID NO: 98385 - DNA, 227 bp, Homo sapiens
  misc_feature 1..227: note = chr8:105385866-105386093
  misc_feature 1..227: note = hypo
  source 1..227: mol_type = genomic DNA
caaatggtgcagagccgggactaatgccgggttcctggagtcaagcccacactgcatcatgggaagtgcccctggcagaggcgctgatggttatgggatagcccaggaacagcgtgtcctcattgactctgcttcaagttcagtttttggatgactggagggctggcgtgaccaggcccccactggtctgtggcactttctcagcagcagagcgacccccacctgga

SEQ ID NO: 98386 - DNA, 40 bp, Homo sapiens
  misc_feature 1..40: note = chr8:105456591-105456631
  misc_feature 1..40: note = hypo
  source 1..40: mol_type = genomic DNA
tccactgcctctgggcggcacagctcgtggccctcagggc

SEQ ID NO: 98387 - DNA, 184 bp, Homo sapiens
  misc_feature 1..184: note = chr8:105459406-105459590
  misc_feature 1..184: note = hypo
  source 1..184: mol_type = genomic DNA
tccgtttccgagccacggaaaatccatttctggatttctcatcttccaatgcattaaatgagtttacctatgtaggcccaatcatcttcaccttatgttatggctgctgtcatttctgtagaagctttggaatgcaaatgcgtacctctgcaattaagtctccattttccgcatggacctgggc

SEQ ID NO: 98388 - DNA, 52 bp, Homo sapiens
  misc_feature 1..52: note = chr8:105478728-105478780
  misc_feature 1..52: note = hyper
  source 1..52: mol_type = genomic DNA
ccctctgacacccgccggggctgcgctccttcccgcccacccagctcctcgg

SEQ ID NO: 98389 - DNA, 187 bp, Homo sapiens; identical to SEQ ID NO: 32217
  misc_feature 1..187: note = chr8:105479247-105479434
  misc_feature 1..187: note = hyper
  source 1..187: mol_type = genomic DNA

SEQ ID NO: 98390 - DNA, 77 bp, Homo sapiens
  misc_feature 1..77: note = chr8:10548185-10548262
  misc_feature 1..77: note = hypo
  source 1..77: mol_type = genomic DNA
tggcgcatctccccccggctcgcccagcccagactccgggtatgagggcccaaggaagccaccggagccccctggtc

SEQ ID NO: 98391 - DNA, 120 bp, Homo sapiens
  misc_feature 1..120: note = chr8:105565464-105565584
  misc_feature 1..120: note = hypo
  source 1..120: mol_type = genomic DNA
agggggaaaatggggagtgcagatacatgcacagaagtcttggcaggggcagaggcatgaaacctgaaagccctgcttgctttctcagcagggaagtttgtagactgggccaagttctca

SEQ ID NO: 98392 - DNA, 155 bp, Homo sapiens; identical to SEQ ID NO: 9720
  misc_feature 1..155: note = chr8:105600526-105600681
  misc_feature 1..155: note = hyper
  source 1..155: mol_type = genomic DNA

SEQ ID NO: 98393 - DNA, 677 bp, Homo sapiens
  misc_feature 1..677: note = chr8:105601010-105601687
  misc_feature 1..677: note = hyper
  source 1..677: mol_type = genomic DNA
gttcggtcagcggggcgcggggacgcggacacttaccgtacaccccagcgaggaaaagcaagagcaacgcagacctccaccgcggagactcttttgtgctccagcgacaggccataaccacagcagatggagagagagaggaggagacggaggaggagggaggagaagctggaggtagacgacgccgacgccgccgccgccgccgccgccgccgccgagccaccggctgctccctgcgctctccgcggctgcgggagggggaagggaggggccgccgccgcccgcgcgcgctccctcctccctcctccctccggctcgcctgctcccaccccgggcggtgcgagagccccacgcggggcggccctcctgggggcaagggcaaggagctcgcgcgccagcgcgagacgagagggtggcggacgccggactccggcctcgcgccgctcgggctagccggcgccgccactcgccagactgagcgcgcgcccatccgtgcgatcggcaatcccctggcccgcctgcctcggttccctccccgcgctccgctggactttccaagtttcgggccgatttccacgcgacgggagcccaaggagcaaggcagcgccaatcgatgacagagcgtgcgaacgccggctgctggatgcccaggggctggagcgcggggtgtgtggagg

SEQ ID NO: 98394 - DNA, 152 bp, Homo sapiens
  misc_feature 1..152: note = chr8:105601931-105602083
  misc_feature 1..152: note = hyper
  source 1..152: mol_type = genomic DNA
cagtgtggactcccacgctcaaggtgcccggaatgagtcgggcaaggcttgtgcagagcccctccagtctggcgtggaagcgccaagaggtcatttgacatctcacgctgggtcgggtgcagctgggccaggatgttcggcagggctggagc

SEQ ID NO: 98395 - DNA, 165 bp, Homo sapiens
  misc_feature 1..165: note = chr8:10562094-10562259
  misc_feature 1..165: note = hypo
  source 1..165: mol_type = genomic DNA
gagggatggagaaggcgctgggcgacctgaaagggcagagtcaggctccttctgtcaagacactgaggctcacacacagttgatgttcatttcacaaacattaattgaccaattatctgtaccagaggctgtcaggcacggaggacccggcggtaaacaagccag

SEQ ID NO: 98396 - DNA, 120 bp, Homo sapiens
  misc_feature 1..120: note = chr8:105645375-105645495
  misc_feature 1..120: note = hypo
  source 1..120: mol_type = genomic DNA
ggggccagtggcgcccgccggccgctcccagtgctgggccctccgagcccatgcccaccctgaactcgcactggtctgcgagtgccgtgcacagccccggctcccgcccgcgcctctccc

SEQ ID NO: 98397 - DNA, 30 bp, Homo sapiens
  misc_feature 1..30: note = chr8:105692986-105693016
  misc_feature 1..30: note = hypo
  source 1..30: mol_type = genomic DNA
gttccaagtcaggcacggtggctcatgcct

SEQ ID NO: 98398 - DNA, 181 bp, Homo sapiens; identical to SEQ ID NO: 31764
  misc_feature 1..181: note = chr8:10587422-10587603
  misc_feature 1..181: note = hyper
  source 1..181: mol_type = genomic DNA

SEQ ID NO: 98399 - DNA, 115 bp, Homo sapiens; identical to SEQ ID NO: 31765
  misc_feature 1..115: note = chr8:10587893-10588008
  misc_feature 1..115: note = hyper
  source 1..115: mol_type = genomic DNA

SEQ ID NO: 98400 - DNA, 109 bp, Homo sapiens; identical to SEQ ID NO: 31766
  misc_feature 1..109: note = chr8:10588184-10588293
  misc_feature 1..109: note = hyper
  source 1..109: mol_type = genomic DNA

SEQ ID NO: 98401 - DNA, 27 bp, Homo sapiens
  misc_feature 1..27: note = chr8:10588640-10588667
  misc_feature 1..27: note = hyper
  source 1..27: mol_type = genomic DNA
cgacgcccccgccgcccctggctctca

SEQ ID NO: 98402 - DNA, 78 bp, Homo sapiens
  misc_feature 1..78: note = chr8:10590855-10590933
  misc_feature 1..78: note = hyper
  source 1..78: mol_type = genomic DNA
ggtcgaggctaggtgcggcgaatcatcacggcgcggaccctggaagacctggaggagaaaggtcgaggcccagggcta

SEQ ID NO: 98403 - DNA, 28 bp, Homo sapiens
  misc_feature 1..28: note = chr8:105977049-105977077
  misc_feature 1..28: note = hypo
  source 1..28: mol_type = genomic DNA
gccatcttgtaaccgcccattttattag

SEQ ID NO: 98404 - DNA, 41 bp, Homo sapiens
  misc_feature 1..41: note = chr8:1060967-1061008
  misc_feature 1..41: note = hypo
  source 1..41: mol_type = genomic DNA
gatgcatctgccagccgaaggtcacacgtgggtttgagcag

SEQ ID NO: 98405 - DNA, 185 bp, Homo sapiens
  misc_feature 1..185: note = chr8:106155895-106156080
  misc_feature 1..185: note = hypo
  source 1..185: mol_type = genomic DNA
tcatgccaactcgcccgttatcgccggcacatgcctgaattgcaaaagaatccgctcttcaattggaacttattgatattctaagaaaaaaaaaaagagagaagggggaaaaaactgaaaatccttaagtttaagccgcagatttttaaatggattaatttcgctgcaatcgcagccatctaagg

SEQ ID NO: 98406 - DNA, 639 bp, Homo sapiens
  misc_feature 1..639: note = chr8:106330435-106331074
  misc_feature 1..639: note = hyper
  source 1..639: mol_type = genomic DNA
ggccctcctccaagccgtccccacgcctcccctccaactcccacccacccctgcccccatcccccaccaccgcctggatcccccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccag

SEQ ID NO: 98407 - DNA, 174 bp, Homo sapiens; identical to SEQ ID NO: 32224
  misc_feature 1..174: note = chr8:106331083-106331257
  misc_feature 1..174: note = hyper
  source 1..174: mol_type = genomic DNA

SEQ ID NO: 98408 - DNA, 131 bp, Homo sapiens
  misc_feature 1..131: note = chr8:106331843-106331974
  misc_feature 1..131: note = hyper
  source 1..131: mol_type = genomic DNA
cgtgtcctgggacttcgggcgggtccggctcacgccgccaggacgctcagccgagcggggattcgggtggtgtctggccctggtggcgcgcggagtcctccctgggaggggccgccagtcacttcccagcg

SEQ ID NO: 98409 - DNA, 185 bp, Homo sapiens
  misc_feature 1..185: note = chr8:106332003-106332188
  misc_feature 1..185: note = hyper
  source 1..185: mol_type = genomic DNA
cgcaggggagtgcatggccctgagcccccgggtgcccgggggtcccgatggtgcttagaggacacggcgggtcaagagacaccttccgaaacaggcacgctcgcagagatcaagtcggtcaacttttcttggcttggggagaattcctccaatagcgttttataggcctgcgacatatcttcaac

SEQ ID NO: 98410 - DNA, 84 bp, Homo sapiens
  misc_feature 1..84: note = chr8:106433918-106434002
  misc_feature 1..84: note = hypo
  source 1..84: mol_type = genomic DNA
aatttttctcagtgacgcataattatgttttattgccaattgtgaggaagaggacagattagcaattaaaagagtagaagttgc

SEQ ID NO: 98411 - DNA, 27 bp, Homo sapiens
  misc_feature 1..27: note = chr8:106466086-106466113
  misc_feature 1..27: note = hypo
  source 1..27: mol_type = genomic DNA
aagtgatccacccgcctcagcctccca

SEQ ID NO: 98412 - DNA, 77 bp, Homo sapiens
  misc_feature 1..77: note = chr8:106475039-106475116
  misc_feature 1..77: note = hypo
  source 1..77: mol_type = genomic DNA
tggccaaagaaatagcgaatccgtttgtatctatgttgttcaaaaaataaaagtcgtttattcgattcaacgtcctt

SEQ ID NO: 98413 - DNA, 30 bp, Homo sapiens; identical to SEQ ID NO: 15145
  misc_feature 1..30: note = chr8:106500552-106500582
  misc_feature 1..30: note = hypo
  source 1..30: mol_type = genomic DNA

SEQ ID NO: 98414 - DNA, 53 bp, Homo sapiens; identical to SEQ ID NO: 41660
  misc_feature 1..53: note = chr8:1066123-1066176
  misc_feature 1..53: note = hypo
  source 1..53: mol_type = genomic DNA

SEQ ID NO: 98415 - DNA, 38 bp, Homo sapiens
  misc_feature 1..38: note = chr8:106706481-106706519
  misc_feature 1..38: note = hypo
  source 1..38: mol_type = genomic DNA
gggattacaggcctgagccaccgcgcccagcctctcca

SEQ ID NO: 98416 - DNA, 28 bp, Homo sapiens
  misc_feature 1..28: note = chr8:106713096-106713124
  misc_feature 1..28: note = hypo
  source 1..28: mol_type = genomic DNA
gcgtgagccactgcgcccagccatccct

SEQ ID NO: 98417 - DNA, 56 bp, Homo sapiens
  misc_feature 1..56: note = chr8:10694858-10694914
  misc_feature 1..56: note = hypo
  source 1..56: mol_type = genomic DNA
gctctggaagcttgacgcctggcttagcctggactttgccccgtgcatcttttcct

SEQ ID NO: 98418 - skipped

SEQ ID NO: 98419 - DNA, 12 bp, Homo sapiens
  misc_feature 1..12: note = chr8:10708327-10708339
  misc_feature 1..12: note = hyper
  source 1..12: mol_type = genomic DNA
cggggaacaacg

SEQ ID NO: 98420 - DNA, 986 bp, Homo sapiens
  misc_feature 1..986: note = chr8:107281909-107282895
  misc_feature 1..986: note = hyper
  source 1..986: mol_type = genomic DNA
aacatttttttcctccgtaaatctgaacaaatttccttgcagctttccttgcagaagcttttttatcgctttaacaaaactttcctctgcttctctagggagagcctagtattagagctgcccgacaggcgggaccccgaaatcggggcagctctggcttagtccaggctattcgagtgggcgcctgaactggaggcgccgtctccaccgggatggggatcctagtgcaggcagacgcctggcaggactcggcgagctggggtccccaccgcggtagccagagcagaaacccgaaccccagccagaggggccgcgcgcggggaggggtgcgcgctaagccagcgtggcttccgcaggagctatttttagcggtgcgtgcctccccccgcccccggcgtggtagcctccggctcgcggcgccccacggctcctctcagtctcccccgccgctgccggctcttggtagcttccacgcgggcaggtccggaaactgagcatgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtaagtttgtgaggctgctgggcgttagggcgagggcttggcgcccgggggagtccaggagggatagcgagaggcgcggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccg

SEQ ID NO: 98421 - DNA, 942 bp, Homo sapiens
  misc_feature 1..942: note = chr8:107283112-107284054
  misc_feature 1..942: note = hyper
  source 1..942: mol_type = genomic DNA
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgc

SEQ ID NO: 98422 - DNA, 181 bp, Homo sapiens
  misc_feature 1..181: note = chr8:107284055-107284236
  misc_feature 1..181: note = hyper
  source 1..181: mol_type = genomic DNA
accaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaag

SEQ ID NO: 98423 - DNA, 30 bp, Homo sapiens; identical to SEQ ID NO: 41892
  misc_feature 1..30: note = chr8:107359293-107359323
  misc_feature 1..30: note = hypo
  source 1..30: mol_type = genomic DNA

SEQ ID NO: 98424 - DNA, 185 bp, Homo sapiens; identical to SEQ ID NO: 41893
  misc_feature 1..185: note = chr8:107531614-107531799
  misc_feature 1..185: note = hypo
  source 1..185: mol_type = genomic DNA

SEQ ID NO: 98425 - DNA, 286 bp, Homo sapiens
  misc_feature 1..286: note = chr8:107670003-107670289
  misc_feature 1..286: note = hyper
  source 1..286: mol_type = genomic DNA
cgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttc

SEQ ID NO: 98426 - DNA, 56 bp, Homo sapiens
  misc_feature 1..56: note = chr8:107670922-107670978
  misc_feature 1..56: note = hyper
  source 1..56: mol_type = genomic DNA
ctagttgacattttgcgtcgtgtactttttgaacggctgcacgttgtcttgtggtg

SEQ ID NO: 98427 - DNA, 18 bp, Homo sapiens
  misc_feature 1..18: note = chr8:107789174-107789192
  misc_feature 1..18: note = hypo
  source 1..18: mol_type = genomic DNA
gcccggccagctgtggat

SEQ ID NO: 98428 - DNA, 164 bp, Homo sapiens
  misc_feature 1..164: note = chr8:108134662-108134826
  misc_feature 1..164: note = hypo
  source 1..164: mol_type = genomic DNA
catgacgccggctgccgtgtgggaggtgccgctggggctgcctgctccatggagcctgcaggatccaggacaggtaggagccccgcccctttctgagtgggaggggcaggagccccaccctcccaggggtagctgcagccacccagccacggttgtggacctgg

SEQ ID NO: 98429 - DNA, 312 bp, Homo sapiens
  misc_feature 1..312: note = chr8:108509338-108509650
  misc_feature 1..312: note = hyper
  source 1..312: mol_type = genomic DNA
ccaaacccagacagccgtcttgcaattgcaaacactgcccccctggagcaaaaggtaaatacacaaatgctcccctaaggaactttaagttagctgcagtgcaagaaaggaaaaaggtccgtgctattagaaactgaaagcaatcacttactttttgcagccactgagtataattttccatcacatgttccagatgttgaagtttctgggaagagaaatccggttccacgtgtggagcatctctctgcagagcgtttgtgttgtactggtctgtcgtactctcacgacagttgccatcgtgttctggaagaa

SEQ ID NO: 98430 - DNA, 50 bp, Homo sapiens
  misc_feature 1..50: note = chr8:1085553-1085603
  misc_feature 1..50: note = hypo
  source 1..50: mol_type = genomic DNA
ctgaaaaggggcatgcggtctttcaggagacggagcgtggcacacctaag

SEQ ID NO: 98431 - DNA, 30 bp, Homo sapiens
  misc_feature 1..30: note = chr8:108581145-108581175
  misc_feature 1..30: note = hypo
  source 1..30: mol_type = genomic DNA
tatttctcccgatatcgctggttgtgtaaa

SEQ ID NO: 98432 - DNA, 77 bp, Homo sapiens; identical to SEQ ID NO: 41895
  misc_feature 1..77: note = chr8:108582504-108582581
  misc_feature 1..77: note = hypo
  source 1..77: mol_type = genomic DNA

SEQ ID NO: 98433 - DNA, 17 bp, Homo sapiens
  misc_feature 1..17: note = chr8:108582641-108582658
  misc_feature 1..17: note = hypo
  source 1..17: mol_type = genomic DNA
ggcggagaaaatattac

SEQ ID NO: 98434 - DNA, 30 bp, Homo sapiens; identical to SEQ ID NO: 41897
  misc_feature 1..30: note = chr8:108588091-108588121
  misc_feature 1..30: note = hypo
  source 1..30: mol_type = genomic DNA

SEQ ID NO: 98435 - DNA, 30 bp, Homo sapiens
  misc_feature 1..30: note = chr8:108592924-108592954
  misc_feature 1..30: note = hypo
  source 1..30: mol_type = genomic DNA
tactactcccaatttcgcaggaagtgtata

SEQ ID NO: 98436 - DNA, 41 bp, Homo sapiens; identical to SEQ ID NO: 41898
  misc_feature 1..41: note = chr8:108593714-108593755
  misc_feature 1..41: note = hypo
  source 1..41: mol_type = genomic DNA

SEQ ID NO: 98437 - DNA, 30 bp, Homo sapiens
  misc_feature 1..30: note = chr8:108594004-108594034
  misc_feature 1..30: note = hypo
  source 1..30: mol_type = genomic DNA
ggggaggacacactccgccacatcgggagt

SEQ ID NO: 98438 - DNA, 393 bp, Homo sapiens
  misc_feature 1..393: note = chr8:108601650-108602043
  misc_feature 1..393: note = hypo
  source 1..393: mol_type = genomic DNA
ggtagtgtccacccccgtatgatattgttcattatatccggtgggaaagaggatgatattactagccatattgcaggagttgtgatattgtttgtaatattcagggcgagggaggatagtattaccctccatatcacaaagtgtgtacacatccttgtgatattgttcgtaatatctgggggggtaggaagataatattactgcctatatcgcaaaacgtgtacacccacgtgtgatagtctccaaaatatttaatgggggaaaggataatatcactccccatatcgcagagtgtatacacgttccccgtgataatgttcctaatatcggggagggggaagaagatgacatcactccccatatcgcagggtgtacgtgtccctctgtgatatt

SEQ ID NO: 98439 - DNA, 208 bp, Homo sapiens
  misc_feature 1..208: note = chr8:10873441-10873649
  misc_feature 1..208: note = hyper
  source 1..208: mol_type = genomic DNA
cgactcctgcggactcggctgcaggcgggctccatgagggcgggcagcagggctcagacgatccggctcggtttggtcagcagacccccggtaacgccccgcaccgtcggcgatccctgcccccttccactgcgcccccacaagccccgagctcgccagtccttccccgcggcgctccgctctgtggccccctcgcatcccaccgtgg

SEQ ID NO: 98440 - DNA, 153 bp, Homo sapiens
  misc_feature 1..153: note = chr8:10873889-10874042
  misc_feature 1..153: note = hyper
  source 1..153: mol_type = genomic DNA
gggacgccggggactcggggtcctagtgccaccggacgcagcgggagtagcgcaggtctgggggcggggtctctcgaggcgcagacaacaagctagatcctgagccctctgcttcaaagcgggtagcgccttcgcccacgccttccctcccac

SEQ ID NO: 98441 - DNA, 30 bp, Homo sapiens
  misc_feature 1..30: note = chr8:10874300-10874330
  misc_feature 1..30: note = hyper
  source 1..30: mol_type = genomic DNA
accactcttctctctcgggccagccgagcc

SEQ ID NO: 98442 - DNA, 96 bp, Homo sapiens
  misc_feature 1..96: note = chr8:108767551-108767647
  misc_feature 1..96: note = hypo
  source 1..96: mol_type = genomic DNA
gaatgacgcagaagccgaagggaatgtggccagggcggctggaggggagtctggccgctgagtgacctgactccagagagaaaccaccttcccact

SEQ ID NO: 98443 - DNA, 30 bp, Homo sapiens
  misc_feature 1..30: note = chr8:1088028-1088058
  misc_feature 1..30: note = hypo
  source 1..30: mol_type = genomic DNA
cccggccccctctctcgatggaagcttttc

SEQ ID NO: 98444 - DNA, 30 bp, Homo sapiens; identical to SEQ ID NO: 41900
  misc_feature 1..30: note = chr8:108957755-108957785
  misc_feature 1..30: note = hypo
  source 1..30: mol_type = genomic DNA

SEQ ID NO: 98445 - DNA, 501 bp, Homo sapiens
  misc_feature 1..501: note = chr8:109093679-109094180
  misc_feature 1..501: note = hyper
  source 1..501: mol_type = genomic DNA
aaaagtccaaagtgccgaatgaaatagacagctctcaccaggtccctgggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaa

SEQ ID NO: 98446 - DNA, 1040 bp, Homo sapiens; identical to SEQ ID NO: 32233
  misc_feature 1..1040: note = chr8:109094397-109095437
  misc_feature 1..1040: note = hyper
  source 1..1040: mol_type = genomic DNA

SEQ ID NO: 98447 - DNA, 63 bp, Homo sapiens; identical to SEQ ID NO: 32234
  misc_feature 1..63: note = chr8:109095505-109095568
  misc_feature 1..63: note = hyper
  source 1..63: mol_type = genomic DNA

SEQ ID NO: 98448 - DNA, 405 bp, Homo sapiens; identical to SEQ ID NO: 32235
  misc_feature 1..405: note = chr8:109095569-109095974
  misc_feature 1..405: note = hyper
  source 1..405: mol_type = genomic DNA

SEQ ID NO: 98449 - DNA, 148 bp, Homo sapiens
  misc_feature 1..148: note = chr8:109104980-109105128
  misc_feature 1..148: note = hypo
  source 1..148: mol_type = genomic DNA
caaaaatttctctgtcgccaccacactatggtggctgggcatgcttggcttctcagacatgttagtggctcctctgatcctcccgttcccttttcggaactttacttcctcagctgtaagatctcgttcctatcgtaaatccattatt

SEQ ID NO: 98450 - DNA, 43 bp, Homo sapiens
  misc_feature 1..43: note = chr8:109144123-109144166
  misc_feature 1..43: note = hypo
  source 1..43: mol_type = genomic DNA
gaccaggaagggccgcgttaagatgctgcgcttcccacaactg

SEQ ID NO: 98451 - DNA, 255 bp, Homo sapiens
  misc_feature 1..255: note = chr8:10916999-10917254
  misc_feature 1..255: note = hyper
  source 1..255: mol_type = genomic DNA
cggagccatctgctgcgcgggcggcgccgctccagtgtttgtttacaacccggcccggcgagcgacaagagctcggctcctcttccaggcgcgcggcggtgccagtggaggaggagcagggcgctgggggcgcggggggcgcggggcggggcgggacaggtgcggggggcgcggggcgggacaggtgcggcgggcgcggggcgggacaggcgcgtctctgttccccggctccccggcccgcgccccccggacccc

SEQ ID NO: 98452 - DNA, 56 bp, Homo sapiens
  misc_feature 1..56: note = chr8:109273857-109273913
  misc_feature 1..56: note = hypo
  source 1..56: mol_type = genomic DNA
caggctggactgctccggtgcccacagactgccagcaggagcgccaccctggctaa

SEQ ID NO: 98453 - DNA, 30 bp, Homo sapiens
  misc_feature 1..30: note = chr8:10928999-10929029
  misc_feature 1..30: note = hypo
  source 1..30: mol_type = genomic DNA
cgagtccatgagccccgagtctatgagccc

SEQ ID NO: 98454 - DNA, 30 bp, Homo sapiens
  misc_feature 1..30: note = chr8:109311321-109311351
  misc_feature 1..30: note = hypo
  source 1..30: mol_type = genomic DNA
acaggtgcaagccaccgcatgtgtagaaat

SEQ ID NO: 98455 - DNA, 30 bp, Homo sapiens
  misc_feature 1..30: note = chr8:10959729-10959759
  misc_feature 1..30: note = hypo
  source 1..30: mol_type = genomic DNA
cccagcccagcatcccgaggacttgcctgc

SEQ ID NO: 98456 - DNA, 57 bp, Homo sapiens
  misc_feature 1..57: note = chr8:10966208-10966265
  misc_feature 1..57: note = hypo
  source 1..57: mol_type = genomic DNA
tgctccattccaaggcgacagagaatcaaccacagatgggcgcgagaacagagtcag

SEQ ID NO: 98457 - DNA, 326 bp, Homo sapiens
  misc_feature 1..326: note = chr8:109799414-109799740
  misc_feature 1..326: note = hyper
  source 1..326: mol_type = genomic DNA
aggcaaggctgatctcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 98458 - DNA, 15 bp, Homo sapiens
  misc_feature 1..15: note = chr8:109799888-109799903
  misc_feature 1..15: note = hyper
  source 1..15: mol_type = genomic DNA
cgggagttgtaggcc

SEQ ID NO: 98459 - DNA, 28 bp, Homo sapiens
  misc_feature 1..28: note = chr8:110086844-110086872
  misc_feature 1..28: note = hypo
  source 1..28: mol_type = genomic DNA
caacaaaagaatacgcaggtgcacagta

SEQ ID NO: 98460 - DNA, 31 bp, Homo sapiens; identical to SEQ ID NO: 41901
  misc_feature 1..31: note = chr8:110274990-110275021
  misc_feature 1..31: note = hypo
  source 1..31: mol_type = genomic DNA

SEQ ID NO: 98461 - DNA, 104 bp, Homo sapiens
  misc_feature 1..104: note = chr8:110406021-110406125
  misc_feature 1..104: note = hypo
  source 1..104: mol_type = genomic DNA
gaagacagactggggcggtcagcggaagatcccagcctttataaagggtaatccttttgtatgcttttttatgtcaatataatttcttaaaatcaactgtaggg

SEQ ID NO: 98462 - DNA, 224 bp, Homo sapiens
  misc_feature 1..224: note = chr8:110479232-110479456
  misc_feature 1..224: note = hypo
  source 1..224: mol_type = genomic DNA
gacagagagagggagcgttggcacagcccttggagcaagtaaaaatgtaccagtgttcctgccactcaaagcaaatgtttttgattgtccttgctgattgagatgggatgggggagcatttactaggttaatagctgcctaacaggtgccagggattgtggatttactgatttgttccggtaaaggtacaatacctggaacaccagatacgcttggcatcatta

SEQ ID NO: 98463 - DNA, 34 bp, Homo sapiens
  misc_feature 1..34: note = chr8:11049928-11049962
  misc_feature 1..34: note = hypo
  source 1..34: mol_type = genomic DNA
ttacagacgtgagccacagcgcctggcctacaaa

SEQ ID NO: 98464 - DNA, 33 bp, Homo sapiens
  misc_feature 1..33: note = chr8:11053392-11053425
  misc_feature 1..33: note = hypo
  source 1..33: mol_type = genomic DNA
cctcatgatccgccacctcggcctcccactgag

SEQ ID NO: 98465 - DNA, 171 bp, Homo sapiens; identical to SEQ ID NO: 15148
  misc_feature 1..171: note = chr8:110548417-110548588
  misc_feature 1..171: note = hypo
  source 1..171: mol_type = genomic DNA

SEQ ID NO: 98466 - DNA, 15 bp, Homo sapiens
  misc_feature 1..15: note = chr8:11058152-11058167
  misc_feature 1..15: note = hyper
  source 1..15: mol_type = genomic DNA
gcgctgcgcccccgg

SEQ ID NO: 98467 - DNA, 601 bp, Homo sapiens
  misc_feature 1..601: note = chr8:11058198-11058799
  misc_feature 1..601: note = hyper
  source 1..601: mol_type = genomic DNA
cgggccgcgccgtggacgtagccggcccccatcatgggggggccccggctggtgagcccctccacggcgcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggggccgcgggaggctgcagcggctggtcccccccgtcggcggcggcgctgcggcgcggcttcctgcccaggagggagcgcaggcaggcggagcggcagccccagtagcacgaggaggtgttgcagcagtggcagatgtgcatcgagctgctctcgccgggctcgctgccgtcgccgccgccgccgcagccgcctcccccgggctccccgtcctcctcgccgccgctgcccaccgcctcgtccaggttgtgca

SEQ ID NO: 98468 - DNA, 51 bp, Homo sapiens
  misc_feature 1..51: note = chr8:110592338-110592389
  misc_feature 1..51: note = hypo
  source 1..51: mol_type = genomic DNA
cgcaatacaattattcgtgtagactgtccttaggagcggccttcttcccac

SEQ ID NO: 98469 - DNA, 409 bp, Homo sapiens
  misc_feature 1..409: note = chr8:110703524-110703933
  misc_feature 1..409: note = hyper
  source 1..409: mol_type = genomic DNA
actgacagcagagaccgcataggcgccccggtcttaccctttctcgcccagaagggccccatcgcgctgtccaggaggaggcacctacgtgcgcccgggagaccgggccccggctgggccgggtgccggtgcggacgggaccccgcgtcgctgctggtttgcgctcaggcccggggagccgggcccggcccgctccgcccgccttagcccggcttggacacgtggtgccgcggaatcccttgcgctccggtgccctcggcccctcggcctctgcagccagccgggcggctgctggggctgaggacaaaatggagagaagggcgggggaccaaagggcaggcaccgctgggtggggcgcagcggcgtgagcacgctgagggccgcgcgccgggggcgccaggattctgct

SEQ ID NO: 98470 - DNA, 116 bp, Homo sapiens
  misc_feature 1..116: note = chr8:110704189-110704305
  misc_feature 1..116: note = hyper
  source 1..116: mol_type = genomic DNA
gcacccttgtcctcacgctggagaggaagagccctgaacactgacttcagcgtgaacctaaggtgccctttaggacagtctccctgggaaaatttatctcgcgaccacagcctgcc

SEQ ID NO: 98471 - DNA, 30 bp, Homo sapiens
  misc_feature 1..30: note = chr8:1108569-1108599
  misc_feature 1..30: note = hypo
  source 1..30: mol_type = genomic DNA
tttcatggctttggacgatacctgtgaaat

SEQ ID NO: 98472 - DNA, 30 bp, Homo sapiens; identical to SEQ ID NO: 15149
  misc_feature 1..30: note = chr8:110961977-110962007
  misc_feature 1..30: note = hypo
  source 1..30: mol_type = genomic DNA

SEQ ID NO: 98473 - DNA, 52 bp, Homo sapiens; identical to SEQ ID NO: 9735
  misc_feature 1..52: note = chr8:110986212-110986264
  misc_feature 1..52: note = hyper
  source 1..52: mol_type = genomic DNA

SEQ ID NO: 98474 - DNA, 691 bp, Homo sapiens; identical to SEQ ID NO: 32241
  misc_feature 1..691: note = chr8:110986328-110987019
  misc_feature 1..691: note = hyper
  source 1..691: mol_type = genomic DNA

SEQ ID NO: 98475 - DNA, 202 bp, Homo sapiens; identical to SEQ ID NO: 9738
  misc_feature 1..202: note = chr8:110987020-110987222
  misc_feature 1..202: note = hyper
  source 1..202: mol_type = genomic DNA

SEQ ID NO: 98476 - DNA, 275 bp, Homo sapiens
  misc_feature 1..275: note = chr8:110987681-110987956
  misc_feature 1..275: note = hyper
  source 1..275: mol_type = genomic DNA
gaatttaaatagtaacgacggcctccctcggtaaagggagaagccgaggccagcgcccaggtgagactagaagtgtacccacggggcccctggaagctgcgctccagccaacctgttggactcggggtgaggaggtgggggtgggagggaagagcaagtgactcacctgcagctcccggcacatctggtctgcgcacaaccggcgccgcaggtaacgtactcttcttttgatcctcttagtctacacgtgaggtctgactcgaccggtccaggag

SEQ ID NO: 98477 - DNA, 29 bp, Homo sapiens
  misc_feature 1..29: note = chr8:111003707-111003736
  misc_feature 1..29: note = hypo
  source 1..29: mol_type = genomic DNA
gagtgcagtggctcacgcctctaatccca

SEQ ID NO: 98478 - DNA, 18 bp, Homo sapiens
  misc_feature 1..18: note = chr8:111194106-111194124
  misc_feature 1..18: note = hypo
  source 1..18: mol_type = genomic DNA
gcccggccagggtttttt

SEQ ID NO: 98479 - DNA, 30 bp, Homo sapiens; identical to SEQ ID NO: 41905
  misc_feature 1..30: note = chr8:111586661-111586691
  misc_feature 1..30: note = hypo
  source 1..30: mol_type = genomic DNA

SEQ ID NO: 98480 - DNA, 244 bp, Homo sapiens
  misc_feature 1..244: note = chr8:111747443-111747687
  misc_feature 1..244: note = hypo
  source 1..244: mol_type = genomic DNA
ggctgcaactgctcccgggaacatggggctcttggccggccacctcaccccaaaccagccccctctggctctgtggagcacacagccccggccatgcctcccccgctgaagctggcatccctgcagcaggtgctccagatgggctgccgctgccatcagtattatgttccgtcataatcatacgtgctatgcttttatacaactgacagcacagtaggtttgtttaaaccgacatcaccacaaa

SEQ ID NO: 98481 - DNA, 687 bp, Homo sapiens
  misc_feature 1..687: note = chr8:11204479-11205166
  misc_feature 1..687: note = hyper
  source 1..687: mol_type = genomic DNA
gattgcaatatgcagcggagtttgagaaccagcgccttggacccagcttcttaagctactgcgcgcaccggcgtcccgctgggggcgcgcgagccccacccccagagatgctgactcagcaagtcgggaggggttgggggtgggacctgccaatctgcatttccaaccggcgcccaggtgacgctgactctgctggtctaccgtcttgggggtcacctaatttttcagcgatgcctcccagctggggaggccaagaagtgcctcgctcaaggtcttccaacacccgacctccagaccctcaatcctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 98482 - DNA, 255 bp, Homo sapiens; identical to SEQ ID NO: 31773
  misc_feature 1..255: note = chr8:11205167-11205422
  misc_feature 1..255: note = hyper
  source 1..255: mol_type = genomic DNA

SEQ ID NO: 98483 - DNA, 257 bp, Homo sapiens; identical to SEQ ID NO: 31774
  misc_feature 1..257: note = chr8:11205445-11205702
  misc_feature 1..257: note = hyper
  source 1..257: mol_type = genomic DNA

SEQ ID NO: 98484 - DNA, 61 bp, Homo sapiens; identical to SEQ ID NO: 9392
  misc_feature 1..61: note = chr8:11206007-11206068
  misc_feature 1..61: note = hyper
  source 1..61: mol_type = genomic DNA

SEQ ID NO: 98485 - DNA, 28 bp, Homo sapiens
  misc_feature 1..28: note = chr8:112347537-112347565
  misc_feature 1..28: note = hypo
  source 1..28: mol_type = genomic DNA
ctgatgtgttcctcacgacgtccagctg

SEQ ID NO: 98486 - DNA, 67 bp, Homo sapiens
  misc_feature 1..67: note = chr8:112636560-112636627
  misc_feature 1..67: note = hypo
  source 1..67: mol_type = genomic DNA
aggtggatggcctaccgctgttctggagtctgtgggcgtgctcttccacgggcgtgctcttccacgg

SEQ ID NO: 98487 - DNA, 218 bp, Homo sapiens
  misc_feature 1..218: note = chr8:11302089-11302307
  misc_feature 1..218: note = hypo
  source 1..218: mol_type = genomic DNA
gaccgcgcagtgagccgcacagggcgccctcctggaggctcgggtctatgatccgtcctggaagcctgtgggtgccatgctccacagaaggcaggaacagacagcgtcgcaggaatctcggggcagcctgtgccaaggtctatctgtcctgaacgcactcgaagaccagactggcaggaagaaggcccagagctctctcttctcgggaagggcaggtg

SEQ ID NO: 98488 - DNA, 16 bp, Homo sapiens
  misc_feature 1..16: note = chr8:113095708-113095724
  misc_feature 1..16: note = hypo
  source 1..16: mol_type = genomic DNA
acgctgtcacctctca

SEQ ID NO: 98489 - DNA, 150 bp, Homo sapiens
  misc_feature 1..150: note = chr8:113146123-113146273
  misc_feature 1..150: note = hypo
  source 1..150: mol_type = genomic DNA
ggcttttccttagtacgcatgtgaagaatgagaggtaaggagtgagagacagaaagagagagagagagacagagggagacggagacagtcagcctatttgtataaggccaccaatcctagtggattaggactacacgattaagaccttat

SEQ ID NO: 98490 - DNA, 203 bp, Homo sapiens
  misc_feature 1..203: note = chr8:113175066-113175269
  misc_feature 1..203: note = hypo
  source 1..203: mol_type = genomic DNA
ttcactgtaaagtgccgagcatatctgtagactccagaaagtgtcccacctgtgcttacaaacaaggtgggtgttgagggttctgccgctgctgcacttttgtggggccagtctcctgctgcatccgataaggatctgcaggtgagctgagaagccctcctccattcacccagtgtcgctgtctcccccgagattcctggttg

SEQ ID NO: 98491 - DNA, 30 bp, Homo sapiens
  misc_feature 1..30: note = chr8:113221643-113221673
  misc_feature 1..30: note = hypo
  source 1..30: mol_type = genomic DNA
aagattaaacctggccgggcgcggtggctt

SEQ ID NO: 98492 - DNA, 43 bp, Homo sapiens
  misc_feature 1..43: note = chr8:1133089-1133132
  misc_feature 1..43: note = hypo
  source 1..43: mol_type = genomic DNA
acacaaatgcattcacgttcgattccctcgagatgccttgtgg

SEQ ID NO: 98493 - DNA, 30 bp, Homo sapiens
  misc_feature 1..30: note = chr8:1134528-1134558
  misc_feature 1..30: note = hypo
  source 1..30: mol_type = genomic DNA
gggaaatcatcactgcgaattctagtgacc

SEQ ID NO: 98494 - DNA, 56 bp, Homo sapiens
  misc_feature 1..56: note = chr8:1136167-1136223
  misc_feature 1..56: note = hypo
  source 1..56: mol_type = genomic DNA
ttggtgccaggattgcgatgggtcggtggcaccgagggcagcgctgcagtctgtgg

SEQ ID NO: 98495 - DNA, 30 bp, Homo sapiens
  misc_feature 1..30: note = chr8:1136428-1136458
  misc_feature 1..30: note = hypo
  source 1..30: mol_type = genomic DNA
cagcccgctgtgcagcgagttcagttgctt

SEQ ID NO: 98496 - DNA, 139 bp, Homo sapiens
  misc_feature 1..139: note = chr8:1137213-1137352
  misc_feature 1..139: note = hypo
  source 1..139: mol_type = genomic DNA
ttcacacgggacctccgtgacgtttgcctcatggaatctcacacacacgggacctctgtgacgtttgtctcatggaatctcacatgcccgggacctctgtgacatttccctcacacgcccaggacctctgtgacgtttc

SEQ ID NO: 98497 - DNA, 112 bp, Homo sapiens
  misc_feature 1..112: note = chr8:1139159-1139271
  misc_feature 1..112: note = hypo
  source 1..112: mol_type = genomic DNA
gttcgggccccaggccgattccgcggttggggttgaccttacacaggatttgggccccaggccggttccgcggttggggttgagcatacacagggttcgggccccagcggga

SEQ ID NO: 98498 - DNA, 37 bp, Homo sapiens
  misc_feature 1..37: note = chr8:1140563-1140600
  misc_feature 1..37: note = hypo
  source 1..37: mol_type = genomic DNA
cagggcactgcgagccgcctgtcgcaatcagcattga

SEQ ID NO: 98499 - DNA, 15 bp, Homo sapiens
  misc_feature 1..15: note = chr8:114444379-114444394
  misc_feature 1..15: note = hyper
  source 1..15: mol_type = genomic DNA
ccaaccagatgattc

SEQ ID NO: 98500 - DNA, 60 bp, Homo sapiens
  misc_feature 1..60: note = chr8:114444481-114444541
  misc_feature 1..60: note = hyper
  source 1..60: mol_type = genomic DNA
cgttcaagccctgtcagtccggtaaattgggttaacttagcaactcggtggtgcaaagcc

SEQ ID NO: 98501 - DNA, 447 bp, Homo sapiens
  misc_feature 1..447: note = chr8:114444784-114445231
  misc_feature 1..447: note = hyper
  source 1..447: mol_type = genomic DNA
ttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagccaagtcagccacccagtttcaacttcgggttgtccatgaa

SEQ ID NO: 98502 - DNA, 500 bp, Homo sapiens; identical to SEQ ID NO: 32247
  misc_feature 1..500: note = chr8:114445521-114446021
  misc_feature 1..500: note = hyper
  source 1..500: mol_type = genomic DNA

SEQ ID NO: 98503 - DNA, 415 bp, Homo sapiens
  misc_feature 1..415: note = chr8:114446931-114447346
  misc_feature 1..415: note = hyper
  source 1..415: mol_type = genomic DNA
tctccaaagctaaaccgattatatcagtccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtc

SEQ ID NO: 98504 - DNA, 101 bp, Homo sapiens; identical to SEQ ID NO: 32249
  misc_feature 1..101: note = chr8:114447347-114447448
  misc_feature 1..101: note = hyper
  source 1..101: mol_type = genomic DNA

SEQ ID NO: 98505 - DNA, 63 bp, Homo sapiens
  misc_feature 1..63: note = chr8:114447789-114447852
  misc_feature 1..63: note = hyper
  source 1..63: mol_type = genomic DNA
tgttgacagccctggcgcgcctgggccaaaacagcaccccctttcccgcgatcccccgccccc

SEQ ID NO: 98506 - DNA, 849 bp, Homo sapiens
  misc_feature 1..849: note = chr8:114448753-114449602
  misc_feature 1..849: note = hyper
  source 1..849: mol_type = genomic DNA
ctgagggggggagaacgagctgtgaatcaactcctttagtattatcagattattttatcggtgcaaattgcaaagtaagctgccagcctctctccatctacaagtcagcccacctccatccaaagcggaggggacccccaaagcagacctacctttcacacaagacaccgtcaataaaaagacgaggttccaaaacgtaaatccacttttaatccccattttcttcatcaggatgaagtctaggcggccacatttagcgcatcttcgcttgccaggctcccagggtttggattcctttgctcggctttcccctttgcggatccctttcatattattcgcgagctcctaattcctgctcctcagcccggcgcagtggagttgttgctgttgttggtgcgcggtcacagctcggagtgaatggtgtttctgggataccacagcaaccttgacgaggactcaaccatctctccaacgggggcacaaagtctccgctactctggattctgtcttttcttgtgcgttttttcccctccaccaaaatctaccccaattctggctcgttatagcaaccaccagaaaccactagtgagcctcttaaagcccacctctgctctctgataaactccacacaatatttgaaattaaggggcttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaaccgtgacgataatgaatcgggctccatcgatgcccacgtcgttataatgggaca

SEQ ID NO: 98507 - DNA, 30 bp, Homo sapiens
  misc_feature 1..30: note = chr8:1148027-1148057
  misc_feature 1..30: note = hypo
  source 1..30: mol_type = genomic DNA
gaaatgagccatggccgtggatgaggaaca

SEQ ID NO: 98508 - DNA, 29 bp, Homo sapiens
  misc_feature 1..29: note = chr8:115020800-115020829
  misc_feature 1..29: note = hypo
  source 1..29: mol_type = genomic DNA
gcacccggcggggctcggtggctcacgcc

SEQ ID NO: 98509 - DNA, 20 bp, Homo sapiens
  misc_feature 1..20: note = chr8:115089750-115089770
  misc_feature 1..20: note = hypo
  source 1..20: mol_type = genomic DNA
tgagtgaatgccagccgggt

SEQ ID NO: 98510 - DNA, 95 bp, Homo sapiens
  misc_feature 1..95: note = chr8:1151094-1151189
  misc_feature 1..95: note = hypo
  source 1..95: mol_type = genomic DNA
gctgctccccgtccccgaggcctggagccgtgggaggaagaggaggatgccacggagccctgtggaggctgaagccgctgcgtagggagcccctt

SEQ ID NO: 98511 - DNA, 136 bp, Homo sapiens
  misc_feature 1..136: note = chr8:1152943-1153079
  misc_feature 1..136: note = hypo
  source 1..136: mol_type = genomic DNA
tcccgagaagctgagcgacatcacggtttccgtgtactccggtgattgcagagttctcctcgccaccaccccatccatctgccgggcacccacatccacgccggttccgtaagctgctctccggctctcccaaatg

SEQ ID NO: 98512 - DNA, 118 bp, Homo sapiens; identical to SEQ ID NO: 41667
  misc_feature 1..118: note = chr8:1153298-1153416
  misc_feature 1..118: note = hypo
  source 1..118: mol_type = genomic DNA

SEQ ID NO: 98513 - DNA, 219 bp, Homo sapiens
  misc_feature 1..219: note = chr8:11536805-11537024
  misc_feature 1..219: note = hyper
  source 1..219: mol_type = genomic DNA
gaaggttctcagactcggggatgggggaggaaggggacgtttctagaagaaacttaaagggggctcgcgccgcacgactgtaggtggagggcgtgcgccgcgggacgccccagccgggtctgataaagccccgaagccgatctaaggtcaataaaccaggcggcgtcaggcttgggccgagggccgggaggagaggagagtggagccctctcaggctgg

SEQ ID NO: 98514 - DNA, 127 bp, Homo sapiens; identical to SEQ ID NO: 31777
  misc_feature 1..127: note = chr8:11537156-11537283
  misc_feature 1..127: note = hyper
  source 1..127: mol_type = genomic DNA

SEQ ID NO: 98515 - DNA, 51 bp, Homo sapiens
  misc_feature 1..51: note = chr8:11538169-11538220
  misc_feature 1..51: note = hyper
  source 1..51: mol_type = genomic DNA
cgccctttgcgtcagagaccccccccttggggagaccggaatcctccagcc

SEQ ID NO: 98516 - DNA, 30 bp, Homo sapiens; identical to SEQ ID NO: 31778
  misc_feature 1..30: note = chr8:11540426-11540456
  misc_feature 1..30: note = hyper
  source 1..30: mol_type = genomic DNA

SEQ ID NO: 98517 - DNA, 343 bp, Homo sapiens
  misc_feature 1..343: note = chr8:11550025-11550368
  misc_feature 1..343: note = hyper
  source 1..343: mol_type = genomic DNA
gaaactatgctcatgcggatctagattgaatctgatccttcgggccgcggcggctccgcctgggagggcgtggcccccgcgctggggcgggaaccggcttctggggacccgcggcctctgcgcctcagccgacctccaccgcgggtgcgtgcgggggtgcgggggtgaggggtgcggggctgctccgtcgggaggctgggagggagagcaggcgccgggacccacgcgagggcgcggacggacggggggcgggaagcgaggctgccgaggggaggaagcggggccggcgcagcgggcgccaggccgggcagaggcgggggcggccggccgggggctgaccccg

SEQ ID NO: 98518 - DNA, 82 bp, Homo sapiens
  misc_feature 1..82: note = chr8:11550619-11550701
  misc_feature 1..82: note = hyper
  source 1..82: mol_type = genomic DNA
cccagtgtctgttaacgatgtggtgttcatttgttcctaaagagctgtaaggaagcttagaaatgattcggcaagctgggcg

SEQ ID NO: 98519 - DNA, 198 bp, Homo sapiens
  misc_feature 1..198: note = chr8:11554969-11555167
  misc_feature 1..198: note = hyper
  source 1..198: mol_type = genomic DNA
tggggaagcggtgttcggaggggagcagcgctctcggtgggcacctgctgcagttggggagggagaggtggtcgtggaggccactttcccctccaccgccagggaagcctggtctgtctgaaggggtcctcgcctgcgccgaggatggccggacggccgggcctccggccccagcacagcccccctttcagaggaccc

SEQ ID NO: 98520 - DNA, 48 bp, Homo sapiens
  misc_feature 1..48: note = chr8:11555473-11555521
  misc_feature 1..48: note = hyper
  source 1..48: mol_type = genomic DNA
cgcgggtgtccctaccataaccactgtcctccccgggagctgggcaag

SEQ ID NO: 98521 - DNA, 73 bp, Homo sapiens
  misc_feature 1..73: note = chr8:11558318-11558391
  misc_feature 1..73: note = hyper
  source 1..73: mol_type = genomic DNA
attataagactctggcgaccttggtggcgccagattttttcagatgttgcttttgttccgggtgtagcggcca

SEQ ID NO: 98522 - DNA, 15 bp, Homo sapiens
  misc_feature 1..15: note = chr8:11559650-11559665
  misc_feature 1..15: note = hyper
  source 1..15: mol_type = genomic DNA
actactaggagaagc

SEQ ID NO: 98523 - DNA, 828 bp, Homo sapiens
  misc_feature 1..828: note = chr8:11560067-11560895
  misc_feature 1..828: note = hyper
  source 1..828: mol_type = genomic DNA
gtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccgccggggtctagaggggcggctgccgtgcgtccagcctgtgcgcaggcctttcgccgctcggcgccccaggcagcctcagtttcctttcctctgtttgcgccccagtgaacctccgcacctctcattcagggaagagaattccccgcgcagccgcgctcgtttcttcctctgggattttcctgagaatccccaggagttggccacgatcccatggggggtttccttctacccagccccgcgtcctggcctcgtccttaacccccgggttgccttcactcaggctgggaatccacgattgatttcctactacggaagcgggtggcgttcccagcctgctttcggagcagcacgggtttcgtgcagggtgttatcccgaccccttcccccatccctctaatctggcttgagaagcccgtgctggagagaaaaacgcggccttaaaaaaaaaaaaaagtttaaccgaaagcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 98524 - DNA, 30 bp, Homo sapiens; identical to SEQ ID NO: 9400
  misc_feature 1..30: note = chr8:11561116-11561146
  misc_feature 1..30: note = hyper
  source 1..30: mol_type = genomic DNA

SEQ ID NO: 98525 - DNA, 333 bp, Homo sapiens; identical to SEQ ID NO: 31787
  misc_feature 1..333: note = chr8:11561391-11561724
  misc_feature 1..333: note = hyper
  source 1..333: mol_type = genomic DNA

SEQ ID NO: 98526 - DNA, 471 bp, Homo sapiens; identical to SEQ ID NO: 3202
  misc_feature 1..471: note = chr8:11561725-11562196
  misc_feature 1..471: note = hyper
  source 1..471: mol_type = genomic DNA

SEQ ID NO: 98527 - DNA, 821 bp, Homo sapiens
  misc_feature 1..821: note = chr8:11562235-11563056
  misc_feature 1..821: note = hyper
  source 1..821: mol_type = genomic DNA
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggccagcgaggagtgtcctataaagggacggggacttttcggcgcttgcaattctcccattctgaaaaatagatcggaagagggctattggttgattcttgaaaggggagcgcatttcctgttggcctgcgaatttggggtgaa

SEQ ID NO: 98528 - DNA, 37 bp, Homo sapiens
  misc_feature 1..37: note = chr8:115649501-115649538
  misc_feature 1..37: note = hypo
  source 1..37: mol_type = genomic DNA
gtagacctgggctgttcctattcggccatcttggctc

SEQ ID NO: 98529 - DNA, 30 bp, Homo sapiens
  misc_feature 1..30: note = chr8:11615747-11615777
  misc_feature 1..30: note = hypo
  source 1..30: mol_type = genomic DNA
ccaagccctcaggagcgtctccatgggcct

SEQ ID NO: 98530 - DNA, 28 bp, Homo sapiens
  misc_feature 1..28: note = chr8:116354110-116354138
  misc_feature 1..28: note = hypo
  source 1..28: mol_type = genomic DNA
tttttttttttgagacggagtcttgctc

SEQ ID NO: 98531 - DNA, 30 bp, Homo sapiens
  misc_feature 1..30: note = chr8:11656439-11656469
  misc_feature 1..30: note = hypo
  source 1..30: mol_type = genomic DNA
agcttagaccacagacgggcactttgaagg

SEQ ID NO: 98532 - DNA, 277 bp, Homo sapiens
  misc_feature 1..277: note = chr8:116660295-116660572
  misc_feature 1..277: note = hyper
  source 1..277: mol_type = genomic DNA
aagaggaaatcagagcgtcaaatcaaggaggggtggcagcaaagaggaagcaaaagagaagacaagaggaaagagagtttatggagagaggaagccaatttgggaagtggggagaagggcaggctggccaggggatgcgacgcgacagggcagagggagtgggaagaagcgggcaggaggcggcctccacgcagctggcagggcaggcagcgctggagagggaggaggagagggaggctgcaggcaccgcgcagcagccgaggatgagagaggtaac

SEQ ID NO: 98533 - DNA, 208 bp, Homo sapiens
  misc_feature 1..208: note = chr8:116660615-116660823
  misc_feature 1..208: note = hyper
  source 1..208: mol_type = genomic DNA
cgataacacgcccacagcccgggcgccgagcacgcgtggtggcggccgcaggcccggggctcctgcgagagcgaacgccagcgacacacacgcagctcctgttgtgtcgccgctgccgcctaggcagggccgcagacagcagcctccttcccagactgagccaactcactctcaccgtagctgctccagaatccgtgaaaagaaaatg

SEQ ID NO: 98534 - DNA, 170 bp, Homo sapiens; identical to SEQ ID NO: 41911
  misc_feature 1..170: note = chr8:116710279-116710449
  misc_feature 1..170: note = hypo
  source 1..170: mol_type = genomic DNA

SEQ ID NO: 98535 - DNA, 30 bp, Homo sapiens
  misc_feature 1..30: note = chr8:116991751-116991781
  misc_feature 1..30: note = hypo
  source 1..30: mol_type = genomic DNA
tattgcaagacaccacgatattgataattt

SEQ ID NO: 98536 - DNA, 134 bp, Homo sapiens
  misc_feature 1..134: note = chr8:11704540-11704674
  misc_feature 1..134: note = hypo
  source 1..134: mol_type = genomic DNA
catcagccatcagcacgcacctgacttgtagagcaggaagtccgaatacacagagaaagctccctccacggggccgtttttgtagatctcggccatgatgtccttctcgctattggagacgctgtaggaattgt

SEQ ID NO: 98537 - DNA, 238 bp, Homo sapiens; identical to SEQ ID NO: 41707
  misc_feature 1..238: note = chr8:11705917-11706155
  misc_feature 1..238: note = hypo
  source 1..238: mol_type = genomic DNA

SEQ ID NO: 98538 - DNA, 153 bp, Homo sapiens
  misc_feature 1..153: note = chr8:117065205-117065358
  misc_feature 1..153: note = hypo
  source 1..153: mol_type = genomic DNA
ccaagaagagggttacgaatagagagaacaagaatgggatgtctttagtagagcaggtcataatctagttaacatcagaaatgagatgataaaaacgcacggcgccttgcaagtgagtgccagtggaacatgtatagacgtgcatattcagca

SEQ ID NO: 98539 - DNA, 64 bp, Homo sapiens
  misc_feature 1..64: note = chr8:11708426-11708490
  misc_feature 1..64: note = hypo
  source 1..64: mol_type = genomic DNA
tgtggccattgttcccgtgcatcgaagcttgcaggcagcttcaggtcctcggtaaacataactc

SEQ ID NO: 98540 - DNA, 36 bp, Homo sapiens
  misc_feature 1..36: note = chr8:11726469-11726505
  misc_feature 1..36: note = hypo
  source 1..36: mol_type = genomic DNA
cagaggggctgggttcggtggctcacgcctgtaatc

SEQ ID NO: 98541 - DNA, 30 bp, Homo sapiens
  misc_feature 1..30: note = chr8:117572696-117572726
  misc_feature 1..30: note = hypo
  source 1..30: mol_type = genomic DNA
gaggctggtggttaccgtccttccctctgt

SEQ ID NO: 98542 - DNA, 18 bp, Homo sapiens
  misc_feature 1..18: note = chr8:117621492-117621510
  misc_feature 1..18: note = hypo
  source 1..18: mol_type = genomic DNA
gagcgagactccatctca

SEQ ID NO: 98543 - DNA, 131 bp, Homo sapiens
  misc_feature 1..131: note = chr8:11772171-11772302
  misc_feature 1..131: note = hypo
  source 1..131: mol_type = genomic DNA
atagatatgactccccgcatcactgggagtgtccacccctctgcgatgtggctcgtcttatcgggggtgggttggtgatatttctccccgcatcgtgggggtcgcccgccccgctgcgatgtgtatcgtaa

SEQ ID NO: 98544 - DNA, 147 bp, Homo sapiens
  misc_feature 1..147: note = chr8:117824014-117824161
  misc_feature 1..147: note = hypo
  source 1..147: mol_type = genomic DNA
aacattgtgcactcacgttttgccaggctctgtgacaggtgttgggatacagaaacaaaagagactgtctttgactcgtaagagctcacattcctgactgggcgtggcaggagaattgcttgaacccaggaggcgaaggttgtggtg

SEQ ID NO: 98545 - DNA, 639 bp, Homo sapiens; identical to SEQ ID NO: 32256
  misc_feature 1..639: note = chr8:117950319-117950958
  misc_feature 1..639: note = hyper
  source 1..639: mol_type = genomic DNA

SEQ ID NO: 98546 - DNA, 23 bp, Homo sapiens
  misc_feature 1..23: note = chr8:118453896-118453919
  misc_feature 1..23: note = hypo
  source 1..23: mol_type = genomic DNA
agccaccgcgcctggccacgcaa

SEQ ID NO: 98547 - DNA, 172 bp, Homo sapiens
  misc_feature 1..172: note = chr8:1184672-1184844
  misc_feature 1..172: note = hypo
  source 1..172: mol_type = genomic DNA
taaaattatgtcccacgagcttgactttggactgacagtgattctgttgcacgtcacaccctttctgggaactcataggtggttaggatcaagctgcctctgccttgcgcaactggggcctttcatgtgccctcaagtgagtgagttcacggcgtcacgtcaggagtgatac

SEQ ID NO: 98548 - DNA, 30 bp, Homo sapiens
  misc_feature 1..30: note = chr8:119057219-119057249
  misc_feature 1..30: note = hypo
  source 1..30: mol_type = genomic DNA
ttgccaacctctagtcgatactatataagc

SEQ ID NO: 98549 - DNA, 37 bp, Homo sapiens
  misc_feature 1..37: note = chr8:119571068-119571105
  misc_feature 1..37: note = hypo
  source 1..37: mol_type = genomic DNA
tacaggcgtgagccaccgcgcccggccgacactgagc

SEQ ID NO: 98550 - DNA, 63 bp, Homo sapiens
  misc_feature 1..63: note = chr8:119964391-119964454
  misc_feature 1..63: note = hyper
  source 1..63: mol_type = genomic DNA
ggctgaggaacaaggcggctgctgtctccgcggggctctgaggtttcccggccccttcccgcc

SEQ ID NO: 98551 - DNA, 300 bp, Homo sapiens
  misc_feature 1..300: note = chr8:1201984-1202284
  misc_feature 1..300: note = hypo
  source 1..300: mol_type = genomic DNA
actgtggtgttgtcacgtgggtgtgttgtgttgtcctgagtcacaatgtcagagtcatgtcatgtcacacttgtcacactgtgttgtcgtgtgggtgtgttgtgttgtcctgggtcacggtgtcaaagtcatgtcatgtcacacttgccacactgtggtgttgtcacacgggtgtgttgtgttgtcctgggtcacggtgtcacagtcgtgtcatgtcacacttgtcacactgtggtgttgtcacatgggtgtgttgtgttgtcctgggtcgtggtgtcacagtcacgtcatgtcacactt

SEQ ID NO: 98552 - DNA, 45 bp, Homo sapiens
  misc_feature 1..45: note = chr8:120220486-120220531
  misc_feature 1..45: note = hyper
  source 1..45: mol_type = genomic DNA
acctgtgcacgtgatcgcgagcggctcgggcgccagggcggagcg

SEQ ID NO: 98553 - DNA, 144 bp, Homo sapiens
  misc_feature 1..144: note = chr8:1202638-1202782
  misc_feature 1..144: note = hypo
  source 1..144: mol_type = genomic DNA
aaagagtcatggtttcgtgctctgtgctgtgtgagaggtgctagcgaggccgccgggtgtcatggctgggcagtggccatggcggccaggcaggcctgctgtcatctagagctcctgttgaagcgcggccggatgtggtgcctc

SEQ ID NO: 98554 - DNA, 45 bp, Homo sapiens
  misc_feature 1..45: note = chr8:120319364-120319409
  misc_feature 1..45: note = hypo
  source 1..45: mol_type = genomic DNA
tcccttgcctggctcggtgggtcccacacccgcagcacagcagtc

SEQ ID NO: 98555 - DNA, 30 bp, Homo sapiens
  misc_feature 1..30: note = chr8:1203228-1203258
  misc_feature 1..30: note = hypo
  source 1..30: mol_type = genomic DNA
gggctgtgtccaccacgcagggctgcagcc

SEQ ID NO: 98556 - DNA, 231 bp, Homo sapiens
  misc_feature 1..231: note = chr8:120428491-120428722
  misc_feature 1..231: note = hyper
  source 1..231: mol_type = genomic DNA
ccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatc

SEQ ID NO: 98557 - DNA, 54 bp, Homo sapiens
  misc_feature 1..54: note = chr8:120429002-120429056
  misc_feature 1..54: note = hyper
  source 1..54: mol_type = genomic DNA
gccctccccagtgcccgggccggtgccctgcgacgccgccgacctgcgcccccg

SEQ ID NO: 98558 - DNA, 30 bp, Homo sapiens
  misc_feature 1..30: note = chr8:120429286-120429316
  misc_feature 1..30: note = hyper
  source 1..30: mol_type = genomic DNA
ccccttcccagagggcgataagcaaataat

SEQ ID NO: 98559 - DNA, 30 bp, Homo sapiens
  misc_feature 1..30: note = chr8:1204827-1204857
  misc_feature 1..30: note = hypo
  source 1..30: mol_type = genomic DNA
tcctgacttttcctccgtgggcctcactcc

SEQ ID NO: 98560 - DNA, 30 bp, Homo sapiens
  misc_feature 1..30: note = chr8:120525191-120525221
  misc_feature 1..30: note = hypo
  source 1..30: mol_type = genomic DNA
aaccactcttcatgtcggtggtttggttgt

SEQ ID NO: 98561 - DNA, 30 bp, Homo sapiens
  misc_feature 1..30: note = chr8:120591921-120591951
  misc_feature 1..30: note = hypo
  source 1..30: mol_type = genomic DNA
ctgatttgattccttcggtgaatctctccc

SEQ ID NO: 98562 - DNA, 16 bp, Homo sapiens
  misc_feature 1..16: note = chr8:120695441-120695457
  misc_feature 1..16: note = hypo
  source 1..16: mol_type = genomic DNA
gcgcccagcctttata

SEQ ID NO: 98563 - DNA, 31 bp, Homo sapiens
  misc_feature 1..31: note = chr8:120844095-120844126
  misc_feature 1..31: note = hypo
  source 1..31: mol_type = genomic DNA
ttcattttaaaactacgaattggggcctggt

SEQ ID NO: 98564 - DNA, 39 bp, Homo sapiens
  misc_feature 1..39: note = chr8:120845542-120845581
  misc_feature 1..39: note = hypo
  source 1..39: mol_type = genomic DNA
tatagattacaaggccgggcgcagtggctcactcctgta

SEQ ID NO: 98565 - DNA, 198 bp, Homo sapiens
  misc_feature 1..198: note = chr8:1209060-1209258
  misc_feature 1..198: note = hypo
  source 1..198: mol_type = genomic DNA
taggactcagcagctcgtctctgaagaagaattggctttaccatcaaattgcaatattttctttatttttgtttgttctggattgacaaatttccatcagtttctgtgaggtaacagatgctgatacaggcttgttggctttaagtgcattcgcccaaggtgccaatgagccgcaggctgagtcggatctgggaagcc

SEQ ID NO: 98566 - DNA, 19 bp, Homo sapiens
  misc_feature 1..19: note = chr8:121002670-121002689
  misc_feature 1..19: note = hypo
  source 1..19: mol_type = genomic DNA
caggcgtgagccaccatgc

SEQ ID NO: 98567 - DNA, 23 bp, Homo sapiens
  misc_feature 1..23: note = chr8:121135619-121135642
  misc_feature 1..23: note = hypo
  source 1..23: mol_type = genomic DNA
accgcgcccggccaattttctgt

SEQ ID NO: 98568 - DNA, 89 bp, Homo sapiens
  misc_feature 1..89: note = chr8:121135998-121136087
  misc_feature 1..89: note = hyper
  source 1..89: mol_type = genomic DNA
aaaggcgccttgctgcggccgcgccctgtggctgaacttaggccaattccgagcgagaccgagacgcagggcggcggtgggggctggaa

SEQ ID NO: 98569 - DNA, 956 bp, Homo sapiens
  misc_feature 1..956: note = chr8:121136826-121137782
  misc_feature 1..956: note = hyper
  source 1..956: mol_type = genomic DNA
gcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaacaggagggctcgagacctcccaaagagagcagggggcctggtttgggagcttgcagtagcttctgccccagtggaagggaaagagcctggctcgctctcggcgcgccacatccggctgccgcgcgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtcagttcgtctttctctgctcttctttggctcggcttcgaagtccattcatgagcaaggaaaagtggaggcagcgagccacctgcagacgcaatgcagttccatggactttcttttcacgcgcgcgcccagaatggactggggacctttgggacgggatgggacgggtacacctggatgccttttcgcggggttcacggtgt

SEQ ID NO: 98570 - DNA, 28 bp, Homo sapiens
  misc_feature 1..28: note = chr8:121206406-121206434
  misc_feature 1..28: note = hypo
  source 1..28: mol_type = genomic DNA
agccattcctattcggccatcttggctg

SEQ ID NO: 98571 - DNA, 30 bp, Homo sapiens
  misc_feature 1..30: note = chr8:121289793-121289823
  misc_feature 1..30: note = hypo
  source 1..30: mol_type = genomic DNA
cagcaagaaatactacgcagccataaaaaa

SEQ ID NO: 98572 - DNA, 30 bp, Homo sapiens; identical to SEQ ID NO: 41916
  misc_feature 1..30: note = chr8:121354745-121354775
  misc_feature 1..30: note = hypo
  source 1..30: mol_type = genomic DNA

SEQ ID NO: 98573 - DNA, 32 bp, Homo sapiens
  misc_feature 1..32: note = chr8:121479576-121479608
  misc_feature 1..32: note = hypo
  source 1..32: mol_type = genomic DNA
aggtgcagtgactcacgcctgtaatcccacca

SEQ ID NO: 98574 - DNA, 138 bp, Homo sapiens
  misc_feature 1..138: note = chr8:121545084-121545222
  misc_feature 1..138: note = hypo
  source 1..138: mol_type = genomic DNA
ttagcacttaaagatcgaccattctttgtaacagttgcagaatattcaagcatacctctgtaccaggatttatttagctagtgatggtcacactgactttttcaatggtcttgttgcaagcaacgctgcagagatgat

SEQ ID NO: 98575 - DNA, 30 bp, Homo sapiens; identical to SEQ ID NO: 41917
  misc_feature 1..30: note = chr8:121566445-121566475
  misc_feature 1..30: note = hypo
  source 1..30: mol_type = genomic DNA

SEQ ID NO: 98576 - DNA, 30 bp, Homo sapiens; identical to SEQ ID NO: 41918
  misc_feature 1..30: note = chr8:121573169-121573199
  misc_feature 1..30: note = hypo
  source 1..30: mol_type = genomic DNA

SEQ ID NO: 98577 - DNA, 97 bp, Homo sapiens
  misc_feature 1..97: note = chr8:121629842-121629939
  misc_feature 1..97: note = hypo
  source 1..97: mol_type = genomic DNA
ttccaaaggaacttacggtattgggcttcctcgtgcattttggatgaggtgttttgttggtcagccttggtgggcataatagcgtgtccaaccttgc

SEQ ID NO: 98578 - DNA, 108 bp, Homo sapiens
  misc_feature 1..108: note = chr8:121643554-121643662
  misc_feature 1..108: note = hypo
  source 1..108: mol_type = genomic DNA
cagcattgtccctttcgttctttgaaatctttgagagataggacaataccaagcccaacaacccatttggtgttaaatttttaggctaagacccgcgcatgatctgct

SEQ ID NO: 98579 - DNA, 54 bp, Homo sapiens
  misc_feature 1..54: note = chr8:121705929-121705983
  misc_feature 1..54: note = hypo
  source 1..54: mol_type = genomic DNA
acctgttctcagggtcggccaaggccatactccgagtgacgtagcacattttga

SEQ ID NO: 98580 - DNA, 75 bp, Homo sapiens; identical to SEQ ID NO: 41919
  misc_feature 1..75: note = chr8:121712263-121712338
  misc_feature 1..75: note = hypo
  source 1..75: mol_type = genomic DNA

SEQ ID NO: 98581 - DNA, 205 bp, Homo sapiens
  misc_feature 1..205: note = chr8:121717222-121717427
  misc_feature 1..205: note = hypo
  source 1..205: mol_type = genomic DNA
ctgatagaagtatgccgttcagaaaaggagagagaagtccttctctttgcctcctcgatcagcctatacctgaagttctaacaggttagacgatgtttaaatgagggtaaagcaaatgatcagcttgttgaaaggctcaggaaataattaaaccatacattaaatgacagacattagcacaaaagagtgacgtgcataaactttg

SEQ ID NO: 98582 - DNA, 183 bp, Homo sapiens; identical to SEQ ID NO: 41920
  misc_feature 1..183: note = chr8:121732132-121732315
  misc_feature 1..183: note = hypo
  source 1..183: mol_type = genomic DNA

SEQ ID NO: 98583 - DNA, 233 bp, Homo sapiens
  misc_feature 1..233: note = chr8:121825604-121825837
  misc_feature 1..233: note = hypo
  source 1..233: mol_type = genomic DNA
attgatgtgtatcatcgttgaaagttctctaagtcttttagaatgactcacacttttaatcaaggaggcttaaaggctcagatgactccctaaagagcggagtcccagccaggtcaaggaatgaaatgaaaacatttggacattttcttgagaaggcggagtcactgcaggtgagagggtgccctgggttaatgcttctgcttgtagctctcccttttcgtatatttttaact

SEQ ID NO: 98584 - DNA, 25 bp, Homo sapiens
  misc_feature 1..25: note = chr8:121855050-121855075
  misc_feature 1..25: note = hypo
  source 1..25: mol_type = genomic DNA
cgcacccggccggaaaacatatttt

SEQ ID NO: 98585 - DNA, 30 bp, Homo sapiens
  misc_feature 1..30: note = chr8:1219311-1219341
  misc_feature 1..30: note = hypo
  source 1..30: mol_type = genomic DNA
cagaggctcctggtacggggaggatgggac

SEQ ID NO: 98586 - DNA, 144 bp, Homo sapiens; identical to SEQ ID NO: 41922
  misc_feature 1..144: note = chr8:121982491-121982635
  misc_feature 1..144: note = hypo
  source 1..144: mol_type = genomic DNA

SEQ ID NO: 98587 - DNA, 30 bp, Homo sapiens
  misc_feature 1..30: note = chr8:122402000-122402030
  misc_feature 1..30: note = hypo
  source 1..30: mol_type = genomic DNA
cttgatccatcacttcgggtctgaattttc

SEQ ID NO: 98588 - DNA, 799 bp, Homo sapiens
  misc_feature 1..799: note = chr8:122651726-122652525
  misc_feature 1..799: note = hyper
  source 1..799: mol_type = genomic DNA
agtccaagtattcagcgcggacgtttgggggacggagggagaggcgctaggggaactggcacctaagactgtgtaataggacacaggtcttgcaagtcctcctccccaggcaccgcccctgtgctcccagcgcctctttgcagctttaattatcctttcagcgccgttcccccgcggctgcgtttccgtggtcagaggaaaaaggctctttcgcctcccggttctcaccctcatacagaccctcctttcagacccgccctcctgttcacagggacccatttcggagccctggctcacgctgggcgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctggcccgagtaagcccagactgacgagcctgacactttaatggggtgcgggaagtgcaaaggaggggaggcccgggaaaggggggagtggccgagaggggatggtagctgcgaggaggtagagaa

SEQ ID NO: 98589 - DNA, 30 bp, Homo sapiens
  misc_feature 1..30: note = chr8:122653102-122653132
  misc_feature 1..30: note = hyper
  source 1..30: mol_type = genomic DNA
tcttggtcataaagtcgtcctcagcctgtc

SEQ ID NO: 98590 - DNA, 106 bp, Homo sapiens
  misc_feature 1..106: note = chr8:122654322-122654428
  misc_feature 1..106: note = hyper
  source 1..106: mol_type = genomic DNA
tctgccgtgggtgggcggaaaacatagaaaagtaattatatgtatatttttgctcaatctggtcccctaacgtaaacatactcaaacagcgcgcattaaaaataaa

SEQ ID NO: 98591 - DNA, 258 bp, Homo sapiens
  misc_feature 1..258: note = chr8:123695489-123695747
  misc_feature 1..258: note = hypo
  source 1..258: mol_type = genomic DNA
gagaaatttaaagggcgagagatggcggcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctagggggtgagggagaagcagtggaggaacggtcagaagagatgcatgctcccagtcaggcaaaggcagataagaggcggttgctgcaaatt

SEQ ID NO: 98592 - DNA, 347 bp, Homo sapiens; identical to SEQ ID NO: 41924
  misc_feature 1..347: note = chr8:123966045-123966392
  misc_feature 1..347: note = hypo
  source 1..347: mol_type = genomic DNA

SEQ ID NO: 98593 - DNA, 26 bp, Homo sapiens
  misc_feature 1..26: note = chr8:124001542-124001568
  misc_feature 1..26: note = hypo
  source 1..26: mol_type = genomic DNA
ttggataacaagtcccgtggctgggc

SEQ ID NO: 98594 - DNA, 42 bp, Homo sapiens
  misc_feature 1..42: note = chr8:12403483-12403525
  misc_feature 1..42: note = hypo
  source 1..42: mol_type = genomic DNA
actagaatcattccactgatttccctccgccaatcaggggga

SEQ ID NO: 98595 - DNA, 105 bp, Homo sapiens; identical to SEQ ID NO: 41925
  misc_feature 1..105: note = chr8:124055130-124055235
  misc_feature 1..105: note = hypo
  source 1..105: mol_type = genomic DNA

SEQ ID NO: 98596 - DNA, 45 bp, Homo sapiens; identical to SEQ ID NO: 41926
  misc_feature 1..45: note = chr8:124055535-124055580
  misc_feature 1..45: note = hypo
  source 1..45: mol_type = genomic DNA

SEQ ID NO: 98597 - DNA, 142 bp, Homo sapiens
  misc_feature 1..142: note = chr8:124168256-124168398
  misc_feature 1..142: note = hypo
  source 1..142: mol_type = genomic DNA
atggcagactctcctcgttggcactaagacccattgagtaagagctattatcctagaaagattcaagtgaaagcccctggaatttcctccttaccaggatagtaaacctggttagtaaaaagttatcgcaattatccccagg

SEQ ID NO: 98598 - DNA, 30 bp, Homo sapiens
  misc_feature 1..30: note = chr8:124169134-124169164
  misc_feature 1..30: note = hyper
  source 1..30: mol_type = genomic DNA
tggactgtgaccacccggactcctacccta

SEQ ID NO: 98599 - DNA, 656 bp, Homo sapiens
  misc_feature 1..656: note = chr8:124172796-124173452
  misc_feature 1..656: note = hyper
  source 1..656: mol_type = genomic DNA
ctcccggcgacctcccggctcccagacctggctgagcccggcggccgccaggggacgctgtgcccaggggttgccgccgctgccccgcaggtttcggctttttccaaattagcctagggacacaccgcgccactagccggtacagggtaccaggcccgatccccacgccaaggtggccccatcacccagacctgcccagggaagggaggtagaacaggagttgggggtgggggcggtgcagatatttcgctccgtaaagtgtctccagcttttaaagatgtatgtccccaattttccaagaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtcagggtcgcctccccacggggtcgcagatgagggagtggggccgcgcagggaggctcctgcaggccgtgacccccaggcctggcccgtagagagtgactgatggcgaggacccgctggggacccgagggcctcagcctgcgcctgcgccggggctccccgaccaagaccttccggcccccaggcctttgcaccggcagctctaggcc

SEQ ID NO: 98600 - DNA, 33 bp, Homo sapiens
  misc_feature 1..33: note = chr8:124185498-124185531
  misc_feature 1..33: note = hypo
  source 1..33: mol_type = genomic DNA
ttttttttcctgagacggagtcttgctctatcg

SEQ ID NO: 98601 - DNA, 16 bp, Homo sapiens
  misc_feature 1..16: note = chr8:124193486-124193502
  misc_feature 1..16: note = hypo
  source 1..16: mol_type = genomic DNA
gcgccacactttaaaa

SEQ ID NO: 98602 - DNA, 28 bp, Homo sapiens
  misc_feature 1..28: note = chr8:124248750-124248778
  misc_feature 1..28: note = hypo
  source 1..28: mol_type = genomic DNA
gggtgcagtggctcacgcctataatccc

SEQ ID NO: 98603 - DNA, 30 bp, Homo sapiens
  misc_feature 1..30: note = chr8:124255278-124255308
  misc_feature 1..30: note = hypo
  source 1..30: mol_type = genomic DNA
gttgaccaggttcagcgttctttcttcaac

SEQ ID NO: 98604 - DNA, 17 bp, Homo sapiens
  misc_feature 1..17: note = chr8:124288888-124288905
  misc_feature 1..17: note = hypo
  source 1..17: mol_type = genomic DNA
gccgatgactaggtttt

SEQ ID NO: 98605 - DNA, 41 bp, Homo sapiens
  misc_feature 1..41: note = chr8:124374923-124374964
  misc_feature 1..41: note = hypo
  source 1..41: mol_type = genomic DNA
gggattaaggtgtgagtcatcacgcccggccaaaaatatca

SEQ ID NO: 98606 - DNA, 20 bp, Homo sapiens
  misc_feature 1..20: note = chr8:124428122-124428142
  misc_feature 1..20: note = hypo
  source 1..20: mol_type = genomic DNA
gcacccggccctaaacacta

SEQ ID NO: 98607 - DNA, 211 bp, Homo sapiens
  misc_feature 1..211: note = chr8:124632114-124632325
  misc_feature 1..211: note = hypo
  source 1..211: mol_type = genomic DNA
aattgtttgggtttacgcagcccaggtaactggataatcagccttcatggaggacacagaaagtcacgtctacatgcagggcagacaggaagcttgtaaacagagagtggtacccacggtcatgtccattagcagctaatcctctgcaaggccaagagagtttgtgaaatatgttttggttccaattttggaaatacgttctttcattagc

SEQ ID NO: 98608 - DNA, 447 bp, Homo sapiens
  misc_feature 1..447: note = chr8:1246426-1246873
  misc_feature 1..447: note = hypo
  source 1..447: mol_type = genomic DNA
aacggagaaatgtggcgtgcatgaacggacaccacgcgagatagggaggattcaggatgtgatcttatttcagcatctttataagtgatcaagtaaaagtcatataattgaagttatctaaaccccccatacaccaaatgcgtccgcttcctggtctgtcgtcctgcagcctacagaggccgcgtccttccacatgatggccccgcacctggcactgtcgccgtccctcagtggagacaccaggaagccctggatcacagtgtgacacgttctgtactggggtataaatacggtttcatggggacacacaggagggagctgagtgtgctcctctggccccggagagtgctgagaggcagcgtaccctgcagaagagtggcagtcgctgagcgtgggggacggctcagtaggtacctcggccacagtcctgcccgtccacatgtcctg

SEQ ID NO: 98609 - DNA, 43 bp, Homo sapiens
  misc_feature 1..43: note = chr8:124934797-124934840
  misc_feature 1..43: note = hyper
  source 1..43: mol_type = genomic DNA
ctcagagaccattagcgagagaaggcagcgcctcctgctggtg

SEQ ID NO: 98610 - DNA, 30 bp, Homo sapiens
  misc_feature 1..30: note = chr8:1251266-1251296
  misc_feature 1..30: note = hypo
  source 1..30: mol_type = genomic DNA
gaggaaggggtggggcgcggtggctcacgc

SEQ ID NO: 98611 - DNA, 70 bp, Homo sapiens
  misc_feature 1..70: note = chr8:1251700-1251770
  misc_feature 1..70: note = hypo
  source 1..70: mol_type = genomic DNA
ccattaggtttaatgcgttatttattttatttttaaaggtgtaactctctcttaacggagaatcagtaga

SEQ ID NO: 98612 - DNA, 209 bp, Homo sapiens
  misc_feature 1..209: note = chr8:125184265-125184474
  misc_feature 1..209: note = hypo
  source 1..209: mol_type = genomic DNA
ggggggggggggtacctgaaagttgccaggtggaggtcgttaaggggaagctgttaactgaaaatgctatataaactacacgctgtttgcaggccgttgtgtttttcctgcccagcctgccaccactggcctggatataaggtggatatcttgtccagcccggtgccactggactctctcccctgtatgtaagccgctaataaaaccct

SEQ ID NO: 98613 - DNA, 97 bp, Homo sapiens; identical to SEQ ID NO: 41929
  misc_feature 1..97: note = chr8:125452302-125452399
  misc_feature 1..97: note = hypo
  source 1..97: mol_type = genomic DNA

SEQ ID NO: 98614 - DNA, 36 bp, Homo sapiens; identical to SEQ ID NO: 41930
  misc_feature 1..36: note = chr8:125452639-125452675
  misc_feature 1..36: note = hypo
  source 1..36: mol_type = genomic DNA

SEQ ID NO: 98615 - DNA, 30 bp, Homo sapiens; identical to SEQ ID NO: 41931
  misc_feature 1..30: note = chr8:125568984-125569014
  misc_feature 1..30: note = hypo
  source 1..30: mol_type = genomic DNA

SEQ ID NO: 98616 - DNA, 30 bp, Homo sapiens
  misc_feature 1..30: note = chr8:125574006-125574036
  misc_feature 1..30: note = hypo
  source 1..30: mol_type = genomic DNA
tagtgaagcacacagcggggaagaggagct

SEQ ID NO: 98617 - DNA, 30 bp, Homo sapiens
  misc_feature 1..30: note = chr8:125576743-125576773
  misc_feature 1..30: note = hyper
  source 1..30: mol_type = genomic DNA
gcggcagttggggaccgacagtaaagctca

SEQ ID NO: 98618 - DNA, 51 bp, Homo sapiens
  misc_feature 1..51: note = chr8:125580647-125580698
  misc_feature 1..51: note = hypo
  source 1..51: mol_type = genomic DNA
gtacagaatcggccacgttcttcaatcaaagccttccggacagcctgcttt

SEQ ID NO: 98619 - DNA, 30 bp, Homo sapiens
  misc_feature 1..30: note = chr8:125618670-125618700
  misc_feature 1..30: note = hypo
  source 1..30: mol_type = genomic DNA
caagcccctgcaccccgccaaaagtaggta

SEQ ID NO: 98620 - DNA, 135 bp, Homo sapiens
  misc_feature 1..135: note = chr8:125672489-125672624
  misc_feature 1..135: note = hyper
  source 1..135: mol_type = genomic DNA
aaaagcacaaacacccgtttgagtgatctggaataggctgtgccacagaaacaggggcccttcgaaagaagcagcactttatccaaaagaaagtaaacaagggagggtgggggcaaggaacgaatggcactagtt

SEQ ID NO: 98621 - DNA, 229 bp, Homo sapiens
  misc_feature 1..229: note = chr8:125680483-125680712
  misc_feature 1..229: note = hypo
  source 1..229: mol_type = genomic DNA
gcacaatcagttccacgtgccctgtcttgttaggcatgttttgttcaggccctaaccctaccaatgtgtgttcatggagagtgatgctgtggacaggaggtgtcaccagatctgcttcatccaacagacagacaaagccaggtttccatacctcagctcacatctacggcaggaattcatcctgtcctagctccgtttgaaaacccgcctttctcgttcatgcccctac

SEQ ID NO: 98622 - DNA, 36 bp, Homo sapiens
  misc_feature 1..36: note = chr8:125682702-125682738
  misc_feature 1..36: note = hypo
  source 1..36: mol_type = genomic DNA
gttagggactcctgacgtcgtcgtacttgcaaagga

SEQ ID NO: 98623 - DNA, 24 bp, Homo sapiens
  misc_feature 1..24: note = chr8:125739302-125739326
  misc_feature 1..24: note = hyper
  source 1..24: mol_type = genomic DNA
cagggtgttgttccccgcccccac

SEQ ID NO: 98624 - DNA, 30 bp, Homo sapiens
  misc_feature 1..30: note = chr8:125740333-125740363
  misc_feature 1..30: note = hyper
  source 1..30: mol_type = genomic DNA
cggggtgcaccagaccgactgttctctgcc

SEQ ID NO: 98625 - DNA, 161 bp, Homo sapiens
  misc_feature 1..161: note = chr8:126044592-126044753
  misc_feature 1..161: note = hypo
  source 1..161: mol_type = genomic DNA
tggtggccaatcaaccgggtcggtcggttttcggcagaccattcctgcaagggaacaagttgcaacaccatatgaagtacttgccttcagcaacattcattaaataccaacgctgtgaaggtcaaaatgtttggggcccatattctcgctggcagatgata

SEQ ID NO: 98626 - DNA, 30 bp, Homo sapiens
  misc_feature 1..30: note = chr8:126079019-126079049
  misc_feature 1..30: note = hypo
  source 1..30: mol_type = genomic DNA
cctcctcaccaaagacgacttgatattctt

SEQ ID NO: 98627 - DNA, 30 bp, Homo sapiens
  misc_feature 1..30: note = chr8:126156768-126156798
  misc_feature 1..30: note = hypo
  source 1..30: mol_type = genomic DNA
gtgctacataaggaccgtattgctacaggc

SEQ ID NO: 98628 - DNA, 121 bp, Homo sapiens; identical to SEQ ID NO: 41932
  misc_feature 1..121: note = chr8:126267003-126267124
  misc_feature 1..121: note = hypo
  source 1..121: mol_type = genomic DNA

SEQ ID NO: 98629 - DNA, 61 bp, Homo sapiens
  misc_feature 1..61: note = chr8:126284144-126284205
  misc_feature 1..61: note = hypo
  source 1..61: mol_type = genomic DNA
tggggattattgctccgtttttcaggtgggaaaacccagagatattcggtgacttggccaa

SEQ ID NO: 98630 - DNA, 140 bp, Homo sapiens
  misc_feature 1..140: note = chr8:126400836-126400976
  misc_feature 1..140: note = hyper
  source 1..140: mol_type = genomic DNA
acagtctttcccaaacgaatagtggacagaacaaggctttgggggctggagtcccagactggagctccgcccgctcccctccccccaccccttccccgagccctgagaccgtgagactatgagaacgtaggattccatct

SEQ ID NO: 98631 - DNA, 149 bp, Homo sapiens; identical to SEQ ID NO: 41711
  misc_feature 1..149: note = chr8:12671777-12671926
  misc_feature 1..149: note = hypo
  source 1..149: mol_type = genomic DNA

SEQ ID NO: 98632 - DNA, 385 bp, Homo sapiens
  misc_feature 1..385: note = chr8:1269154-1269539
  misc_feature 1..385: note = hypo
  source 1..385: mol_type = genomic DNA
atccgtgtgcctctgcgtgtgtgtgggcatccgtgtgcctctgtgcccaggcatccatgtgtctctaagtgtgcacatgcatctgtgtgcctctgtgtgtgcgcatgcatccatgtgcctctgtgtgtgtgtgcatccatgtgtctctgcatgtgtgcatgcatccgtgcccgtatgtgtctgcgtccatgtgtctctacgtgtgcacgtgcatccatgtgcctctgcatgtgtgtgtgcatctgtgtctctgcatgtgcacgtgcatctgtgccatgtgcgtgtgcgtgcatctgtgtgtctctgtgtgcatctgtgtgtctctgcgtgtgcgtgtgtgtctgtgtgtctctgcatgtgcttatgcatccgtaccatgtgcgtg

SEQ ID NO: 98633 - DNA, 27 bp, Homo sapiens
  misc_feature 1..27: note = chr8:127089268-127089295
  misc_feature 1..27: note = hypo
  source 1..27: mol_type = genomic DNA
atcctgggcccggcacggtggctcaca

SEQ ID NO: 98634 - DNA, 99 bp, Homo sapiens
  misc_feature 1..99: note = chr8:127305215-127305314
  misc_feature 1..99: note = hypo
  source 1..99: mol_type = genomic DNA
gcctagccgaggagcaggtgtccctaagaacccaaatattccagctgcaaacgtatcaacaaaaacagtctcattgcacacatacggtaggcaaaatgc

SEQ ID NO: 98635 - DNA, 233 bp, Homo sapiens
  misc_feature 1..233: note = chr8:127518583-127518816
  misc_feature 1..233: note = hypo
  source 1..233: mol_type = genomic DNA
cttcttgtgcaggtccgccagtcaaatccagcagactgcaaaaatactagactttctccactgaagagtcaggtaatgccagaagagtattatggcacagcaatactcctcagagcaaacgttggcttttcagctaacttagaagttccctggaaaatgcttcttaagccttagagaagagagacagtctttttcatataacatagccaaaccaagggcgtgacactccgtca

SEQ ID NO: 98636 - DNA, 112 bp, Homo sapiens
  misc_feature 1..112: note = chr8:1276830-1276942
  misc_feature 1..112: note = hypo
  source 1..112: mol_type = genomic DNA
cttaaatttagtgatcgtcattattcattctttttaaaaactcgtagtaaagacagaacaacaaccacagcaaaatgaactaagcttcccataataacgggagacggcggaa

SEQ ID NO: 98637 - DNA, 30 bp, Homo sapiens
  misc_feature 1..30: note = chr8:12777147-12777177
  misc_feature 1..30: note = hypo
  source 1..30: mol_type = genomic DNA
cctcatgtccgtgtccgtcatgaaggatgc

SEQ ID NO: 98638 - DNA, 30 bp, Homo sapiens
  misc_feature 1..30: note = chr8:1279525-1279555
  misc_feature 1..30: note = hypo
  source 1..30: mol_type = genomic DNA
ggctagtgggcaggtcgctggcctttccta

SEQ ID NO: 98639 - DNA, 68 bp, Homo sapiens
  misc_feature 1..68: note = chr8:12808843-12808911
  misc_feature 1..68: note = hyper
  source 1..68: mol_type = genomic DNA
ttaagtgagaagagccgcgctaaagccaagcgtcgtcgtcacccaaggtactgcgctgatgcgctgcg

SEQ ID NO: 98640 - DNA, 152 bp, Homo sapiens
  misc_feature 1..152: note = chr8:12809647-12809799
  misc_feature 1..152: note = hyper
  source 1..152: mol_type = genomic DNA
agcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgca

SEQ ID NO: 98641 - DNA, 42 bp, Homo sapiens; identical to SEQ ID NO: 41671
  misc_feature 1..42: note = chr8:1281668-1281710
  misc_feature 1..42: note = hypo
  source 1..42: mol_type = genomic DNA

SEQ ID NO: 98642 - DNA, 30 bp, Homo sapiens
  misc_feature 1..30: note = chr8:12826740-12826770
  misc_feature 1..30: note = hypo
  source 1..30: mol_type = genomic DNA
tactgaaaggcccaccgtctcttcattaca

SEQ ID NO: 98643 - DNA, 86 bp, Homo sapiens; identical to SEQ ID NO: 41712
  misc_feature 1..86: note = chr8:12831656-12831742
  misc_feature 1..86: note = hypo
  source 1..86: mol_type = genomic DNA

SEQ ID NO: 98644 - DNA, 45 bp, Homo sapiens
  misc_feature 1..45: note = chr8:1284619-1284664
  misc_feature 1..45: note = hypo
  source 1..45: mol_type = genomic DNA
cctcgtctttacagacgtccgttatgaggacgttccagtgtgcca

SEQ ID NO: 98645 - DNA, 80 bp, Homo sapiens; identical to SEQ ID NO: 41935
  misc_feature 1..80: note = chr8:128745542-128745622
  misc_feature 1..80: note = hypo
  source 1..80: mol_type = genomic DNA

SEQ ID NO: 98646 - DNA, 29 bp, Homo sapiens
  misc_feature 1..29: note = chr8:12881832-12881861
  misc_feature 1..29: note = hypo
  source 1..29: mol_type = genomic DNA
tgagccaccgcgcccggcctgttcctttt

SEQ ID NO: 98647 - DNA, 41 bp, Homo sapiens
  misc_feature 1..41: note = chr8:128861840-128861881
  misc_feature 1..41: note = hypo
  source 1..41: mol_type = genomic DNA
aaaagagaaagactgcgtgcatgtgcatgggtgcacagcct

SEQ ID NO: 98648 - DNA, 39 bp, Homo sapiens; identical to SEQ ID NO: 41936
  misc_feature 1..39: note = chr8:128864120-128864159
  misc_feature 1..39: note = hypo
  source 1..39: mol_type = genomic DNA

SEQ ID NO: 98649 - DNA, 176 bp, Homo sapiens
  misc_feature 1..176: note = chr8:128872283-128872459
  misc_feature 1..176: note = hypo
  source 1..176: mol_type = genomic DNA
ggctgcggctgccagcggtgatgagaactgatgacactccagggctaccaggaacggtgtgtgtgcctctgggcagggccacttcctagaaccatggggctgctctgtgaagagaaccggctcccagtgagctccaggagacgaggagcaggtcctggtggcggaggtgctggcgc

SEQ ID NO: 98650 - DNA, 162 bp, Homo sapiens
  misc_feature 1..162: note = chr8:128882652-128882814
  misc_feature 1..162: note = hypo
  source 1..162: mol_type = genomic DNA
tccccagaactgtgagagagtgcatctgctgatgtaagccacccagtttgtagcaatttgttatggctgccctcagaaactaagacagtagccaacacagaaccaaataccctttggggattgagggaagtggagcgggagaatgagcggcactccctccct

SEQ ID NO: 98651 - DNA, 488 bp, Homo sapiens
  misc_feature 1..488: note = chr8:128888909-128889397
  misc_feature 1..488: note = hypo
  source 1..488: mol_type = genomic DNA
tgtcctctaagcaggcggaggagggaaccatgtcagctcctaggtgcccccagagcacctgctgccagttttccacaactcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcgagatgtgcctgcgtgacttgagtagagacctgcttctgagaaagtcagaagtgcattccaaagtcaggagcgtgacctccccggaagcccagctaatccaggttttaaagaggagttggaacaaaggtggtgcttatgggatgtatggagctgtgggatgtgggagaggacaggtttagcagagtggcgtggtggaaagtttcctctcgccgaggaggacaactccccagcgcctgagacagcgg

SEQ ID NO: 98652 - DNA, 30 bp, Homo sapiens; identical to SEQ ID NO: 41939
  misc_feature 1..30: note = chr8:128931231-128931261
  misc_feature 1..30: note = hypo
  source 1..30: mol_type = genomic DNA

SEQ ID NO: 98653 - DNA, 35 bp, Homo sapiens; identical to SEQ ID NO: 41940
  misc_feature 1..35: note = chr8:128962506-128962541
  misc_feature 1..35: note = hypo
  source 1..35: mol_type = genomic DNA

SEQ ID NO: 98654 - DNA, 30 bp, Homo sapiens
  misc_feature 1..30: note = chr8:1290508-1290538
  misc_feature 1..30: note = hypo
  source 1..30: mol_type = genomic DNA
gtcccacagatgatgcgtttaatttgtgat

SEQ ID NO: 98655 - DNA, 209 bp, Homo sapiens
  misc_feature 1..209: note = chr8:129069803-129070012
  misc_feature 1..209: note = hypo
  source 1..209: mol_type = genomic DNA
cctggcactggctgacgtgggaggtacagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtagaacgaggttcggatctcggcattaaatctcc

SEQ ID NO: 98656 - DNA, 91 bp, Homo sapiens
  misc_feature 1..91: note = chr8:129355798-129355889
  misc_feature 1..91: note = hypo
  source 1..91: mol_type = genomic DNA
aatgcctcagttgctcgtttgtaacacagaactaaaaaagccaacatttatagaagtattgtgagcatcaataataataagaatagttggg

SEQ ID NO: 98657 - DNA, 141 bp, Homo sapiens
  misc_feature 1..141: note = chr8:12949878-12950019
  misc_feature 1..141: note = hypo
  source 1..141: mol_type = genomic DNA
ggaaaaggatcagttcgatggattttgtctgtgggggttaagtccagtgagactattttctcatgcacgccaacagaccagtctcaggtatgtctttattagcggtgtgagaatggactaatatagcggtctaaccttctt

SEQ ID NO: 98658 - DNA, 108 bp, Homo sapiens; identical to SEQ ID NO: 41714
  misc_feature 1..108: note = chr8:12952416-12952524
  misc_feature 1..108: note = hypo
  source 1..108: mol_type = genomic DNA

SEQ ID NO: 98659 - DNA, 90 bp, Homo sapiens; identical to SEQ ID NO: 41715
  misc_feature 1..90: note = chr8:12956998-12957088
  misc_feature 1..90: note = hypo
  source 1..90: mol_type = genomic DNA

SEQ ID NO: 98660 - DNA, 66 bp, Homo sapiens
  misc_feature 1..66: note = chr8:12957529-12957595
  misc_feature 1..66: note = hypo
  source 1..66: mol_type = genomic DNA
cacccgcttgttgcacgcactgaggctccgggtcctcgtaacagggctgggcgtgctgaccgcgct

SEQ ID NO: 98661 - DNA, 330 bp, Homo sapiens
  misc_feature 1..330: note = chr8:12989381-12989711
  misc_feature 1..330: note = hyper
  source 1..330: mol_type = genomic DNA
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctccttgtccgggtcaagggggtgggcatccccaagggggcatttcagggacacgattcagcgacccatctccgggaaaaaaaccaa

SEQ ID NO: 98662 - DNA, 113 bp, Homo sapiens
  misc_feature 1..113: note = chr8:12990035-12990148
  misc_feature 1..113: note = hyper
  source 1..113: mol_type = genomic DNA
gacaggagatcagtacgagcgcagagcagtccccagaggaaaggaaggtagaaggcggtgtcgccgcgcccctcgagccagagccgcgagcccccgcccggctcaaggaggaa

SEQ ID NO: 98663 - DNA, 838 bp, Homo sapiens
  misc_feature 1..838: note = chr8:12990499-12991337
  misc_feature 1..838: note = hyper
  source 1..838: mol_type = genomic DNA
aggcggcggcggaagcgctgtggggaagtcgaggcaggcggaggcggctcggcttccgcgtcgggacccacggcggcacccgagacgcgcgccctcgcggtcctcaacgcatccttgctcgccgctccctgcccctcgtcacggccccagaaagaaagcggggttttctaaagatcgaaacgagggagcgctcagggagttgggcgagaagtccgtgagccggcgctcctgatgcggagaggtgcggccatgtcctggctgggagcgaagcgccctcgctcgggcagtcggagcgaactgtctcccgcgcgctccgccagccgggccctcccgctgggcccaccccccgaggggcggggccagagcgggcggcaccgcctcctccccgctgtctgggtcgcaggccttagcgacgggctgttctccggccccgccccattcccaggctccgccccccgcccctcttcctcgtggccgcagcctcaggccgccctctagccccgccccgcccaggccccgcctctcctctgtcccgccccctcggttccctcctcccccccgccccgccccgcgcctcctccgccgaaggctggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcggagaggaagggat

SEQ ID NO: 98664 - DNA, 88 bp, Homo sapiens
  misc_feature 1..88: note = chr8:13003417-13003505
  misc_feature 1..88: note = hypo
  source 1..88: mol_type = genomic DNA
tctagttcttcattgcgtggtgggttaatggtgttgtattattgtgcctcataatgtatatatcatagtctcttaaaatatactgtag

SEQ ID NO: 98665 - DNA, 30 bp, Homo sapiens; identical to SEQ ID NO: 41942
  misc_feature 1..30: note = chr8:130080387-130080417
  misc_feature 1..30: note = hypo
  source 1..30: mol_type = genomic DNA

SEQ ID NO: 98666 - DNA, 186 bp, Homo sapiens
  misc_feature 1..186: note = chr8:130116277-130116463
  misc_feature 1..186: note = hypo
  source 1..186: mol_type = genomic DNA
tgcggtcagtgcacacgagaggcactaaagtgaggtggcagcccaaactcggaagagtttgaccagcccaaaccctgagggaattactcatgcctcatctatggtgcctctgtgagatccatgaggcctgcggccacttttctctaacttttcattctgtcttcggtgcctcgcacatttcttggc

SEQ ID NO: 98667 - DNA, 162 bp, Homo sapiens
  misc_feature 1..162: note = chr8:1302664-1302826
  misc_feature 1..162: note = hypo
  source 1..162: mol_type = genomic DNA
cgagacactgtctcagaaaaaaagaaagaacgaaaagaaaataccttggaatgaaagactgtggggccattaagatgatgctgtgggtgaaggtggaaagtcacggatgatgctgcggatgaaggtggaaagtcacggatgatgctgcggatgaaggtggaa

SEQ ID NO: 98668 - DNA, 203 bp, Homo sapiens; identical to SEQ ID NO: 41944
  misc_feature 1..203: note = chr8:130288699-130288902
  misc_feature 1..203: note = hypo
  source 1..203: mol_type = genomic DNA

SEQ ID NO: 98669 - DNA, 30 bp, Homo sapiens
  misc_feature 1..30: note = chr8:130305961-130305991
  misc_feature 1..30: note = hypo
  source 1..30: mol_type = genomic DNA
ctggggtagggtggccgggagcagtggctc

SEQ ID NO: 98670 - DNA, 30 bp, Homo sapiens; identical to SEQ ID NO: 41673
  misc_feature 1..30: note = chr8:1303386-1303416
  misc_feature 1..30: note = hypo
  source 1..30: mol_type = genomic DNA

SEQ ID NO: 98671 - DNA, 209 bp, Homo sapiens; identical to SEQ ID NO: 41945
  misc_feature 1..209: note = chr8:130368840-130369049
  misc_feature 1..209: note = hypo
  source 1..209: mol_type = genomic DNA

SEQ ID NO: 98672 - DNA, 89 bp, Homo sapiens; identical to SEQ ID NO: 41946
  misc_feature 1..89: note = chr8:130369289-130369378
  misc_feature 1..89: note = hypo
  source 1..89: mol_type = genomic DNA

SEQ ID NO: 98673 - DNA, 30 bp, Homo sapiens
  misc_feature 1..30: note = chr8:130381962-130381992
  misc_feature 1..30: note = hypo
  source 1..30: mol_type = genomic DNA
gtgagccaccgcacccggccaacagagcct

SEQ ID NO: 98674 - DNA, 35 bp, Homo sapiens
  misc_feature 1..35: note = chr8:130461171-130461206
  misc_feature 1..35: note = hypo
  source 1..35: mol_type = genomic DNA
caggcgtgagccaccgcgcccggccaggaatctgt

SEQ ID NO: 98675 - DNA, 30 bp, Homo sapiens
  misc_feature 1..30: note = chr8:1305031-1305061
  misc_feature 1..30: note = hypo
  source 1..30: mol_type = genomic DNA
aatgaggaaacacctcgtcttcagggtgtg

SEQ ID NO: 98676 - DNA, 201 bp, Homo sapiens; identical to SEQ ID NO: 41948
  misc_feature 1..201: note = chr8:130583277-130583478
  misc_feature 1..201: note = hypo
  source 1..201: mol_type = genomic DNA

SEQ ID NO: 98677 - DNA, 75 bp, Homo sapiens
  misc_feature 1..75: note = chr8:1306799-1306874
  misc_feature 1..75: note = hypo
  source 1..75: mol_type = genomic DNA
gtgttgagggttggccgtggtgaagaaggcttctgatgggcaaagtgtctttaggagaaacgtgttatccccact

SEQ ID NO: 98678 - DNA, 142 bp, Homo sapiens
  misc_feature 1..142: note = chr8:1307773-1307915
  misc_feature 1..142: note = hypo
  source 1..142: mol_type = genomic DNA
agaggctgatgctgtcggcggctgtccctgtgggtgatgcggtggcgctggcagatagccatcccctcccaatcccacggtagacgctggcctcagctcttataaaacccgcgcgttccctgcgcagcgtgggactgtggat

SEQ ID NO: 98679 - DNA, 47 bp, Homo sapiens
  misc_feature 1..47: note = chr8:1308321-1308368
  misc_feature 1..47: note = hypo
  source 1..47: mol_type = genomic DNA
gtgcataagggttagcgactcctgctgcttcccgggtgtgctcaggg

SEQ ID NO: 98680 - DNA, 30 bp, Homo sapiens
  misc_feature 1..30: note = chr8:131046198-131046228
  misc_feature 1..30: note = hypo
  source 1..30: mol_type = genomic DNA
gagtctctgttctgccgtgaatgtctccag

SEQ ID NO: 98681 - DNA, 30 bp, Homo sapiens
  misc_feature 1..30: note = chr8:131278061-131278091
  misc_feature 1..30: note = hypo
  source 1..30: mol_type = genomic DNA
gaagagccaagactgcgccactgtactcaa

SEQ ID NO: 98682 - DNA, 568 bp, Homo sapiens
  misc_feature 1..568: note = chr8:13133827-13134395
  misc_feature 1..568: note = hyper
  source 1..568: mol_type = genomic DNA
agtccctgatgtgatcgctaaaggacctccggagaggggctcgcagggggcgcgccatcacgtgggccttggggtcccccatccgctcgcagacgccttcagcgcagcccgggcgccgcgaccatgcctcggtactccgccccgcgctgtgctcccggccgcaggctgtcgcctgccttcaggaggccggcattgcggctggcactgcggccccgggaagcgccaactgcaggcggcctcctggcccgcggccaagcgcgcgcggcggccacatctggaaagacttaccctgcgccggcgacaccctcgcggggcgcgcgagctgcagcacagctatccggaggcgtctcgcttcctgtgcaacccaatgactcacctgggtccgcgccgggctgctcctgggtcacatagcaggtcttcccttcaggggcagtccaggtgacctcgcgttttcaaagggaaacgcagcgccgcaggcaagcacgcaggggaggtgggagggtggggctggcaggtggccttgtctttaactttcaaggttgattctcaagaacgtttgcattttagt

SEQ ID NO: 98683 - DNA, 1028 bp, Homo sapiens
  misc_feature 1..1028: note = chr8:131455184-131456212
  misc_feature 1..1028: note = hyper
  source 1..1028: mol_type = genomic DNA
cacccccttccctttcgtttctcttcttttgctttaggcaagtggcctggggcctgccaagcagcgccgggtccgggtaggggccgggggccgcggggaactttcctcggctgcaccagagacaatgccgggagggcgccccatcggcggggtccgggccgccaagcacgtcgtcccgggccctcccccggagggggacgcgaaaccccccagggcgggccccgtccccggccccactgcaggggccccctctcccgagctggaggcgaggagacctcccccccccaccgggcggcctcgcccggccccgcagagcctggccgcgcgtcccgcacacgccccagcccagggccggcgccctccccgcggagaaggacaccccgctgcgagaggagccgggagcccgccccgcgccccgtcccggcgcccttcttcgcgcgagagactgggcagggggcgcccgcgactgtgggcgactccgcccggccccgccgagcgcgcccgagcgccccgcaactcaccgggacctggcgggccgctgggcattattccatcgcgggttcggccgggcgctcgcggctctcgggtgggaaagcgaactgcgaccgggaagcgccggctgggcgggaggcgcgggcccggggctgcccagcgcacagtgctcgcccgcggcagcggccaggccaggcgaggcgcgggagccgagcgcggcgcaggaaggggcgggcgaccatgtgccgagggggaggaggccgcggcgacgcgagcggctcgcacgatcccgctcggcggcggagggcgcgggtttcaggaaatccaaacacttcgacaggaaatcggaatcctgactaagcattcccggccccgagccgctccgcgccgggggctcccgcctcgcttaacccttggcccgccggcagccacgaggggggcgtgggaggggccccagacctcggccggggtcgggcgtccttcgccttccgccccatgccccggccggccggcctcctccccgcctgaggtggaag

SEQ ID NO: 98684 - DNA, 18 bp, Homo sapiens
  misc_feature 1..18: note = chr8:131922190-131922208
  misc_feature 1..18: note = hypo
  source 1..18: mol_type = genomic DNA
tttttttttttgagacgg

SEQ ID NO: 98685 - DNA, 397 bp, Homo sapiens
  misc_feature 1..397: note = chr8:132051903-132052300
  misc_feature 1..397: note = hyper
  source 1..397: mol_type = genomic DNA
tcactacctcaatgccggtgaagaagcccagcaggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 98686 - DNA, 118 bp, Homo sapiens; identical to SEQ ID NO: 3368
  misc_feature 1..118: note = chr8:132052398-132052516
  misc_feature 1..118: note = hyper
  source 1..118: mol_type = genomic DNA

SEQ ID NO: 98687 - DNA, 1995 bp, Homo sapiens
  misc_feature 1..1995: note = chr8:132052589-132054584
  misc_feature 1..1995: note = hyper
  source 1..1995: mol_type = genomic DNA
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcgcgtcgggcgggtcctggctgctgcactgggctttggacgcccactgctccgcggctgcagggggcctggccggcggtgaccggcggcagcgatgggtgcgaagttagcagatgtggctggaatcatcgcccttcggagaactccattgcgccgggatggggagcaggggcggagctgggggcgggggcaaagaaggaggaggagggggtcacggtgaggtggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggatcaggagaggcgggggaaggaaaaagtggtgagggctccaaagccaagagctccgagaacgaagagaagccgccggtgcggatatctgaggctgagaaccgaagcttggcggatgaggcgaaggtttggaggagaagggaggcccgaggccgcgtggaagtcgacagagacgcctctggatctagggaagcgccgccgcgtgccaccctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 98688 - DNA, 205 bp, Homo sapiens; identical to SEQ ID NO: 32274
  misc_feature 1..205: note = chr8:132054593-132054798
  misc_feature 1..205: note = hyper
  source 1..205: mol_type = genomic DNA

SEQ ID NO: 98689 - DNA, 30 bp, Homo sapiens; identical to SEQ ID NO: 41950
  misc_feature 1..30: note = chr8:132284091-132284121
  misc_feature 1..30: note = hypo
  source 1..30: mol_type = genomic DNA

SEQ ID NO: 98690 - DNA, 192 bp, Homo sapiens
  misc_feature 1..192: note = chr8:132480519-132480711
  misc_feature 1..192: note = hypo
  source 1..192: mol_type = genomic DNA
caaatcactccaaaacgtagtggctaaaaataccgatatattattatctgtcatattctgtggattgtctggaatacgatggatggctcttgcttctagtcttttgttttgctgtgacaagtggtagcttcagcttatctgtaaaataatgccaagtacctatgtcataggttgttgcgaagcttcatgagt

SEQ ID NO: 98691 - DNA, 30 bp, Homo sapiens
  misc_feature 1..30: note = chr8:1326091-1326121
  misc_feature 1..30: note = hypo
  source 1..30: mol_type = genomic DNA
agctgatggagttcacgcacccctgtgcag

SEQ ID NO: 98692 - DNA, 52 bp, Homo sapiens
  misc_feature 1..52: note = chr8:1326776-1326828
  misc_feature 1..52: note = hypo
  source 1..52: mol_type = genomic DNA
cacctgtctgtcctgcgcacacctggcctcatctgtccgtcctgcacacatg

SEQ ID NO: 98693 - DNA, 30 bp, Homo sapiens
  misc_feature 1..30: note = chr8:1327435-1327465
  misc_feature 1..30: note = hypo
  source 1..30: mol_type = genomic DNA
cgagggccacatcttcgctaagtcaccagc

SEQ ID NO: 98694 - DNA, 30 bp, Homo sapiens; identical to SEQ ID NO: 41951
  misc_feature 1..30: note = chr8:132783128-132783158
  misc_feature 1..30: note = hypo
  source 1..30: mol_type = genomic DNA

SEQ ID NO: 98695 - DNA, 212 bp, Homo sapiens
  misc_feature 1..212: note = chr8:132823274-132823486
  misc_feature 1..212: note = hypo
  source 1..212: mol_type = genomic DNA
tctagggcaataccacgggacatttgttccactccagtttcacatttctacaaggaagcatccgactggctcagctttgattactgtatgcaatagactgaatgtttatgtccccaccccaaattcatctgctgaaatcgaatccccattgtaatggtatttggacacagggcctttgggaggtgactgggtcatgacggtagagtcctcat

SEQ ID NO: 98696 - DNA, 50 bp, Homo sapiens
  misc_feature 1..50: note = chr8:133062815-133062865
  misc_feature 1..50: note = hypo
  source 1..50: mol_type = genomic DNA
cactttcctacatgccggctgtgagacttcgggcacgtgttctttcctcg

SEQ ID NO: 98697 - DNA, 24 bp, Homo sapiens
  misc_feature 1..24: note = chr8:13319913-13319937
  misc_feature 1..24: note = hypo
  source 1..24: mol_type = genomic DNA
tttttttttttgagacggagtctg

SEQ ID NO: 98698 - DNA, 16 bp, Homo sapiens
  misc_feature 1..16: note = chr8:13320204-13320220
  misc_feature 1..16: note = hypo
  source 1..16: mol_type = genomic DNA
gcgcccggcctactat

SEQ ID NO: 98699 - DNA, 199 bp, Homo sapiens
  misc_feature 1..199: note = chr8:133337370-133337569
  misc_feature 1..199: note = hypo
  source 1..199: mol_type = genomic DNA
ataggctggctttctcgagccttgtcctggggtcctggcggtgtggatggggaaagacagttagtcagtcaataaaaggaaagaaaaccacctaatcatgagagctgcagatggacttcataaaatgttggactcacgggatgcaggagagagaagtgtgttgggggtcaagagagctgggttccgtccagggtctaat

SEQ ID NO: 98700 - DNA, 30 bp, Homo sapiens
  misc_feature 1..30: note = chr8:133412585-133412615
  misc_feature 1..30: note = hypo
  source 1..30: mol_type = genomic DNA
gtggaaccccagggccggcttttcacacat

SEQ ID NO: 98701 - DNA, 371 bp, Homo sapiens
  misc_feature 1..371: note = chr8:133492260-133492631
  misc_feature 1..371: note = hyper
  source 1..371: mol_type = genomic DNA
gacgggctggtctccccttcagcgggaaagcatccatgggtcttaaagccccagagacttctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctcca

SEQ ID NO: 98702 - DNA, 473 bp, Homo sapiens
  misc_feature 1..473: note = chr8:133492712-133493185
  misc_feature 1..473: note = hyper
  source 1..473: mol_type = genomic DNA
cgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgccatgatccgcgcgcccctccccacccccccccaaaagcaggcaaaggcgggccccctggggggcaggggaggccaggcagggggtcagggggtcacatcccgcgcgggtcagccgcaggaccccgagggtcgcgggccgggggctgcggagaagctgggagggcgcgcgaggctggcgcggaggcgctagggcgcgcggcggcgggagcctggaaccggcgctccggggcggcggcggcggcggcggcacccaggccggcgagcccaagacagcatcgcagtttatttaca

SEQ ID NO: 98703 - DNA, 257 bp, Homo sapiens
  misc_feature 1..257: note = chr8:133493495-133493752
  misc_feature 1..257: note = hyper
  source 1..257: mol_type = genomic DNA
tgcaaccaggcagtgcgccaggcggctgcagagcccggctcctggagctcccgtgggcgttggggcttcccctggatggggcgtgacggcgggcagttgggggaagaagaggaagggaggagggactggggggttgtcgcccaccaaacattggctctgtggttgcagctttgtgaatttccctcaccccctacccctgctcctcggcttcagaggtaaaagccaagttgtcgggttggtcaaggccgggcgcaccg

SEQ ID NO: 98704 - DNA, 92 bp, Homo sapiens
  misc_feature 1..92: note = chr8:133686745-133686837
  misc_feature 1..92: note = hypo
  source 1..92: mol_type = genomic DNA
tggggagctcaaaaacgttgtcgatatcaaaatggttcatacaatataaataacttacccgcatcaccttgcagtttgttagtatattctta

SEQ ID NO: 98705 - DNA, 31 bp, Homo sapiens
  misc_feature 1..31: note = chr8:133687137-133687168
  misc_feature 1..31: note = hypo
  source 1..31: mol_type = genomic DNA
caaacaaacaaaaacacgtttataacactta

SEQ ID NO: 98706 - DNA, 30 bp, Homo sapiens
  misc_feature 1..30: note = chr8:133728335-133728365
  misc_feature 1..30: note = hypo
  source 1..30: mol_type = genomic DNA
aggtgcagctgcagccgctcagccatggct

SEQ ID NO: 98707 - DNA, 132 bp, Homo sapiens; identical to SEQ ID NO: 15163
  misc_feature 1..132: note = chr8:133811037-133811169
  misc_feature 1..132: note = hypo
  source 1..132: mol_type = genomic DNA

SEQ ID NO: 98708 - DNA, 30 bp, Homo sapiens; identical to SEQ ID NO: 41675
  misc_feature 1..30: note = chr8:1340176-1340206
  misc_feature 1..30: note = hypo
  source 1..30: mol_type = genomic DNA

SEQ ID NO: 98709 - DNA, 30 bp, Homo sapiens
  misc_feature 1..30: note = chr8:134018690-134018720
  misc_feature 1..30: note = hypo
  source 1..30: mol_type = genomic DNA
gagaactacgatggacgggtaagaatcatc

SEQ ID NO: 98710 - DNA, 30 bp, Homo sapiens
  misc_feature 1..30: note = chr8:134215121-134215151
  misc_feature 1..30: note = hypo
  source 1..30: mol_type = genomic DNA
cagaggcacccgatgcgctttgaaacaagc

SEQ ID NO: 98711 - DNA, 85 bp, Homo sapiens; identical to SEQ ID NO: 31798
  misc_feature 1..85: note = chr8:13424168-13424253
  misc_feature 1..85: note = hyper
  source 1..85: mol_type = genomic DNA

SEQ ID NO: 98712 - DNA, 52 bp, Homo sapiens
  misc_feature 1..52: note = chr8:13424344-13424396
  misc_feature 1..52: note = hyper
  source 1..52: mol_type = genomic DNA
cgttgccaagacagctgggaaggcgtctcccggaagacgacctccgcagagc

SEQ ID NO: 98713 - DNA, 30 bp, Homo sapiens
  misc_feature 1..30: note = chr8:134262730-134262760
  misc_feature 1..30: note = hypo
  source 1..30: mol_type = genomic DNA
ttcacaatgtgctggcggtaggtgtggacc

SEQ ID NO: 98714 - DNA, 179 bp, Homo sapiens; identical to SEQ ID NO: 41955
  misc_feature 1..179: note = chr8:134470121-134470300
  misc_feature 1..179: note = hypo
  source 1..179: mol_type = genomic DNA

SEQ ID NO: 98715 - DNA, 110 bp, Homo sapiens
  misc_feature 1..110: note = chr8:134471909-134472019
  misc_feature 1..110: note = hypo
  source 1..110: mol_type = genomic DNA
tgcccctccaagctccgggatggaacggctccagcaagatgctggggctggaaatgcagaggtgtgacagtgcgtccatcctcagcccttcactgcgtcatctccccttg

SEQ ID NO: 98716 - DNA, 67 bp, Homo sapiens
  misc_feature 1..67: note = chr8:134519862-134519929
  misc_feature 1..67: note = hypo
  source 1..67: mol_type = genomic DNA
atgaagaaaagaagacgtattgtttctttcttctccaggccagcccaaaggacgagcaggaaacctg

SEQ ID NO: 98717 - DNA, 59 bp, Homo sapiens
  misc_feature 1..59: note = chr8:134521601-134521660
  misc_feature 1..59: note = hypo
  source 1..59: mol_type = genomic DNA
ctagggccagacagacgtgggttccacccttgtgtttcacttgacgggagactctgagt

SEQ ID NO: 98718 - DNA, 30 bp, Homo sapiens
  misc_feature 1..30: note = chr8:134525332-134525362
  misc_feature 1..30: note = hypo
  source 1..30: mol_type = genomic DNA
tgtcctcagagaacacggtcatcaatgtca

SEQ ID NO: 98719 - DNA, 63 bp, Homo sapiens
  misc_feature 1..63: note = chr8:134541589-134541652
  misc_feature 1..63: note = hypo
  source 1..63: mol_type = genomic DNA
tgggagcttataggtcgaaggtgctgctaccgagcaaatgtacaaggtcgtaaaactcaggac

SEQ ID NO: 98720 - DNA, 250 bp, Homo sapiens
  misc_feature 1..250: note = chr8:134545088-134545338
  misc_feature 1..250: note = hypo
  source 1..250: mol_type = genomic DNA
catgctcctccccagcgtggagggggtgatagtttggggacgagaagcatagctttggagggctaacttctgcttcactccttctctcactctttcccatattcattcgttgaaaccactaaggtactaattaagtgccgggctggagctgaaggagtaggtataaattaattagtctttcttgactacgtttccttcagaggaattactcaggggccatggttctctgaatttccgctggatgctggaa

SEQ ID NO: 98721 - DNA, 30 bp, Homo sapiens
  misc_feature 1..30: note = chr8:134566350-134566380
  misc_feature 1..30: note = hypo
  source 1..30: mol_type = genomic DNA
tttagggaataggaccgctcctcattgttg

SEQ ID NO: 98722 - DNA, 30 bp, Homo sapiens
  misc_feature 1..30: note = chr8:134566647-134566677
  misc_feature 1..30: note = hypo
  source 1..30: mol_type = genomic DNA
ccaaaatcctacactcgacagtgggatgta

SEQ ID NO: 98723 - DNA, 50 bp, Homo sapiens
  misc_feature 1..50: note = chr8:134581243-134581293
  misc_feature 1..50: note = hyper
  source 1..50: mol_type = genomic DNA
tcagaaggcagtttccgcctgctgctgcagagcttcgaggaacagactcc

SEQ ID NO: 98724 - DNA, 120 bp, Homo sapiens
  misc_feature 1..120: note = chr8:134583173-134583293
  misc_feature 1..120: note = hyper
  source 1..120: mol_type = genomic DNA
gcggattcagagtttcgagttgccactaacacgactccggccgtgctctccttggcccacccgcgtcccccactgtccgccacgccgcgttcagctctcttgtcccgggtgtcaacttca

SEQ ID NO: 98725 - DNA, 66 bp, Homo sapiens
  misc_feature 1..66: note = chr8:134585014-134585080
  misc_feature 1..66: note = hyper
  source 1..66: mol_type = genomic DNA
acagggaagcgggggcggtggagacttcttttgctgaaaggcagagtgcagcgctttgatgctaaa

SEQ ID NO: 98726 - DNA, 21 bp, Homo sapiens
  misc_feature 1..21: note = chr8:134724787-134724808
  misc_feature 1..21: note = hypo
  source 1..21: mol_type = genomic DNA
ccaccgcgcccgtcctctgaa

SEQ ID NO: 98727 - DNA, 34 bp, Homo sapiens; identical to SEQ ID NO: 41957
  misc_feature 1..34: note = chr8:135301251-135301285
  misc_feature 1..34: note = hypo
  source 1..34: mol_type = genomic DNA

SEQ ID NO: 98728 - DNA, 30 bp, Homo sapiens
  misc_feature 1..30: note = chr8:135319421-135319451
  misc_feature 1..30: note = hypo
  source 1..30: mol_type = genomic DNA
gcctgagtttttaaacggggaagacgaggc

SEQ ID NO: 98729 - DNA, 23 bp, Homo sapiens
  misc_feature 1..23: note = chr8:135477507-135477530
  misc_feature 1..23: note = hypo
  source 1..23: mol_type = genomic DNA
ggagtactcgccctgcagtactt

SEQ ID NO: 98730 - DNA, 128 bp, Homo sapiens
  misc_feature 1..128: note = chr8:135732756-135732884
  misc_feature 1..128: note = hyper
  source 1..128: mol_type = genomic DNA
aaagagaaacttggccgagatctgaagtgtgatgagaatttggaacacggaagacaagccaggaggcccttctgaaagtaggaagccacagaagcaaacggtgccaaggaggacgatccagggcgggc

SEQ ID NO: 98731 - DNA, 18 bp, Homo sapiens
  misc_feature 1..18: note = chr8:135950097-135950115
  misc_feature 1..18: note = hypo
  source 1..18: mol_type = genomic DNA
aaccgaaaaaacaaataa

SEQ ID NO: 98732 - DNA, 89 bp, Homo sapiens
  misc_feature 1..89: note = chr8:1362767-1362856
  misc_feature 1..89: note = hypo
  source 1..89: mol_type = genomic DNA
ctgagcggagctgcccggcagctgtctctgaggatcccgccatctacgcacgtccaggcgtcctctgccctcagcgtgtcttgccttta

SEQ ID NO: 98733 - DNA, 230 bp, Homo sapiens
  misc_feature 1..230: note = chr8:136469072-136469302
  misc_feature 1..230: note = hyper
  source 1..230: mol_type = genomic DNA
acgcccagaagggcacgcgcttttatgtaaccgacctctgagctggcggatctcaggaggttggcgctctgagctcaggcgcggagaaaggacggcgcccctgccttactctcttataagtacgaggggacagcaacgcgacataacttagagaagtccaggaagctttagagagcagggcggtcccgctgctattcctcagagcgcgactggggcgaactggggcgccc

SEQ ID NO: 98734 - DNA, 158 bp, Homo sapiens
  misc_feature 1..158: note = chr8:136470155-136470313
  misc_feature 1..158: note = hyper
  source 1..158: mol_type = genomic DNA
tggacccctccttcacgcacgccctgcgcctggtgaaccaaggtgaggcgccggccgttaactgccggccggcggcggttgggggccgggtggaaacgcgggggcccagggggcccctccgtgccctctgctgtcagcggacgcggcggagacggagg

SEQ ID NO: 98735 - DNA, 30 bp, Homo sapiens; identical to SEQ ID NO: 41718
  misc_feature 1..30: note = chr8:13654931-13654961
  misc_feature 1..30: note = hypo
  source 1..30: mol_type = genomic DNA

SEQ ID NO: 98736 - DNA, 19 bp, Homo sapiens
  misc_feature 1..19: note = chr8:136858149-136858168
  misc_feature 1..19: note = hypo
  source 1..19: mol_type = genomic DNA
gatggctgggagtggcggc

SEQ ID NO: 98737 - DNA, 23 bp, Homo sapiens
  misc_feature 1..23: note = chr8:136865750-136865773
  misc_feature 1..23: note = hypo
  source 1..23: mol_type = genomic DNA
ttcctattcggccatctataatt

SEQ ID NO: 98738 - DNA, 30 bp, Homo sapiens
  misc_feature 1..30: note = chr8:137746178-137746208
  misc_feature 1..30: note = hypo
  source 1..30: mol_type = genomic DNA
gtacatgcatatgcacgcacgcacattgaa

SEQ ID NO: 98739 - DNA, 160 bp, Homo sapiens
  misc_feature 1..160: note = chr8:1380012-1380172
  misc_feature 1..160: note = hypo
  source 1..160: mol_type = genomic DNA
ccctgagaaccctgccggcacccagcaccccatgccagccagcaccgctacggctgccatccatcagggctgaaccctgccggcacccagcaccccatgccagccagcaccgctacggctgccatccatcggggctgaatcctgccggcacccagcaccc

SEQ ID NO: 98740 - DNA, 27 bp, Homo sapiens
  misc_feature 1..27: note = chr8:138625594-138625621
  misc_feature 1..27: note = hypo
  source 1..27: mol_type = genomic DNA
tctttaaaactgatacgtggggctggg

SEQ ID NO: 98741 - DNA, 18 bp, Homo sapiens
  misc_feature 1..18: note = chr8:138909127-138909145
  misc_feature 1..18: note = hypo
  source 1..18: mol_type = genomic DNA
ctacaaggactcattcgt

SEQ ID NO: 98742 - DNA, 154 bp, Homo sapiens; identical to SEQ ID NO: 41958
  misc_feature 1..154: note = chr8:138910227-138910381
  misc_feature 1..154: note = hypo
  source 1..154: mol_type = genomic DNA

SEQ ID NO: 98743 - DNA, 99 bp, Homo sapiens
  misc_feature 1..99: note = chr8:139046831-139046930
  misc_feature 1..99: note = hypo
  source 1..99: mol_type = genomic DNA
tgttcatttccctgccgtatgggaaggctattacaggctcttctgtgaggcatttgaaacctcttcaatagtctttctgaaagttccaaaatttgtccc

SEQ ID NO: 98744 - DNA, 30 bp, Homo sapiens
  misc_feature 1..30: note = chr8:139155605-139155635
  misc_feature 1..30: note = hypo
  source 1..30: mol_type = genomic DNA
ccgactgccacaccacgtgcctggcgtgtc

SEQ ID NO: 98745 - DNA, 190 bp, Homo sapiens; identical to SEQ ID NO: 9765
  misc_feature 1..190: note = chr8:139508757-139508947
  misc_feature 1..190: note = hyper
  source 1..190: mol_type = genomic DNA

SEQ ID NO: 98746 - DNA, 20 bp, Homo sapiens
  misc_feature 1..20: note = chr8:139509651-139509671
  misc_feature 1..20: note = hyper
  source 1..20: mol_type = genomic DNA
ccctcccagactgaccggcg

SEQ ID NO: 98747 - DNA, 242 bp, Homo sapiens
  misc_feature 1..242: note = chr8:139509693-139509935
  misc_feature 1..242: note = hyper
  source 1..242: mol_type = genomic DNA
cggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccgatgggctcctcac

SEQ ID NO: 98748 - DNA, 220 bp, Homo sapiens
  misc_feature 1..220: note = chr8:139667039-139667259
  misc_feature 1..220: note = hypo
  source 1..220: mol_type = genomic DNA
gtgccctatcttggccgagttatgttcaacctctcaggaccttttcctctcgtgggaaaagcaaatgtggttctagaaaccagtcaagtctgcactcacatctgagtttgtcctggataaaaggcccaacagcccacatcacctcactgaacctgcgctctggtcctggcccagcaggacccaggtccaggctgtttgactctgccgctggccctccttt

SEQ ID NO: 98749 - DNA, 30 bp, Homo sapiens
  misc_feature 1..30: note = chr8:139894041-139894071
  misc_feature 1..30: note = hypo
  source 1..30: mol_type = genomic DNA
cacctgtctgtgtatcggggaccccagtgt

SEQ ID NO: 98750 - DNA, 37 bp, Homo sapiens
  misc_feature 1..37: note = chr8:139908925-139908962
  misc_feature 1..37: note = hypo
  source 1..37: mol_type = genomic DNA
ccattcaaggccagacgcggtggcttatgcttgtaat

SEQ ID NO: 98751 - DNA, 40 bp, Homo sapiens
  misc_feature 1..40: note = chr8:139926210-139926250
  misc_feature 1..40: note = hyper
  source 1..40: mol_type = genomic DNA
gaaacgccgcagcctcggccagccccgccactgcccagga

SEQ ID NO: 98752 - DNA, 275 bp, Homo sapiens
  misc_feature 1..275: note = chr8:139926455-139926730
  misc_feature 1..275: note = hyper
  source 1..275: mol_type = genomic DNA
gaaaacgagagaggccgacgaggccccggacagtggcgaggggctgcggggaaaggtgggcagggacctcgggagggctgtgggggactggacagcgttagggtccaggcagtaacgaggtggccctgggaagcccaaaagaggggctgacaactttctgtccaattatagacttcactgatactctgctcccttttccagcgggtctgaaatagaccaccgactagtgccgcagctgcccgaaactttgggaagtttggcgccaccagggggcc

SEQ ID NO: 98753 - DNA, 30 bp, Homo sapiens
  misc_feature 1..30: note = chr8:1400681-1400711
  misc_feature 1..30: note = hypo
  source 1..30: mol_type = genomic DNA
ttgtgggacactgggcgctccggggagagc

SEQ ID NO: 98754 - DNA, 207 bp, Homo sapiens
  misc_feature 1..207: note = chr8:140417247-140417454
  misc_feature 1..207: note = hypo
  source 1..207: mol_type = genomic DNA
aagagggcagaaggccggcgctcactgactacttgctctgtgggtggcacagtgctaagcttttaaacatatatgattagcaagatttatcttattcaaactttacaacagtcttctgaggtaaatcttaaggaatcccgatattcagatgagaagcaagcattggtggttaagtgactttcctggagtcaccgggccatagtggaa

SEQ ID NO: 98755 - DNA, 30 bp, Homo sapiens
  misc_feature 1..30: note = chr8:140616896-140616926
  misc_feature 1..30: note = hypo
  source 1..30: mol_type = genomic DNA
gaacacggaacaccccggagtaagtttttc

SEQ ID NO: 98756 - DNA, 114 bp, Homo sapiens
  misc_feature 1..114: note = chr8:140630523-140630637
  misc_feature 1..114: note = hypo
  source 1..114: mol_type = genomic DNA
tcagcctctggtggtcggtaaagctgtgtaacccaggagagatggagctaataggcgatgggaagaggctgttttttaatgtgcttggtgagatctcctcgatcttgtaagaga

SEQ ID NO: 98757 - DNA, 30 bp, Homo sapiens; identical to SEQ ID NO: 41959
  misc_feature 1..30: note = chr8:140630956-140630986
  misc_feature 1..30: note = hypo
  source 1..30: mol_type = genomic DNA

SEQ ID NO: 98758 - DNA, 106 bp, Homo sapiens
  misc_feature 1..106: note = chr8:140643342-140643448
  misc_feature 1..106: note = hyper
  source 1..106: mol_type = genomic DNA
gccgcccacgttttccggtgactgcgtccagaacgcaggaatcatctgggaaaagtcgctaatctttctttctcatagatgagatgtcatgcgatgaatgttttct

SEQ ID NO: 98759 - DNA, 30 bp, Homo sapiens
  misc_feature 1..30: note = chr8:140657025-140657055
  misc_feature 1..30: note = hypo
  source 1..30: mol_type = genomic DNA
cactcaggcactgaccgggcttcagggcca

SEQ ID NO: 98760 - DNA, 37 bp, Homo sapiens; identical to SEQ ID NO: 41960
  misc_feature 1..37: note = chr8:140691457-140691494
  misc_feature 1..37: note = hypo
  source 1..37: mol_type = genomic DNA

SEQ ID NO: 98761 - DNA, 651 bp, Homo sapiens
  misc_feature 1..651: note = chr8:140714444-140715095
  misc_feature 1..651: note = hyper
  source 1..651: mol_type = genomic DNA
ggggcccaggggctacggagggtcagtgcctctcacgccccaggcgcactcccctgccacctgagtccctctaggagccatgggtgccaggccagccctctccaactcccagagaggtagtaagtgtaaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatc

SEQ ID NO: 98762 - DNA, 369 bp, Homo sapiens; identical to SEQ ID NO: 9768
  misc_feature 1..369: note = chr8:140715219-140715588
  misc_feature 1..369: note = hyper
  source 1..369: mol_type = genomic DNA

SEQ ID NO: 98763 - DNA, 323 bp, Homo sapiens; identical to SEQ ID NO: 32285
  misc_feature 1..323: note = chr8:140715699-140716022
  misc_feature 1..323: note = hyper
  source 1..323: mol_type = genomic DNA

SEQ ID NO: 98764 - skipped

SEQ ID NO: 98765 - DNA, 44 bp, Homo sapiens
  misc_feature 1..44: note = chr8:140716408-140716452
  misc_feature 1..44: note = hyper
  source 1..44: mol_type = genomic DNA
ccggcgggagggcctcggggagcgggggccgggctacgccgagg

SEQ ID NO: 98766 - DNA, 511 bp, Homo sapiens
  misc_feature 1..511: note = chr8:140716655-140717166
  misc_feature 1..511: note = hyper
  source 1..511: mol_type = genomic DNA
ggatgggaggataaacgcggcttcttgggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaat

SEQ ID NO: 98767 - DNA, 150 bp, Homo sapiens
  misc_feature 1..150: note = chr8:140717226-140717376
  misc_feature 1..150: note = hyper
  source 1..150: mol_type = genomic DNA
atatatatataatcactctttgatatatataatcactctttggttccccacagctgggcgcaaggtgcgccgtggatgcagccctgagccacgcgatagccccctcgagaccacctggggtaggaacacgaggctcgggctggggcgcac

SEQ ID NO: 98768 - DNA, 196 bp, Homo sapiens
  misc_feature 1..196: note = chr8:140717664-140717860
  misc_feature 1..196: note = hyper
  source 1..196: mol_type = genomic DNA
atcagacctaaccctcgggcagctcgcgggctccaggagaccagtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagg

SEQ ID NO: 98769 - DNA, 34 bp, Homo sapiens
  misc_feature 1..34: note = chr8:140751338-140751372
  misc_feature 1..34: note = hypo
  source 1..34: mol_type = genomic DNA
gcaaccctgacatctcgaccgggcaccacggggt

SEQ ID NO: 98770 - DNA, 37 bp, Homo sapiens
  misc_feature 1..37: note = chr8:140788728-140788765
  misc_feature 1..37: note = hypo
  source 1..37: mol_type = genomic DNA
gcatctcaacccattcggcaaacgggagcttcatcgc

SEQ ID NO: 98771 - DNA, 186 bp, Homo sapiens
  misc_feature 1..186: note = chr8:140818684-140818870
  misc_feature 1..186: note = hypo
  source 1..186: mol_type = genomic DNA
ccactcggggctcagcggcagtgacaccaaggacccgtgaaaacaatatgtagcagcagcaacaggattaagagtggagcagaagtagcctcaggtcccagagcagctccccaagggtgtacctgaaccgggaggcatccaggtgtgacctcagctgggtccggcagtagccgagcctcctgaacc

SEQ ID NO: 98772 - DNA, 281 bp, Homo sapiens
  misc_feature 1..281: note = chr8:140834115-140834396
  misc_feature 1..281: note = hypo
  source 1..281: mol_type = genomic DNA
tctccccatggagctcgacggagagaaaatgaatcgtagtgccatgctcggctattggctgggcctaaattgttccttactctgagaattcgttaagtggctgagcaataaagaagagagatttgagagttctttctcggcacaatggctttgacccctgccctttcagtcgtgatggctttattagggaccgtggggtgctgcaaacagccttgaggctctgggcagaccagttcatccagctcaattaaaaacccattacctggcgctgagctgggcca

SEQ ID NO: 98773 - DNA, 140 bp, Homo sapiens
  misc_feature 1..140: note = chr8:140834841-140834981
  misc_feature 1..140: note = hypo
  source 1..140: mol_type = genomic DNA
ctgagagccaagagccgtaggatggcgggggggggctgccttgcctccatgggaaggacagcagaggggctgccatctgccagaggcctgctgagtgcatgcgtcctctcagacacgctgcctgccgctgacacatggag

SEQ ID NO: 98774 - DNA, 30 bp, Homo sapiens
  misc_feature 1..30: note = chr8:140869275-140869305
  misc_feature 1..30: note = hypo
  source 1..30: mol_type = genomic DNA
ccctgggaatctgggcggggggagctggtt

SEQ ID NO: 98775 - DNA, 30 bp, Homo sapiens
  misc_feature 1..30: note = chr8:140869920-140869950
  misc_feature 1..30: note = hypo
  source 1..30: mol_type = genomic DNA
tcctccctgcctgggcggcccgctgcttgt

SEQ ID NO: 98776 - DNA, 315 bp, Homo sapiens
  misc_feature 1..315: note = chr8:140963081-140963396
  misc_feature 1..315: note = hypo
  source 1..315: mol_type = genomic DNA
caagagcagaaaaaacggactgatgtagtggttgcacaccaaccagtaagtgaacaccggctccgaaggcctctttggtatgcaccaaaacacatggcatgcggcaagaggaggcgcggcagggagggagccgcacccgccttacagccaaacaaatgaactataaaagggtgaggtgagtcaaccgaggacaatgccctgccaaacagagtgcctcacctgctcacggcttggagtcagccagacccaggcgcgcacatccccaccgccacctccccacctgtgacacaggcctggttacgccacctctctgag

SEQ ID NO: 98777 - DNA, 30 bp, Homo sapiens
  misc_feature 1..30: note = chr8:140971345-140971375
  misc_feature 1..30: note = hypo
  source 1..30: mol_type = genomic DNA
gcattccgagtcacacgggggagccctgca

SEQ ID NO: 98778 - DNA, 30 bp, Homo sapiens; identical to SEQ ID NO: 41964
  misc_feature 1..30: note = chr8:141018127-141018157
  misc_feature 1..30: note = hypo
  source 1..30: mol_type = genomic DNA

SEQ ID NO: 98779 - DNA, 30 bp, Homo sapiens; identical to SEQ ID NO: 41965
  misc_feature 1..30: note = chr8:141054547-141054577
  misc_feature 1..30: note = hypo
  source 1..30: mol_type = genomic DNA

SEQ ID NO: 98780 - DNA, 41 bp, Homo sapiens; identical to SEQ ID NO: 41966
  misc_feature 1..41: note = chr8:141106960-141107001
  misc_feature 1..41: note = hypo
  source 1..41: mol_type = genomic DNA

SEQ ID NO: 98781 - DNA, 323 bp, Homo sapiens
  misc_feature 1..323: note = chr8:141107540-141107863
  misc_feature 1..323: note = hypo
  source 1..323: mol_type = genomic DNA
cctgagtcctggctgcgcagcctgtgttgccagtcgcagggtaatacactcgcctgcatcgtgggtgccccgccaccgccctgccacagtctacaaggcaagaacgcccgtctgggtccgtagtgtgcagccgcagctgtgctgctgtccacaccataaaaactcctggccacagacgtgccacagtcggcaggataagaatgcccagctggatcttggggtgcacagccccagctgtgccgctgtccacagggtaagaacgcctgtctgggtgggtccttggtgcacaaccacaggcgcgctgcagtcggcagagtgaggag

SEQ ID NO: 98782 - DNA, 30 bp, Homo sapiens
  misc_feature 1..30: note = chr8:141126859-141126889
  misc_feature 1..30: note = hypo
  source 1..30: mol_type = genomic DNA
tcagtccaaaggtaccgtagaggttcccta

SEQ ID NO: 98783 - DNA, 30 bp, Homo sapiens
  misc_feature 1..30: note = chr8:141159257-141159287
  misc_feature 1..30: note = hypo
  source 1..30: mol_type = genomic DNA
gtcaccctctgatctcgttccattgctctg

SEQ ID NO: 98784 - DNA, 203 bp, Homo sapiens
  misc_feature 1..203: note = chr8:141159746-141159949
  misc_feature 1..203: note = hypo
  source 1..203: mol_type = genomic DNA
ccctgcgattagtgacggcttcaattcctcatttgtgaaatgaggataaaatctctaccacatggggctgctgtctgactcgaatgtacgtgagtcatcatccacggttccaggcaaatatttactaatccccttctcatctccttgaaaggtctgctcgccttgacgcagcacatgaagtacgagtgcgagcagtggagcct

SEQ ID NO: 98785 - DNA, 284 bp, Homo sapiens
  misc_feature 1..284: note = chr8:141202454-141202738
  misc_feature 1..284: note = hypo
  source 1..284: mol_type = genomic DNA
gcatgatcacctcaacgtaggcaaaaggactctgttagaagaagtcactggctgacttctgcagtcaacaggcccaatcgtccacagagcaaggtgatctgcagaaacctcctggcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgcaaaacctgctccgacgaggtttaagaacc

SEQ ID NO: 98786 - DNA, 30 bp, Homo sapiens
  misc_feature 1..30: note = chr8:141219253-141219283
  misc_feature 1..30: note = hypo
  source 1..30: mol_type = genomic DNA
cctctgcagacgatccgcctaaaacaacga

SEQ ID NO: 98787 - DNA, 70 bp, Homo sapiens
  misc_feature 1..70: note = chr8:141249551-141249621
  misc_feature 1..70: note = hypo
  source 1..70: mol_type = genomic DNA
gatgcagccaccaggcgctaggaacaaaaaacaagtaagactccggccctgcccgcgagatgagggtggt

SEQ ID NO: 98788 - DNA, 113 bp, Homo sapiens
  misc_feature 1..113: note = chr8:141347719-141347832
  misc_feature 1..113: note = hypo
  source 1..113: mol_type = genomic DNA
tgcagcacgtgggtgcgggtaccggatccacctgccctgaacctgctgcctcccccaccaaaatgggctgcctaggtgtcagatgggcacgtgatcagcggtgctgtgagagt

SEQ ID NO: 98789 - DNA, 196 bp, Homo sapiens; identical to SEQ ID NO: 41971
  misc_feature 1..196: note = chr8:141466557-141466753
  misc_feature 1..196: note = hypo
  source 1..196: mol_type = genomic DNA

SEQ ID NO: 98790 - DNA, 30 bp, Homo sapiens
  misc_feature 1..30: note = chr8:141503865-141503895
  misc_feature 1..30: note = hypo
  source 1..30: mol_type = genomic DNA
tttttactgtgatggcgaccagcagaggga

SEQ ID NO: 98791 - DNA, 30 bp, Homo sapiens
  misc_feature 1..30: note = chr8:141559694-141559724
  misc_feature 1..30: note = hypo
  source 1..30: mol_type = genomic DNA
gcctcgcggctgtggcggccccagggcagt

SEQ ID NO: 98792 - DNA, 215 bp, Homo sapiens
  misc_feature 1..215: note = chr8:141566731-141566946
  misc_feature 1..215: note = hypo
  source 1..215: mol_type = genomic DNA
cgtctacctgtgggacgaggtgctggagctgcccagccctacctgaatgacaggatctaaacaccaagggaagagttacagcacatggctcagggtcggaatttgatcctttcccaaggcaaggatttttcaaagagtcgtgatgttagaggagagtgaatgacgcaacggtgcagtgacggagcacctgcctcgcgctgcggggcctgctggac

SEQ ID NO: 98793 - DNA, 80 bp, Homo sapiens
  misc_feature 1..80: note = chr8:141577436-141577516
  misc_feature 1..80: note = hypo
  source 1..80: mol_type = genomic DNA
ccaagggacaggcaccgtgtgcgtctgggctgccagcagcaggtggtccacacccgagacactgccgcctctcaacagcc

SEQ ID NO: 98794 - DNA, 171 bp, Homo sapiens
  misc_feature 1..171: note = chr8:141588008-141588179
  misc_feature 1..171: note = hypo
  source 1..171: mol_type = genomic DNA
cctgcacacccagcacggcgtgcggcttgggctgggcggatctctcaagagaaggaggctgttcggtcatgccagtgaggcagtgccctgaggggctacaatgcacacccgtggagtcggctggcagacaatcctggccaccactcaggcctccgccgcccagagagagca

SEQ ID NO: 98795 - DNA, 30 bp, Homo sapiens
  misc_feature 1..30: note = chr8:141594621-141594651
  misc_feature 1..30: note = hypo
  source 1..30: mol_type = genomic DNA
gaacttcaacaagaacgttcacagcagtct

SEQ ID NO: 98796 - DNA, 55 bp, Homo sapiens
  misc_feature 1..55: note = chr8:141594857-141594912
  misc_feature 1..55: note = hypo
  source 1..55: mol_type = genomic DNA
cacacatcagaatgccgtgactttaggggctgggggtaaccggaagagggtatga

SEQ ID NO: 98797 - DNA, 368 bp, Homo sapiens
  misc_feature 1..368: note = chr8:141596819-141597187
  misc_feature 1..368: note = hypo
  source 1..368: mol_type = genomic DNA
ctctctacgccacaccggagtagaacaaagcacttgccaacacgtggccctgttctcaggtggctccaaccacccagtgagacggctcccaggaaacgtctaggacagagcccgggaatctggccctgtggccaatctcgatttcagggtcgggcacgctcctctcggggaggagagtcactgtccttcggtgactcccagcttacaaggtgctcatgcagttacttaaccgagcctcacaaccataccacaaaggggcacaccgctggctgcaagaaggttttgggctggaacacgagctacttgcaggtgaagcaaagctgctgggccggctccaaaccaggcccctccaccgggcccccaagcag

SEQ ID NO: 98798 - DNA, 30 bp, Homo sapiens
  misc_feature 1..30: note = chr8:141598051-141598081
  misc_feature 1..30: note = hypo
  source 1..30: mol_type = genomic DNA
cctgcatccaagactcgacctcacctcccc

SEQ ID NO: 98799 - DNA, 30 bp, Homo sapiens
  misc_feature 1..30: note = chr8:141599723-141599753
  misc_feature 1..30: note = hypo
  source 1..30: mol_type = genomic DNA
gcatcagccagaaaacgtgcaggccaaaga

SEQ ID NO: 98800 - DNA, 109 bp, Homo sapiens
  misc_feature 1..109: note = chr8:141600175-141600284
  misc_feature 1..109: note = hypo
  source 1..109: mol_type = genomic DNA
ctcccatgccaggcccgggccaccaatgagcccacggtgagccgaagtcaaagcctcacccagcccacgttcacagagacgcgtctggcccaggcgtcacagctgtgca

SEQ ID NO: 98801 - DNA, 52 bp, Homo sapiens
  misc_feature 1..52: note = chr8:141602350-141602402
  misc_feature 1..52: note = hypo
  source 1..52: mol_type = genomic DNA
ctaccaagacagacccgcacgctggtccagggctgctcgaagcctgacacct

SEQ ID NO: 98802 - DNA, 38 bp, Homo sapiens
  misc_feature 1..38: note = chr8:141624393-141624431
  misc_feature 1..38: note = hypo
  source 1..38: mol_type = genomic DNA
gcctaggagacagagtgagactccgtctcaaaacaaaa

SEQ ID NO: 98803 - DNA, 32 bp, Homo sapiens
  misc_feature 1..32: note = chr8:141629973-141630005
  misc_feature 1..32: note = hypo
  source 1..32: mol_type = genomic DNA
ggtttttaacatgaacgcgggggataagcaca

SEQ ID NO: 98804 - DNA, 53 bp, Homo sapiens
  misc_feature 1..53: note = chr8:141632257-141632310
  misc_feature 1..53: note = hypo
  source 1..53: mol_type = genomic DNA
tctatagaacatactcggaacaggtcaatccagtgagacggaacgcagatggg

SEQ ID NO: 98805 - DNA, 40 bp, Homo sapiens
  misc_feature 1..40: note = chr8:141633613-141633653
  misc_feature 1..40: note = hypo
  source 1..40: mol_type = genomic DNA
cagcagtcaggcccccggctggacacgggtcacacctgga

SEQ ID NO: 98806 - DNA, 68 bp, Homo sapiens
  misc_feature 1..68: note = chr8:141634252-141634320
  misc_feature 1..68: note = hypo
  source 1..68: mol_type = genomic DNA
tcctcaggccagctccgaagagcccccacccagcaggtctcgactgggtcacccggctctgccccctc

SEQ ID NO: 98807 - DNA, 30 bp, Homo sapiens
  misc_feature 1..30: note = chr8:141638210-141638240
  misc_feature 1..30: note = hypo
  source 1..30: mol_type = genomic DNA
cttcagggcagagaccggaagaagctttca

SEQ ID NO: 98808 - DNA, 123 bp, Homo sapiens
  misc_feature 1..123: note = chr8:1420309-1420432
  misc_feature 1..123: note = hypo
  source 1..123: mol_type = genomic DNA
catgcagagctcagacggggccgcactggggaggtgatgctggaggaaatccttgcagcaggagggatgcctgccgccatgttgggaggggaggggggttgagccatgcggtagagcggctgt

SEQ ID NO: 98809 - DNA, 30 bp, Homo sapiens
  misc_feature 1..30: note = chr8:142095370-142095400
  misc_feature 1..30: note = hypo
  source 1..30: mol_type = genomic DNA
aacccggatctcagacgtcccaggtacgtc

SEQ ID NO: 98810 - DNA, 94 bp, Homo sapiens
  misc_feature 1..94: note = chr8:142119106-142119200
  misc_feature 1..94: note = hypo
  source 1..94: mol_type = genomic DNA
aggctgtcctggcagcgcccgccagcaagaaggtggcagtgctgggaacatgggctgtctgggaccctaaaactccgctgggtcactgcaacct

SEQ ID NO: 98811 - DNA, 30 bp, Homo sapiens
  misc_feature 1..30: note = chr8:142168132-142168162
  misc_feature 1..30: note = hypo
  source 1..30: mol_type = genomic DNA
acaggcgtgagccaccgcgcccagtcggag

SEQ ID NO: 98812 - DNA, 30 bp, Homo sapiens
  misc_feature 1..30: note = chr8:142190839-142190869
  misc_feature 1..30: note = hypo
  source 1..30: mol_type = genomic DNA
tttcagtgcccatgacgcttccggagacaa

SEQ ID NO: 98813 - DNA, 54 bp, Homo sapiens
  misc_feature 1..54: note = chr8:142231648-142231702
  misc_feature 1..54: note = hypo
  source 1..54: mol_type = genomic DNA
gacaccaggtgtggccgagaaacttaccgatggcagagccgttaaggaaaagtg

SEQ ID NO: 98814 - DNA, 176 bp, Homo sapiens
  misc_feature 1..176: note = chr8:142242938-142243114
  misc_feature 1..176: note = hypo
  source 1..176: mol_type = genomic DNA
tggctcccgggtgaacgctcacgaccagcttgggctggactggcgtctcctttcagtggttgccactttccatggtgtagatgctaccaccccgcccaatctcaagctgctgaggtgacgtcgctgaacaggagtggagaggagcagcagccagcgctgagcggcacctctgcccc

SEQ ID NO: 98815 - DNA, 266 bp, Homo sapiens
  misc_feature 1..266: note = chr8:142243948-142244214
  misc_feature 1..266: note = hypo
  source 1..266: mol_type = genomic DNA
ggtccagcaggtctgcggctggacctgactctgggctgagctgagcttcagaggccagcactagggccccatggttgagtggaggctgaattccgagtctgaatcccagctctaccatctactagctctgttgagtgtccgtttcctgatctgcagaaatctgtaaacatcatcaccaggcttttatgagaactgagtcatcctgaacagctcactgttggcataaaccattagcgaatcgtcgccaacatcggggcctgcatcgc

SEQ ID NO: 98816 - DNA, 30 bp, Homo sapiens
  misc_feature 1..30: note = chr8:142260889-142260919
  misc_feature 1..30: note = hypo
  source 1..30: mol_type = genomic DNA
actgggacatacccccgttgcaagttgagg

SEQ ID NO: 98817 - DNA, 95 bp, Homo sapiens
  misc_feature 1..95: note = chr8:142290791-142290886
  misc_feature 1..95: note = hypo
  source 1..95: mol_type = genomic DNA
atgggggtttttgttcgtgtaatgcgacagcgtgcagctccacacacacaggaagcaagctgtcaggacagagcctgactcgcacaggtaactgg

SEQ ID NO: 98818 - DNA, 151 bp, Homo sapiens
  misc_feature 1..151: note = chr8:142292552-142292703
  misc_feature 1..151: note = hypo
  source 1..151: mol_type = genomic DNA
agcctctgtctccatcgctgccctccctccaggccgccgctcagggcacgccgcctccatcgctgccctctctccaggccaccactcagggcgcgctgcgctcagctcacaccaccccgtgcacagctcgtggatgcggtcctcccttttc

SEQ ID NO: 98819 - DNA, 30 bp, Homo sapiens
  misc_feature 1..30: note = chr8:142296602-142296632
  misc_feature 1..30: note = hypo
  source 1..30: mol_type = genomic DNA
agggcaggtgcaaatcgaggaatttatact

SEQ ID NO: 98820 - DNA, 43 bp, Homo sapiens
  misc_feature 1..43: note = chr8:142297555-142297598
  misc_feature 1..43: note = hypo
  source 1..43: mol_type = genomic DNA
ctccccaaagtccctcgttaacccttcacggcaagtctggagt

SEQ ID NO: 98821 - DNA, 245 bp, Homo sapiens
  misc_feature 1..245: note = chr8:142299062-142299307
  misc_feature 1..245: note = hypo
  source 1..245: mol_type = genomic DNA
gcgctaatccttcggcgtgggtgggaaaagaggtccaggaaaggaacccagctcccaagagggaggcagaggcagagatgtggtcccagaggaataagcagggcctcagccggccatgaaaccagccaggtgcgcgatggagtcagggcctggggaagaggatgatcggagaaggcggtgccagggaacagtgggcacagaggccagggcgagagcagaaggggcagaggcggggatggcggggg

SEQ ID NO: 98822 - DNA, 26 bp, Homo sapiens
  misc_feature 1..26: note = chr8:142313508-142313534
  misc_feature 1..26: note = hypo
  source 1..26: mol_type = genomic DNA
gattgcaggaacgagcctctgtgccc

SEQ ID NO: 98823 - DNA, 30 bp, Homo sapiens; identical to SEQ ID NO: 41984
  misc_feature 1..30: note = chr8:142323052-142323082
  misc_feature 1..30: note = hypo
  source 1..30: mol_type = genomic DNA

SEQ ID NO: 98824 - DNA, 30 bp, Homo sapiens
  misc_feature 1..30: note = chr8:142356494-142356524
  misc_feature 1..30: note = hypo
  source 1..30: mol_type = genomic DNA
agccccactgctcttcgctggggtgactcc

SEQ ID NO: 98825 - DNA, 162 bp, Homo sapiens
  misc_feature 1..162: note = chr8:142361169-142361331
  misc_feature 1..162: note = hypo
  source 1..162: mol_type = genomic DNA
tgtgaggggcacctgcggtttggtgttaggctcccacctacaggggcaaagcccaggctcagaggtgacctggaatcagcgaatcaggggccgagctggactaggcaggagggtgtgtggttgcagcaggtgagctcatctgtaaaacgggggtgcgacacc

SEQ ID NO: 98826 - DNA, 188 bp, Homo sapiens
  misc_feature 1..188: note = chr8:1423661-1423849
  misc_feature 1..188: note = hypo
  source 1..188: mol_type = genomic DNA
gctttggaggtgccccgctgattgttgcaggctgtttcgtgaggatcaatgagcggctgggagtaaacgtcttccatactgggtcaggtcaccaccctaaagccctacaaagtcgttgacccccataattcaggaacattgcttgtcatcccgggacccaccgcaaggccgagcggagaggaagacag

SEQ ID NO: 98827 - DNA, 64 bp, Homo sapiens
  misc_feature 1..64: note = chr8:142367760-142367824
  misc_feature 1..64: note = hypo
  source 1..64: mol_type = genomic DNA
gagggtgtcttggcccgggtgcggcagcagaagacgtacagcgccagcccgttgagcaccagcc

SEQ ID NO: 98828 - DNA, 30 bp, Homo sapiens
  misc_feature 1..30: note = chr8:142368111-142368141
  misc_feature 1..30: note = hypo
  source 1..30: mol_type = genomic DNA
agaactcagctggcccgtctgcccctgcac

SEQ ID NO: 98829 - DNA, 30 bp, Homo sapiens
  misc_feature 1..30: note = chr8:142369212-142369242
  misc_feature 1..30: note = hyper
  source 1..30: mol_type = genomic DNA
cagggtggggaggctcgtgggccgtttctt

SEQ ID NO: 98830 - DNA, 30 bp, Homo sapiens
  misc_feature 1..30: note = chr8:142405274-142405304
  misc_feature 1..30: note = hypo
  source 1..30: mol_type = genomic DNA
cgatggcccagtaggcgttcacctggcaga

SEQ ID NO: 98831 - DNA, 30 bp, Homo sapiens
  misc_feature 1..30: note = chr8:142405762-142405792
  misc_feature 1..30: note = hypo
  source 1..30: mol_type = genomic DNA
tacctggggaaggtgcgtgggccacccctc

SEQ ID NO: 98832 - DNA, 30 bp, Homo sapiens
  misc_feature 1..30: note = chr8:142419859-142419889
  misc_feature 1..30: note = hypo
  source 1..30: mol_type = genomic DNA
gtgcaggctgcccagcgtgcccagctccca

SEQ ID NO: 98833 - DNA, 30 bp, Homo sapiens
  misc_feature 1..30: note = chr8:142424065-142424095
  misc_feature 1..30: note = hypo
  source 1..30: mol_type = genomic DNA
ggctctggtgggcgtcgtggggctggactg

SEQ ID NO: 98834 - DNA, 105 bp, Homo sapiens
  misc_feature 1..105: note = chr8:142427595-142427700
  misc_feature 1..105: note = hyper
  source 1..105: mol_type = genomic DNA
atttccaaagctgggcgcgctctgtccaggcctccccaccaggagcgcggcccggcggctcctgccctccggacccccagcccacaggcccgtgcagccccatga

SEQ ID NO: 98835 - DNA, 47 bp, Homo sapiens
  misc_feature 1..47: note = chr8:142428027-142428074
  misc_feature 1..47: note = hyper
  source 1..47: mol_type = genomic DNA
gcggcggaggggcggcgccccgacccagggccagcaccgtgggcacc

SEQ ID NO: 98836 - DNA, 155 bp, Homo sapiens
  misc_feature 1..155: note = chr8:142432225-142432380
  misc_feature 1..155: note = hypo
  source 1..155: mol_type = genomic DNA
caagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagct

SEQ ID NO: 98837 - DNA, 116 bp, Homo sapiens
  misc_feature 1..116: note = chr8:142436166-142436282
  misc_feature 1..116: note = hypo
  source 1..116: mol_type = genomic DNA
aagtagccgtgacaccggttgtctctaggagttgccctgcctggaggctggggaggggtgagatgcccccgagggctgtgtgtctgcctcagtgggcccagcgggctctccctggt

SEQ ID NO: 98838 - DNA, 149 bp, Homo sapiens
  misc_feature 1..149: note = chr8:142439200-142439349
  misc_feature 1..149: note = hypo
  source 1..149: mol_type = genomic DNA
tcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagc

SEQ ID NO: 98839 - DNA, 30 bp, Homo sapiens
  misc_feature 1..30: note = chr8:142444722-142444752
  misc_feature 1..30: note = hypo
  source 1..30: mol_type = genomic DNA
ggcctgtgtaacagacgggcagctggtggc

SEQ ID NO: 98840 - DNA, 30 bp, Homo sapiens
  misc_feature 1..30: note = chr8:142445528-142445558
  misc_feature 1..30: note = hypo
  source 1..30: mol_type = genomic DNA
ccaggctggtctgcccgcggccctggccct

SEQ ID NO: 98841 - DNA, 162 bp, Homo sapiens
  misc_feature 1..162: note = chr8:142452230-142452392
  misc_feature 1..162: note = hypo
  source 1..162: mol_type = genomic DNA
tatggagggtagcagcgggcgagggcgtgggagactcagggcgtgtggcgtagcggagcccagagaagtgtccattctccactcctgagactcctgccctcagaggacatggagaaacccgcggcactggccctcgcttgtgagtgacggagaaacccgcgg

SEQ ID NO: 98842 - DNA, 30 bp, Homo sapiens
  misc_feature 1..30: note = chr8:142453296-142453326
  misc_feature 1..30: note = hypo
  source 1..30: mol_type = genomic DNA
ccagcccaggacccccggcaatgctcaagg

SEQ ID NO: 98843 - DNA, 65 bp, Homo sapiens
  misc_feature 1..65: note = chr8:142461734-142461799
  misc_feature 1..65: note = hypo
  source 1..65: mol_type = genomic DNA
ggactggggggtgggcgactggaagtgggcaagtcactgcaggtgagagccggtggtgtcctgga

SEQ ID NO: 98844 - DNA, 54 bp, Homo sapiens
  misc_feature 1..54: note = chr8:142501450-142501504
  misc_feature 1..54: note = hypo
  source 1..54: mol_type = genomic DNA
tgaaactaaaggtgacgtggttttagaagtagttgagtccgtagatgtacctcc

SEQ ID NO: 98845 - DNA, 191 bp, Homo sapiens; identical to SEQ ID NO: 32290
  misc_feature 1..191: note = chr8:142528212-142528403
  misc_feature 1..191: note = hyper
  source 1..191: mol_type = genomic DNA

SEQ ID NO: 98846 - DNA, 153 bp, Homo sapiens; identical to SEQ ID NO: 32291
  misc_feature 1..153: note = chr8:142528454-142528607
  misc_feature 1..153: note = hyper
  source 1..153: mol_type = genomic DNA

SEQ ID NO: 98847 - DNA, 112 bp, Homo sapiens; identical to SEQ ID NO: 9773
  misc_feature 1..112: note = chr8:142528670-142528782
  misc_feature 1..112: note = hyper
  source 1..112: mol_type = genomic DNA

SEQ ID NO: 98848 - DNA, 128 bp, Homo sapiens; identical to SEQ ID NO: 9774
  misc_feature 1..128: note = chr8:142528834-142528962
  misc_feature 1..128: note = hyper
  source 1..128: mol_type = genomic DNA

SEQ ID NO: 98849 - DNA, 15 bp, Homo sapiens
  misc_feature 1..15: note = chr8:142529027-142529042
  misc_feature 1..15: note = hyper
  source 1..15: mol_type = genomic DNA
cggaggcaggccctc

SEQ ID NO: 98850 - DNA, 200 bp, Homo sapiens
  misc_feature 1..200: note = chr8:142535307-142535507
  misc_feature 1..200: note = hypo
  source 1..200: mol_type = genomic DNA
gggtagacacaaactcggagagagagagggtcaggacggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 98851 - DNA, 55 bp, Homo sapiens
  misc_feature 1..55: note = chr8:142547012-142547067
  misc_feature 1..55: note = hypo
  source 1..55: mol_type = genomic DNA
catgggggtgtcctgcgcagccacctgcctcccgcctgggcgggatcctggccct

SEQ ID NO: 98852 - DNA, 144 bp, Homo sapiens; identical to SEQ ID NO: 41991
  misc_feature 1..144: note = chr8:142553829-142553973
  misc_feature 1..144: note = hypo
  source 1..144: mol_type = genomic DNA

SEQ ID NO: 98853 - DNA, 185 bp, Homo sapiens
  misc_feature 1..185: note = chr8:142558807-142558992
  misc_feature 1..185: note = hypo
  source 1..185: mol_type = genomic DNA
gagcagcacgtcacccgcccccagactcccagggccccaggctggcaaggtggccttccagagtgcctggggctcctgtggttctgtgcccgccagcactgtcctcacaggcacaagcacctcatggatgctggtgggtcaggtgggctggcgtctcacaggacctcttccgccactgccctcga

SEQ ID NO: 98854 - DNA, 62 bp, Homo sapiens
  misc_feature 1..62: note = chr8:142560165-142560227
  misc_feature 1..62: note = hypo
  source 1..62: mol_type = genomic DNA
taccctgtgagtccccggcaggcgtcactgcccccagggctccacgtcgtctctcctgcatg

SEQ ID NO: 98855 - DNA, 296 bp, Homo sapiens
  misc_feature 1..296: note = chr8:142568543-142568839
  misc_feature 1..296: note = hypo
  source 1..296: mol_type = genomic DNA
gtactgttcccaacacgttttatacaaggggagaccagagctcagagaggtcaagccacctgcctgaggtcgcacagctggcctgtggagaagccggggctctgctacccaggtccgcctgatcttgccatcatccgatgctcttgccgacggcaccacatggctgcggaaagggtaagtgatgtgatgagcacaaatgcccttcaaagaccaacttctgggcgactatctgctgtcatgcctctctctggaccccaagccaggccaccccttagcccggtcgggttgacacataa

SEQ ID NO: 98856 - DNA, 172 bp, Homo sapiens
  misc_feature 1..172: note = chr8:142583056-142583228
  misc_feature 1..172: note = hypo
  source 1..172: mol_type = genomic DNA
cagctgtgtgcagggcggggtggcggggggggacggggagggcggaggagccattggagtgattatgatggagctggcactggtcataaactttaatcaacttaaaacccgcttttggtattaaactttaccaaccatttaatacccctggacaggccgagtgtgggagcag

SEQ ID NO: 98857 - DNA, 171 bp, Homo sapiens
  misc_feature 1..171: note = chr8:142593564-142593735
  misc_feature 1..171: note = hypo
  source 1..171: mol_type = genomic DNA
gtgggcctggggtcacggagcgctttctggaaagccgtggtgaagcatcacccggtaccagccgcctcgctagctcttgccatagcagcagcgtgaacaagcgtcccgccatttagtggctcaaaacaacaaggtgccgtggtttctcccgagcctcgggtgggtctaatc

SEQ ID NO: 98858 - DNA, 30 bp, Homo sapiens
  misc_feature 1..30: note = chr8:142603404-142603434
  misc_feature 1..30: note = hypo
  source 1..30: mol_type = genomic DNA
tggagatcacagccacgcctggtcacgggg

SEQ ID NO: 98859 - DNA, 132 bp, Homo sapiens
  misc_feature 1..132: note = chr8:142622154-142622286
  misc_feature 1..132: note = hypo
  source 1..132: mol_type = genomic DNA
gcgctggcctggctacgagagctgtggctcaccctgagggtcccacatccgccttggtgctgccccaggctccacgggcatctggccaccttcaagtgctgcctggggccatggcatcgctgctaccctccc

SEQ ID NO: 98860 - DNA, 41 bp, Homo sapiens
  misc_feature 1..41: note = chr8:142630247-142630288
  misc_feature 1..41: note = hypo
  source 1..41: mol_type = genomic DNA
ggggccttcaggtgccgagggtggtgcgcaccccgggatgc

SEQ ID NO: 98861 - DNA, 30 bp, Homo sapiens
  misc_feature 1..30: note = chr8:142633631-142633661
  misc_feature 1..30: note = hypo
  source 1..30: mol_type = genomic DNA
tgagctccttggtgacggtgcccaggtcat

SEQ ID NO: 98862 - DNA, 43 bp, Homo sapiens
  misc_feature 1..43: note = chr8:142659067-142659110
  misc_feature 1..43: note = hypo
  source 1..43: mol_type = genomic DNA
agtctctgggagccccgcgggactcgcccgcctgccacacctg

SEQ ID NO: 98863 - DNA, 34 bp, Homo sapiens
  misc_feature 1..34: note = chr8:142680131-142680165
  misc_feature 1..34: note = hypo
  source 1..34: mol_type = genomic DNA
ggtgactcctccagacggccgggagggcttcaca

SEQ ID NO: 98864 - DNA, 136 bp, Homo sapiens
  misc_feature 1..136: note = chr8:142694812-142694948
  misc_feature 1..136: note = hypo
  source 1..136: mol_type = genomic DNA
gatggagaggtgctccgtccactctgcccagtgtctgccctctgcccagacgccccaaaagcagccgcagagagaaggcgaactttggcttcgggggcccagtgccaccacttccgatctgcgtggcggtggtcaa

SEQ ID NO: 98865 - DNA, 193 bp, Homo sapiens; identical to SEQ ID NO: 41998
  misc_feature 1..193: note = chr8:142706678-142706871
  misc_feature 1..193: note = hypo
  source 1..193: mol_type = genomic DNA

SEQ ID NO: 98866 - DNA, 46 bp, Homo sapiens
  misc_feature 1..46: note = chr8:142738298-142738344
  misc_feature 1..46: note = hypo
  source 1..46: mol_type = genomic DNA
gcctgaaccacagagcgggcttcttccagcccgggagtccgagagg

SEQ ID NO: 98867 - DNA, 196 bp, Homo sapiens
  misc_feature 1..196: note = chr8:142841690-142841886
  misc_feature 1..196: note = hypo
  source 1..196: mol_type = genomic DNA
ctgctggtacagagccgcgctccttgggagaggtgaggaaggggcaggggtggtgttggtatgaggctgaggctgccacagggtggacaggagagaaggccagagttgggggtggcccctgagtaattctgggcttcgcaggccatggaaggtgtttggatatactcctcagtgccacagacgctcccagggacca

SEQ ID NO: 98868 - DNA, 202 bp, Homo sapiens
  misc_feature 1..202: note = chr8:142859982-142860184
  misc_feature 1..202: note = hypo
  source 1..202: mol_type = genomic DNA
tgcccttggacttcccggcatccagaacccgagccaaaaaaagttcatttttaaaaaaattacccagtctcagggattctgttattgcaacagaaaatgaacttagacgtatgcttacaacacacagcatagtgcttgccatgaaggaacacctgttaaataaataatagtggttggtgggtgggtgcggttgtcatgagtg

SEQ ID NO: 98869 - DNA, 30 bp, Homo sapiens
  misc_feature 1..30: note = chr8:142881166-142881196
  misc_feature 1..30: note = hypo
  source 1..30: mol_type = genomic DNA
gtgcgctgggcaggccgtggttctcactct

SEQ ID NO: 98870 - DNA, 42 bp, Homo sapiens
  misc_feature 1..42: note = chr8:142895890-142895932
  misc_feature 1..42: note = hypo
  source 1..42: mol_type = genomic DNA
tgcagaccaaactcccgaccagcacagcgtctgtttgccacc

SEQ ID NO: 98871 - DNA, 159 bp, Homo sapiens
  misc_feature 1..159: note = chr8:142939132-142939291
  misc_feature 1..159: note = hypo
  source 1..159: mol_type = genomic DNA
tattagcaccaccatcgtcatccccatccttgtcatcatcaccagtactatcatcatcatcatcgtcatcatcatagctattaccatcaacatcaatgccgttactgtcatcatcattgttaccatcaccatcatcgccattcccgtcatcatcatcac

SEQ ID NO: 98872 - DNA, 147 bp, Homo sapiens
  misc_feature 1..147: note = chr8:142984512-142984659
  misc_feature 1..147: note = hypo
  source 1..147: mol_type = genomic DNA
gcagactgtcaccaccgcccatcgccaccctgggagagtgaaggccgtcgtaggcaggagacaaactgctggatgagctgagtgccagagaaccttgatgcgcaaacaaaggcgcggctgggtctggtccgccggccggcgctgctg

SEQ ID NO: 98873 - DNA, 30 bp, Homo sapiens
  misc_feature 1..30: note = chr8:143013191-143013221
  misc_feature 1..30: note = hypo
  source 1..30: mol_type = genomic DNA
tcagacacccctcaccgcccaggccaggag

SEQ ID NO: 98874 - DNA, 102 bp, Homo sapiens
  misc_feature 1..102: note = chr8:143054769-143054871
  misc_feature 1..102: note = hypo
  source 1..102: mol_type = genomic DNA
actgtacttgcctcacgtgtgcctgggctcacggtgcctgcgctcacgggtgcctgccctcacggtgcctgcgttcacgggtgcctgccctcacgggtgcct

SEQ ID NO: 98875 - DNA, 162 bp, Homo sapiens
  misc_feature 1..162: note = chr8:143054991-143055153
  misc_feature 1..162: note = hypo
  source 1..162: mol_type = genomic DNA
cctgggctcacggtgcctgcgctcacgggtgcctgccctcacgagcctgcgctcacgggtgcctgtgcttacaggtgcgcaccaccccccacaccctctaggtggcttctcagcttttaatctcagagggtgatgcctgctggcacccgccttgttctgctc

SEQ ID NO: 98876 - DNA, 30 bp, Homo sapiens
  misc_feature 1..30: note = chr8:143055995-143056025
  misc_feature 1..30: note = hypo
  source 1..30: mol_type = genomic DNA
ggatgatgctgttaccgttgccatcatcat

SEQ ID NO: 98877 - DNA, 280 bp, Homo sapiens
  misc_feature 1..280: note = chr8:143088493-143088773
  misc_feature 1..280: note = hypo
  source 1..280: mol_type = genomic DNA
ccaccgcagcgtgtacgccgttttctacatttacggagagactcaggtgtgtgcacactgtgtgtccagaagggctgagggctacagagcagcctggaagaagcacatcgaaatgagcagagcccacacccatcctcccggggaccatggactgccaccacctccctgcggacagccctgggatgcagaccccagccaccaggccggctgcacggaccgcagggtgcaactgcctcctctctcagcccctttgtgcagtgaacaacgtgcgtagccatat

SEQ ID NO: 98878 - DNA, 68 bp, Homo sapiens; identical to SEQ ID NO: 42003
  misc_feature 1..68: note = chr8:143088999-143089067
  misc_feature 1..68: note = hypo
  source 1..68: mol_type = genomic DNA

SEQ ID NO: 98879 - DNA, 85 bp, Homo sapiens
  misc_feature 1..85: note = chr8:143090651-143090736
  misc_feature 1..85: note = hypo
  source 1..85: mol_type = genomic DNA
atgtgagggcacagccgacagacggccgcctgtggaccaggaggcagccctctccggacgccaaatctgccggcaccttgatctt

SEQ ID NO: 98880 - DNA, 33 bp, Homo sapiens; identical to SEQ ID NO: 15178
  misc_feature 1..33: note = chr8:143097424-143097457
  misc_feature 1..33: note = hypo
  source 1..33: mol_type = genomic DNA

SEQ ID NO: 98881 - DNA, 399 bp, Homo sapiens
  misc_feature 1..399: note = chr8:143105067-143105466
  misc_feature 1..399: note = hypo
  source 1..399: mol_type = genomic DNA
ccttggaggtgccctcgccacccctgggggcagagctgccgctgacaggagtgatggaaggagaggctgcgtggccgcgctgctgccgctcaaacacctcgaagcccacagcttcgaggacaggcgctggaaagccagtgccagctgcgccagctcagccgtctgtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgcaaggtgctcagaccccctccacctcagagttctcacctgaaaagtggggataataactgtctccacattacaaccgggaggaccaactc

SEQ ID NO: 98882 - DNA, 30 bp, Homo sapiens
  misc_feature 1..30: note = chr8:143105753-143105783
  misc_feature 1..30: note = hypo
  source 1..30: mol_type = genomic DNA
ccttccagcgctgatcgctccttgaaatca

SEQ ID NO: 98883 - DNA, 57 bp, Homo sapiens
  misc_feature 1..57: note = chr8:143128744-143128801
  misc_feature 1..57: note = hypo
  source 1..57: mol_type = genomic DNA
gggcacaatacacctcgctccagagctgcgtgatggcaaactcgagtccggccagaa

SEQ ID NO: 98884 - DNA, 30 bp, Homo sapiens; identical to SEQ ID NO: 42008
  misc_feature 1..30: note = chr8:143156215-143156245
  misc_feature 1..30: note = hypo
  source 1..30: mol_type = genomic DNA

SEQ ID NO: 98885 - DNA, 30 bp, Homo sapiens
  misc_feature 1..30: note = chr8:143162428-143162458
  misc_feature 1..30: note = hypo
  source 1..30: mol_type = genomic DNA
tcctctctgaaagcccgccctcctttaatg

SEQ ID NO: 98886 - DNA, 150 bp, Homo sapiens
  misc_feature 1..150: note = chr8:143171132-143171282
  misc_feature 1..150: note = hypo
  source 1..150: mol_type = genomic DNA
cacacgacacccactcggaaactggagtcaacagagagccgcagctgctcgtaccgggcaagtctctgcggggtgggaccctgtcccaggacgcaggattggcgctgagctcgggatctctgtgtgcacctgcatcgctggtaggaggac

SEQ ID NO: 98887 - DNA, 30 bp, Homo sapiens
  misc_feature 1..30: note = chr8:143193094-143193124
  misc_feature 1..30: note = hypo
  source 1..30: mol_type = genomic DNA
tacaagagtctcctgcgaatcaacgatgcc

SEQ ID NO: 98888 - DNA, 157 bp, Homo sapiens
  misc_feature 1..157: note = chr8:143198927-143199084
  misc_feature 1..157: note = hypo
  source 1..157: mol_type = genomic DNA
aggccacagctactccgcagctcacggcagttgggacccaggcctgtaggcggagatgggacgggctgggccctctgctccagagcgcagcagcactcgcatctgtggacactcatcatcgggtctttaaagcacaaaagagcggttcacacaggag

SEQ ID NO: 98889 - DNA, 30 bp, Homo sapiens
  misc_feature 1..30: note = chr8:143199865-143199895
  misc_feature 1..30: note = hypo
  source 1..30: mol_type = genomic DNA
cactgcctgctcagccggcacaatcactca

SEQ ID NO: 98890 - DNA, 30 bp, Homo sapiens
  misc_feature 1..30: note = chr8:143200728-143200758
  misc_feature 1..30: note = hypo
  source 1..30: mol_type = genomic DNA
aaatgcaaacagggccgcatcccaagcccc

SEQ ID NO: 98891 - DNA, 175 bp, Homo sapiens
  misc_feature 1..175: note = chr8:143210674-143210849
  misc_feature 1..175: note = hypo
  source 1..175: mol_type = genomic DNA
gccaagagaaaaacacggaatcccaaagtcggagggaacccggaacaggaaacaacgcacaggctcaggacaggggacaccggtgtgtgtgacccattgctgccacccaccagccgtgtggccctggggacccccatcgccctctgtgcctcggcgtcctcgtctgcagtagtga

SEQ ID NO: 98892 - DNA, 66 bp, Homo sapiens; identical to SEQ ID NO: 42012
  misc_feature 1..66: note = chr8:143217605-143217671
  misc_feature 1..66: note = hypo
  source 1..66: mol_type = genomic DNA

SEQ ID NO: 98893 - DNA, 87 bp, Homo sapiens
  misc_feature 1..87: note = chr8:143223873-143223960
  misc_feature 1..87: note = hypo
  source 1..87: mol_type = genomic DNA
cctagagatggtggccgcatagagagggctttctgatgggagctgtggcctccacagagggacacagctgagcgtgtcagagaggga

SEQ ID NO: 98894 - DNA, 30 bp, Homo sapiens
  misc_feature 1..30: note = chr8:143237748-143237778
  misc_feature 1..30: note = hypo
  source 1..30: mol_type = genomic DNA
tcctttcatggccggcgcacctgcccgtgc

SEQ ID NO: 98895 - DNA, 181 bp, Homo sapiens
  misc_feature 1..181: note = chr8:143246191-143246372
  misc_feature 1..181: note = hypo
  source 1..181: mol_type = genomic DNA
tccagtttccagctgcggtgacctgaaggagcttccaccagctccagcactcagccagaacttgcacccggtaggtgtcactgggggcgagttgccttctggacagaggcatccttgctcagtgcccagaggagctgatgggaaaacccttggggagcagccaggccgctgatccacgaat

SEQ ID NO: 98896 - DNA, 49 bp, Homo sapiens
  misc_feature 1..49: note = chr8:143251863-143251912
  misc_feature 1..49: note = hypo
  source 1..49: mol_type = genomic DNA
ctctgaaggccaccacgccacccatgtctccccacggaagtctccatcg

SEQ ID NO: 98897 - DNA, 30 bp, Homo sapiens
  misc_feature 1..30: note = chr8:143258355-143258385
  misc_feature 1..30: note = hypo
  source 1..30: mol_type = genomic DNA
agagccagactccaacgatgaaccagagca

SEQ ID NO: 98898 - DNA, 30 bp, Homo sapiens; identical to SEQ ID NO: 42013
  misc_feature 1..30: note = chr8:143265172-143265202
  misc_feature 1..30: note = hypo
  source 1..30: mol_type = genomic DNA

SEQ ID NO: 98899 - DNA, 119 bp, Homo sapiens
  misc_feature 1..119: note = chr8:143314588-143314707
  misc_feature 1..119: note = hypo
  source 1..119: mol_type = genomic DNA
tgggcaggacaggcccgtgaggcacgaagagctggcacagctttcctggggctcaggccccttttacagatgggagggcctaggacccaagcggggtttttggacgggtgatggtcaag

SEQ ID NO: 98900 - DNA, 389 bp, Homo sapiens
  misc_feature 1..389: note = chr8:143317093-143317482
  misc_feature 1..389: note = hypo
  source 1..389: mol_type = genomic DNA
actttaggccaaaggcggcagcgggtgagagcacatggcgttgggtccactgtcctgaaagggaagcggccctgagcgtttcctctgtgccagggcctgccaggggcacgggagtcctgtcttttagggagggcttcatgcagggtgggggatggacaagttgaggagcatggcggggcaggaggaggtgggcacgcaggaggggcttcacctggcgaggtgggggcacagaaggctgcaagtcccccaggggagacgggctcacctctcccaattagccccaggctgtgcaggatgctggagcttcagggcaaggactccgcagccaggctccagccacagcctcaccgcgtggccatgaggctctgcccattcgaggcttcagtttc

SEQ ID NO: 98901 - DNA, 54 bp, Homo sapiens
  misc_feature 1..54: note = chr8:143319314-143319368
  misc_feature 1..54: note = hypo
  source 1..54: mol_type = genomic DNA
ttccctgctggcccacgccacccgcctgcccacgccacccgcccaggtctccat

SEQ ID NO: 98902 - DNA, 50 bp, Homo sapiens
  misc_feature 1..50: note = chr8:143326089-143326139
  misc_feature 1..50: note = hypo
  source 1..50: mol_type = genomic DNA
aactaagacagtgagcggggacgcagggagagagacgcttaccgcagccc

SEQ ID NO: 98903 - DNA, 47 bp, Homo sapiens
  misc_feature 1..47: note = chr8:143329464-143329511
  misc_feature 1..47: note = hypo
  source 1..47: mol_type = genomic DNA
ccttacaaggcttcacgcagcatcctccacctcgccctctgccttct

SEQ ID NO: 98904 - DNA, 132 bp, Homo sapiens
  misc_feature 1..132: note = chr8:143332980-143333112
  misc_feature 1..132: note = hypo
  source 1..132: mol_type = genomic DNA
tatgagaggagccttcgacacccttcactgagtgcctcttgccagggcctgggcaccatatacccaccgcccgcgttctctatctgcagggcccgggcaccatgtacccgccacccgcgatctctgtctgca

SEQ ID NO: 98905 - DNA, 346 bp, Homo sapiens
  misc_feature 1..346: note = chr8:143333322-143333668
  misc_feature 1..346: note = hypo
  source 1..346: mol_type = genomic DNA
tctgtcttcagggcccgggcaccatgtacccgccactcgcgttctctatctgcagggcccgggcaccatgtacccgccgcccacgttctctatctgcagggcccgggcaccatgtacccaccgctcgcgttctctatctgcagggcccgggcaccatgtacccgccgcccgcgttctctgtctgcagggcacgcacgttgagagagagcttgtttgatatctgggcggtttgtttggtttaattttgttgttttccctttctgctgtcaagaggtaaacagacggctgcttcatcttcttaagcaggcctacattcgtaatgcatgggttgcgggtgggaggagga

SEQ ID NO: 98906 - DNA, 159 bp, Homo sapiens
  misc_feature 1..159: note = chr8:143334538-143334697
  misc_feature 1..159: note = hypo
  source 1..159: mol_type = genomic DNA
cccaggctggcactacgggtacgggaggagggccggtagccgtggagtcacagcagtggtgacggcggtgcctgcagaagcagggccgctgggccacctcccgagcacaagcaacaagcgaggcacaggccagcgtgcgtgccgcgtctgcacagggtc

SEQ ID NO: 98907 - DNA, 142 bp, Homo sapiens
  misc_feature 1..142: note = chr8:143386798-143386940
  misc_feature 1..142: note = hypo
  source 1..142: mol_type = genomic DNA
agtcacactgggatgcgagccgtgtggacacccaggaaggcggcagggctggggtgcgggccagaggagaccccgcaggtgctcggtctccctcacctccacagcgggaggatcgggggcctggtgccgctctccccagcag

SEQ ID NO: 98908 - DNA, 324 bp, Homo sapiens
  misc_feature 1..324: note = chr8:143405647-143405971
  misc_feature 1..324: note = hypo
  source 1..324: mol_type = genomic DNA
gaaaggccaggcaggcggctacagggtccaggaaacctgacccaagcatccctctcccagcactcctgtgcgaggtctgcacagctgccagctcggcggctcctgtactaccagccaggtggtgccgttgctgccagcagtcaggtgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacctcatgtcccgcgtatctcatacctg

SEQ ID NO: 98909 - DNA, 313 bp, Homo sapiens
  misc_feature 1..313: note = chr8:143436977-143437290
  misc_feature 1..313: note = hypo
  source 1..313: mol_type = genomic DNA
gcaggggtccctgtgcgggcagcttctgactggcctacaccctaatgctatcactacggaacctgctggccaggccacaccttaagttctaaacacctcagggcaagggctccacccgcccacacaaacacctgaagtgcgaaggcaggtttcagagcaaagtgagcctcacgccagctgagtacagacccaagtccctagggccggggaaggcggtgtgaccccacgttccctctgagcaagacacccgcctgtgccatccagccctgcccagagcagggcagcaccaggacaccatcgacccagtgggccc

SEQ ID NO: 98910 - DNA, 52 bp, Homo sapiens; identical to SEQ ID NO: 42023
  misc_feature 1..52: note = chr8:143463629-143463681
  misc_feature 1..52: note = hypo
  source 1..52: mol_type = genomic DNA

SEQ ID NO: 98911 - DNA, 456 bp, Homo sapiens
  misc_feature 1..456: note = chr8:143509151-143509607
  misc_feature 1..456: note = hypo
  source 1..456: mol_type = genomic DNA
gctgggattggagcccgccctgcctcggggaagatcctcgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctgctctcccacagcgtccacagtcactgggccaggctcgcacctgtgaggggccaggacccatac

SEQ ID NO: 98912 - DNA, 15 bp, Homo sapiens
  misc_feature 1..15: note = chr8:143509628-143509643
  misc_feature 1..15: note = hypo
  source 1..15: mol_type = genomic DNA
cggccaccctctggg

SEQ ID NO: 98913 - DNA, 94 bp, Homo sapiens
  misc_feature 1..94: note = chr8:143511468-143511562
  misc_feature 1..94: note = hypo
  source 1..94: mol_type = genomic DNA
aatgcccatccacaccgctgggcaggactggctaaaataacacgtgcgacgcatgcacctgctgatggagaatccacgccggtaaacctcaggc

SEQ ID NO: 98914 - DNA, 16 bp, Homo sapiens
  misc_feature 1..16: note = chr8:143518352-143518368
  misc_feature 1..16: note = hypo
  source 1..16: mol_type = genomic DNA
gtagagttggagtcac

SEQ ID NO: 98915 - DNA, 1302 bp, Homo sapiens
  misc_feature 1..1302: note = chr8:143530469-143531771
  misc_feature 1..1302: note = hyper
  source 1..1302: mol_type = genomic DNA
ccgtccatccacccacgcacctgcattgcctaggcacaacccctcacttccttccctccattcatctgtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatctcgctcccctccccccacacccccgccccccgctagcgctccccctctaatgtgtgatctggaagctctataaagcctgatgtaatccgtaatgcagtctctggctcccgattcgggatccagtttcagagagcgagagattggggagcgccggcagccgggtggggggaagcagctctcgcctctctcctcctccttctcctcgtcctcggcctcctcctcctccccgcgccgccccgcccccggctcggcttggctcgcccccccccccccctcgccaggaaggggaaaaaaggcgagaagagccgggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 98916 - DNA, 532 bp, Homo sapiens
  misc_feature 1..532: note = chr8:143531978-143532510
  misc_feature 1..532: note = hyper
  source 1..532: mol_type = genomic DNA
gacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcct

SEQ ID NO: 98917 - DNA, 958 bp, Homo sapiens; identical to SEQ ID NO: 3374
  misc_feature 1..958: note = chr8:143532541-143533499
  misc_feature 1..958: note = hyper
  source 1..958: mol_type = genomic DNA

SEQ ID NO: 98918 - DNA, 141 bp, Homo sapiens; identical to SEQ ID NO: 3375
  misc_feature 1..141: note = chr8:143533500-143533641
  misc_feature 1..141: note = hyper
  source 1..141: mol_type = genomic DNA

SEQ ID NO: 98919 - DNA, 1049 bp, Homo sapiens
  misc_feature 1..1049: note = chr8:143533708-143534757
  misc_feature 1..1049: note = hyper
  source 1..1049: mol_type = genomic DNA
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 98920 - DNA, 77 bp, Homo sapiens
  misc_feature 1..77: note = chr8:143535787-143535864
  misc_feature 1..77: note = hypo
  source 1..77: mol_type = genomic DNA
accgtgaggtgcacacgggtgcacacggcacccccgccccgcgatgtgtgcctgtctacacacgcagaggggaagga

SEQ ID NO: 98921 - DNA, 49 bp, Homo sapiens; identical to SEQ ID NO: 42027
  misc_feature 1..49: note = chr8:143538439-143538488
  misc_feature 1..49: note = hypo
  source 1..49: mol_type = genomic DNA

SEQ ID NO: 98922 - DNA, 30 bp, Homo sapiens
  misc_feature 1..30: note = chr8:143539356-143539386
  misc_feature 1..30: note = hypo
  source 1..30: mol_type = genomic DNA
ccccgcccctccccccgtgcagtcttttct

SEQ ID NO: 98923 - DNA, 163 bp, Homo sapiens
  misc_feature 1..163: note = chr8:143543201-143543364
  misc_feature 1..163: note = hypo
  source 1..163: mol_type = genomic DNA
gaggagtcaaggccacgtgggttcagcaccaggtgggactggcactctgccaggctctgccgacactcagccaggactgggctcaccccgggactgtagcgcaaggtgaggctggggaggccttctggctgtgggacctgcccacagccgctccctctccatg

SEQ ID NO: 98924 - DNA, 157 bp, Homo sapiens
  misc_feature 1..157: note = chr8:143550641-143550798
  misc_feature 1..157: note = hypo
  source 1..157: mol_type = genomic DNA
gtgaatgtgtgtgcacgcgtgcatgtgtgaatgtaaatgtgtgcacatgcatgtgtgtgaatgtgggagtgtctatgtgcacgtgcatgtgtgtgaatgtgggagtgtgtatgtgcacatgcagatgtgaatgtgagtgtgtgcacgtgtgaatgag

SEQ ID NO: 98925 - DNA, 93 bp, Homo sapiens
  misc_feature 1..93: note = chr8:143555636-143555729
  misc_feature 1..93: note = hypo
  source 1..93: mol_type = genomic DNA
ctgggatcgagctgccggatccccagtgttccccagtggcagcggccccagctccatggtgggtcccctcgtggtggccgccagctgtctcct

SEQ ID NO: 98926 - DNA, 207 bp, Homo sapiens
  misc_feature 1..207: note = chr8:143556062-143556269
  misc_feature 1..207: note = hypo
  source 1..207: mol_type = genomic DNA
caggtccatgaaggccgcggggactgtcggggcagggatggagaaagactcactagagaagctgaacagagcggccggggtcagggcaggggcgtggcggggaggcgcctgcaggcatttatcccaggctccctcctcgggtggccagctggccaggtccagggcaggctccgtcaggctgtgccctgggttcgaggccctggttgg

SEQ ID NO: 98927 - DNA, 357 bp, Homo sapiens; identical to SEQ ID NO: 42029
  misc_feature 1..357: note = chr8:143557723-143558080
  misc_feature 1..357: note = hypo
  source 1..357: mol_type = genomic DNA

SEQ ID NO: 98928 - DNA, 254 bp, Homo sapiens
  misc_feature 1..254: note = chr8:143558389-143558643
  misc_feature 1..254: note = hypo
  source 1..254: mol_type = genomic DNA
gcagccctcctgctgcggggtctggccccggtctgactgcagccccatgggcggcaggcctgtgacgctgtagtggggcctgcaggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccaggtgg

SEQ ID NO: 98929 - DNA, 499 bp, Homo sapiens
  misc_feature 1..499: note = chr8:143560990-143561489
  misc_feature 1..499: note = hypo
  source 1..499: mol_type = genomic DNA
tccagagccagctgccggctctcagtaccccttcctgaacccctgtcccgggccccttggcagagccccatgagatctgtgatgaggacaactttggtgctgtgatctggaaggagaccccagcgggagaggtggctgctgtccggtgtccccgcaacgccacaggtgagggctggagagcacgtggtgtatgggggctcccgtcctgtcctcacggtgatgcccacgctgaggtgctgtcagcactgggaggcggcccagacacggagcccagacagcctgcgtgtgctggcgcggggtggtggggccgcgagcccagggcaccgtgtgagaactctgtggcagctgctgttctgagcactcgctaggggctggcacccatgctcagccctaacgcaagatgtccacggagtctaagcaacccaagaagccgccaccatttacagctgggaaactgaggcacagggaagtgaatgcccttgcccggggcttgcgggga

SEQ ID NO: 98930 - DNA, 154 bp, Homo sapiens
  misc_feature 1..154: note = chr8:143567944-143568098
  misc_feature 1..154: note = hypo
  source 1..154: mol_type = genomic DNA
caggcggcattcagacgtgtctggtggaaaccatagcttcgtgcctattgtacttgaacaagtcccactaaaacatgtccaagacggatcgacattcttattataatgtctttgggaggctaactagcattaaccttttaaattaaagactgag

SEQ ID NO: 98931 - DNA, 152 bp, Homo sapiens
  misc_feature 1..152: note = chr8:143572706-143572858
  misc_feature 1..152: note = hypo
  source 1..152: mol_type = genomic DNA
ctggagcaagttccacgccccatgtggggttccgcaaggagcagtcaggctgtggggtgccatctcggggccctggtgggtgtgccagagtggggccatcctcccagacagcaaggtgggggcagcgaagagaagctcgcccagtcacagga

SEQ ID NO: 98932 - DNA, 30 bp, Homo sapiens; identical to SEQ ID NO: 42033
  misc_feature 1..30: note = chr8:143573208-143573238
  misc_feature 1..30: note = hypo
  source 1..30: mol_type = genomic DNA

SEQ ID NO: 98933 - DNA, 220 bp, Homo sapiens
  misc_feature 1..220: note = chr8:143587271-143587491
  misc_feature 1..220: note = hypo
  source 1..220: mol_type = genomic DNA
gtgggggaggtgaagcggggacccaaggctccgggtgagcgatggcaggctggccgtgccctccccattcattcacgcgcaggcgtcctggctgtgcgccctaccttagtggcgcctgtgggcgcctgtgggactgtcatgcaccagaatgtgtccctggggccacatgtgtgagcagcgtgctgactgagcacctgggcgaccccgaggtggagtaaac

SEQ ID NO: 98934 - DNA, 384 bp, Homo sapiens
  misc_feature 1..384: note = chr8:143591423-143591807
  misc_feature 1..384: note = hyper
  source 1..384: mol_type = genomic DNA
aggaggaagaggaggcggaggaggaagaggaggaggtggaggaggaagaacaggaggaggaggttgggggtggagaggaggaggaggggtttgcagagcaggtcagtccctggtgcaccaagtaacaagtcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 98935 - DNA, 156 bp, Homo sapiens; identical to SEQ ID NO: 32303
  misc_feature 1..156: note = chr8:143591888-143592044
  misc_feature 1..156: note = hyper
  source 1..156: mol_type = genomic DNA

SEQ ID NO: 98936 - DNA, 178 bp, Homo sapiens; identical to SEQ ID NO: 32304
  misc_feature 1..178: note = chr8:143592101-143592279
  misc_feature 1..178: note = hyper
  source 1..178: mol_type = genomic DNA

SEQ ID NO: 98937 - DNA, 221 bp, Homo sapiens; identical to SEQ ID NO: 32305
  misc_feature 1..221: note = chr8:143592358-143592579
  misc_feature 1..221: note = hyper
  source 1..221: mol_type = genomic DNA

SEQ ID NO: 98938 - DNA, 24 bp, Homo sapiens
  misc_feature 1..24: note = chr8:143592663-143592687
  misc_feature 1..24: note = hyper
  source 1..24: mol_type = genomic DNA
cgggacccccggaaagtggctgat

SEQ ID NO: 98939 - DNA, 306 bp, Homo sapiens
  misc_feature 1..306: note = chr8:143595515-143595821
  misc_feature 1..306: note = hypo
  source 1..306: mol_type = genomic DNA
cagaggctgtggcttcgggggttcagagtggcctacaggggctgctgaccaggacaggggcctgagatggtggtagaggcgggtacgtgggcaccccgggagccagggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaaccgctctgagtcacacctgtgaggcggatgatgccacct

SEQ ID NO: 98940 - DNA, 171 bp, Homo sapiens
  misc_feature 1..171: note = chr8:143598967-143599138
  misc_feature 1..171: note = hypo
  source 1..171: mol_type = genomic DNA
tgcaaggaagctggtcgggatgtgtccgggctgtggagggacaggtgggtgtggggtgtcagggcctggctggatggcatcttggatgggggtgggccggagtcaaagcggctgctgcccccggatttctcgaagcctgggcccaagaggactgtgcgtgtgggtgggcct

SEQ ID NO: 98941 - DNA, 30 bp, Homo sapiens; identical to SEQ ID NO: 42037
  misc_feature 1..30: note = chr8:143599572-143599602
  misc_feature 1..30: note = hypo
  source 1..30: mol_type = genomic DNA

SEQ ID NO: 98942 - DNA, 30 bp, Homo sapiens
  misc_feature 1..30: note = chr8:143606129-143606159
  misc_feature 1..30: note = hypo
  source 1..30: mol_type = genomic DNA
ttgggctttccttcccgctctcctcccacc

SEQ ID NO: 98943 - DNA, 35 bp, Homo sapiens
  misc_feature 1..35: note = chr8:143609580-143609615
  misc_feature 1..35: note = hypo
  source 1..35: mol_type = genomic DNA
aaggggactggaaggcgcagcggcctccctctggg

SEQ ID NO: 98944 - DNA, 67 bp, Homo sapiens
  misc_feature 1..67: note = chr8:143616161-143616228
  misc_feature 1..67: note = hypo
  source 1..67: mol_type = genomic DNA
gctcaccctggtgcacgccacatgggccaggccctggtcccagcaatgaactcgtgttagtgaatct

SEQ ID NO: 98945 - DNA, 47 bp, Homo sapiens; identical to SEQ ID NO: 42038
  misc_feature 1..47: note = chr8:143618365-143618412
  misc_feature 1..47: note = hypo
  source 1..47: mol_type = genomic DNA

SEQ ID NO: 98946 - DNA, 88 bp, Homo sapiens
  misc_feature 1..88: note = chr8:143620736-143620824
  misc_feature 1..88: note = hypo
  source 1..88: mol_type = genomic DNA
cgacttcgagaaggacgtggatctggcctgtagatcaggtgagcgcccgacaggtgagaggacagtgccagcccggccccctgcatgg

SEQ ID NO: 98947 - DNA, 161 bp, Homo sapiens; identical to SEQ ID NO: 15189
  misc_feature 1..161: note = chr8:143621956-143622117
  misc_feature 1..161: note = hypo
  source 1..161: mol_type = genomic DNA

SEQ ID NO: 98948 - DNA, 541 bp, Homo sapiens
  misc_feature 1..541: note = chr8:143623394-143623935
  misc_feature 1..541: note = hypo
  source 1..541: mol_type = genomic DNA
cccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgc

SEQ ID NO: 98949 - DNA, 30 bp, Homo sapiens; identical to SEQ ID NO: 42043
  misc_feature 1..30: note = chr8:143624997-143625027
  misc_feature 1..30: note = hypo
  source 1..30: mol_type = genomic DNA

SEQ ID NO: 98950 - DNA, 34 bp, Homo sapiens; identical to SEQ ID NO: 42044
  misc_feature 1..34: note = chr8:143631480-143631514
  misc_feature 1..34: note = hypo
  source 1..34: mol_type = genomic DNA

SEQ ID NO: 98951 - DNA, 45 bp, Homo sapiens
  misc_feature 1..45: note = chr8:143652467-143652512
  misc_feature 1..45: note = hypo
  source 1..45: mol_type = genomic DNA
tgaggatggccacgacgctgtcccgctcctcggtgctctgaagag

SEQ ID NO: 98952 - DNA, 95 bp, Homo sapiens
  misc_feature 1..95: note = chr8:143656193-143656288
  misc_feature 1..95: note = hypo
  source 1..95: mol_type = genomic DNA
catgttcccgggactcgtgccagtcccctcctccaggaagcccctctatttgtgggccctcggggaaccccgtgcatgcccgggcagcacctcct

SEQ ID NO: 98953 - DNA, 37 bp, Homo sapiens
  misc_feature 1..37: note = chr8:143660632-143660669
  misc_feature 1..37: note = hypo
  source 1..37: mol_type = genomic DNA
gggacgtgtcactcacgcctgccggggccagagctcg

SEQ ID NO: 98954 - DNA, 40 bp, Homo sapiens
  misc_feature 1..40: note = chr8:143665380-143665420
  misc_feature 1..40: note = hypo
  source 1..40: mol_type = genomic DNA
ctgccctggggaccccgaggccttacggggtgagcacctc

SEQ ID NO: 98955 - DNA, 33 bp, Homo sapiens
  misc_feature 1..33: note = chr8:143665824-143665857
  misc_feature 1..33: note = hypo
  source 1..33: mol_type = genomic DNA
ccctggggcgcccctcggcgagggacagggccc

SEQ ID NO: 98956 - DNA, 30 bp, Homo sapiens
  misc_feature 1..30: note = chr8:143671868-143671898
  misc_feature 1..30: note = hypo
  source 1..30: mol_type = genomic DNA
ggcctgggtttccatcgccacccttccagg

SEQ ID NO: 98957 - DNA, 30 bp, Homo sapiens
  misc_feature 1..30: note = chr8:143677149-143677179
  misc_feature 1..30: note = hypo
  source 1..30: mol_type = genomic DNA
accccagcacccagacgccactgacaaggg

SEQ ID NO: 98958 - DNA, 30 bp, Homo sapiens
  misc_feature 1..30: note = chr8:143679642-143679672
  misc_feature 1..30: note = hypo
  source 1..30: mol_type = genomic DNA
gaagaaagctcagcccggctggctggcatc

SEQ ID NO: 98959 - DNA, 353 bp, Homo sapiens
  misc_feature 1..353: note = chr8:143695463-143695816
  misc_feature 1..353: note = hyper
  source 1..353: mol_type = genomic DNA
cctgcttggacacctcggccagcaggtgccggtgcgtccgccgcacgtgctccagcatctcggcccggcacttcccgatctgcaggatcacgttgggcttggccacctgcccgccccgcggcccggggtaggcgtggagcccgccgctggtccggtggtccagctccatctgtgcgcaggtgctccggcaggcggcaaactcctcggggcggacagagggtggtccggcgctggggtccggcggcctgggtcccgtgcggagctgcggggagcgcctgtctgtcgctgcgggccggcggcggggccggcggagcacgcccggggaggcaggtccggctcggctgctgcggagg

SEQ ID NO: 98960 - DNA, 30 bp, Homo sapiens; identical to SEQ ID NO: 42046
  misc_feature 1..30: note = chr8:143702052-143702082
  misc_feature 1..30: note = hypo
  source 1..30: mol_type = genomic DNA

SEQ ID NO: 98961 - DNA, 30 bp, Homo sapiens
  misc_feature 1..30: note = chr8:143704046-143704076
  misc_feature 1..30: note = hypo
  source 1..30: mol_type = genomic DNA
gcagagcctcctcctcgccaggtcccagca

SEQ ID NO: 98962 - DNA, 30 bp, Homo sapiens
  misc_feature 1..30: note = chr8:143704780-143704810
  misc_feature 1..30: note = hypo
  source 1..30: mol_type = genomic DNA
gtcctaaggtgcatccggtggcagatctgg

SEQ ID NO: 98963 - DNA, 136 bp, Homo sapiens
  misc_feature 1..136: note = chr8:143819384-143819520
  misc_feature 1..136: note = hypo
  source 1..136: mol_type = genomic DNA
tgagtgtatccagtgcgcatatggatgtgcgtgcctgtgtgcatttgtgtgtgtgtgtgtgtgtgtgcgcacgtgcacgcaggcaacgggcaagcttcaaggtggttgaatgggcagcacccgcaagcctctgggg

SEQ ID NO: 98964 - DNA, 30 bp, Homo sapiens; identical to SEQ ID NO: 42048
  misc_feature 1..30: note = chr8:143827179-143827209
  misc_feature 1..30: note = hypo
  source 1..30: mol_type = genomic DNA

SEQ ID NO: 98965 - DNA, 45 bp, Homo sapiens
  misc_feature 1..45: note = chr8:143831792-143831837
  misc_feature 1..45: note = hypo
  source 1..45: mol_type = genomic DNA
tattgcagcaggacacgggcagggtctggccgatgccatccacat

SEQ ID NO: 98966 - DNA, 61 bp, Homo sapiens; identical to SEQ ID NO: 42049
  misc_feature 1..61: note = chr8:143833212-143833273
  misc_feature 1..61: note = hypo
  source 1..61: mol_type = genomic DNA

SEQ ID NO: 98967 - DNA, 30 bp, Homo sapiens
  misc_feature 1..30: note = chr8:143840647-143840677
  misc_feature 1..30: note = hypo
  source 1..30: mol_type = genomic DNA
ggaggcttcatctgacgataaaaccctggt

SEQ ID NO: 98968 - DNA, 30 bp, Homo sapiens
  misc_feature 1..30: note = chr8:1438482-1438512
  misc_feature 1..30: note = hypo
  source 1..30: mol_type = genomic DNA
gcggggttgaaaaggcgcctgtggagaagg

SEQ ID NO: 98969 - DNA, 30 bp, Homo sapiens
  misc_feature 1..30: note = chr8:143855362-143855392
  misc_feature 1..30: note = hypo
  source 1..30: mol_type = genomic DNA
ctgggctacctgcatcggggatggattggt

SEQ ID NO: 98970 - DNA, 159 bp, Homo sapiens
  misc_feature 1..159: note = chr8:143855667-143855826
  misc_feature 1..159: note = hypo
  source 1..159: mol_type = genomic DNA
aacccccagcctgtgcgcgcatcccccagtcctgcgtcttttgccttgctcggctgggtcctgctgtggttggggaccaggactcgggggaccacctgctctgcccctttccctccctgcccagaatagcgctggccgggtcagcgtccaggacccacc

SEQ ID NO: 98971 - DNA, 30 bp, Homo sapiens
  misc_feature 1..30: note = chr8:143857179-143857209
  misc_feature 1..30: note = hypo
  source 1..30: mol_type = genomic DNA
atcaggcccccagcccgtcaccttccccgg

SEQ ID NO: 98972 - DNA, 217 bp, Homo sapiens
  misc_feature 1..217: note = chr8:143858535-143858752
  misc_feature 1..217: note = hyper
  source 1..217: mol_type = genomic DNA
accgtgaggtaccgccgcgcctgggagtcacccgcggccgctcgccggtaggtgcctgcctgagtctaatcgtaggcgtgtctgtgtgtcccgcagcacccgtgccgcatcgcctgatgctcaccgcaggcccagcccagtcccgcccccggaacagcccgcccagcgcgagctcaccgcaggccccgccccaggcctgccccggccccacctcctg

SEQ ID NO: 98973 - DNA, 154 bp, Homo sapiens
  misc_feature 1..154: note = chr8:143859127-143859281
  misc_feature 1..154: note = hyper
  source 1..154: mol_type = genomic DNA
acacagaggcagccacgcagtgattccctggcgaccctcagactcacgtgttcagcccggacactccgcaggctatcttcaccgcgtcccgcggcagcccagccttccccgcagccgcctccgcccactcgcccgcgccgcgtcgtttgtcggc

SEQ ID NO: 98974 - DNA, 24 bp, Homo sapiens
  misc_feature 1..24: note = chr8:143859337-143859361
  misc_feature 1..24: note = hyper
  source 1..24: mol_type = genomic DNA
cggaactggcgccctttggcgcac

SEQ ID NO: 98975 - DNA, 124 bp, Homo sapiens
  misc_feature 1..124: note = chr8:143870853-143870977
  misc_feature 1..124: note = hypo
  source 1..124: mol_type = genomic DNA
gctcagagagggaagcgcctggcttagggcggcacagcaccgtactccaggcttgcaccagcccagccctgggccctgtcctggctgaatgggtgcctggtggacaaggcggggccccgggctg

SEQ ID NO: 98976 - DNA, 74 bp, Homo sapiens
  misc_feature 1..74: note = chr8:143876922-143876996
  misc_feature 1..74: note = hypo
  source 1..74: mol_type = genomic DNA
agtgcttctttagcacgggcacgggctcgggagaccagtggcaggctgggtgggggcagcggccccgggaggct

SEQ ID NO: 98977 - DNA, 33 bp, Homo sapiens; identical to SEQ ID NO: 42052
  misc_feature 1..33: note = chr8:143879185-143879218
  misc_feature 1..33: note = hypo
  source 1..33: mol_type = genomic DNA

SEQ ID NO: 98978 - DNA, 182 bp, Homo sapiens
  misc_feature 1..182: note = chr8:143882149-143882331
  misc_feature 1..182: note = hypo
  source 1..182: mol_type = genomic DNA
ctcccaggagggctgcgttttccaggcttccacatacacgccacctgctctctcctgctattttaaacgggcaccctttggtttaaactgtaaagccccttcttggccctattttggcaatactgctggggagctgcggggcttcctctaacactcgcagaaagatgcgatgatgaacgtag

SEQ ID NO: 98979 - DNA, 30 bp, Homo sapiens
  misc_feature 1..30: note = chr8:143921405-143921435
  misc_feature 1..30: note = hypo
  source 1..30: mol_type = genomic DNA
agctgtgtgtgggagcgggaagcgcgtcag

SEQ ID NO: 98980 - DNA, 123 bp, Homo sapiens
  misc_feature 1..123: note = chr8:143956397-143956520
  misc_feature 1..123: note = hypo
  source 1..123: mol_type = genomic DNA
gcctctgccaggcgccgcccaaggcactggcgcatgccaaagccaaagggcacgtggtagaagttcctgccggagcccctgatgtctagccagcgctgggggttatagcgctcaggcctcggg

SEQ ID NO: 98981 - DNA, 129 bp, Homo sapiens
  misc_feature 1..129: note = chr8:143956795-143956924
  misc_feature 1..129: note = hypo
  source 1..129: mol_type = genomic DNA
tcctaccgaagaacccgcagaggtcccagatccatgggaagcccaggtcgtaggaagtgcttccttgcacctgctgagcccggccaaacctcccctaacttaagcagccccgagcgcagaaggacatgc

SEQ ID NO: 98982 - DNA, 173 bp, Homo sapiens
  misc_feature 1..173: note = chr8:143960027-143960200
  misc_feature 1..173: note = hypo
  source 1..173: mol_type = genomic DNA
ccctgagggaggctgcggccccggcgaacaccaggctcagtactcagcctgtgacctgggccagtgggagtacccttctcagggcctcagttttctgacctatgggaaggacagtccccagaccgcaagagaaagcatcggccaaggttggtgcagagcgggttctcactaca

SEQ ID NO: 98983 - DNA, 247 bp, Homo sapiens
  misc_feature 1..247: note = chr8:143993967-143994214
  misc_feature 1..247: note = hypo
  source 1..247: mol_type = genomic DNA
tctgcctctgccaggcgccgcccgaggcactggcgcatgccaaagccaaagggcacgtggtggaagttcctgccggagcccctgatgtctagccagcgctggggattataccgctcaggcctcgggaacaaggcggcattgcgacccagcgagtagaggaaaacctgtaccaatgtctgcggacggtgcagagcagggatcagggaatgactggggagggaggttctcagctcgaggggtgtggggc

SEQ ID NO: 98984 - DNA, 33 bp, Homo sapiens
  misc_feature 1..33: note = chr8:143994764-143994797
  misc_feature 1..33: note = hypo
  source 1..33: mol_type = genomic DNA
cactgatgctggctgcggcggccaggctctcct

SEQ ID NO: 98985 - DNA, 159 bp, Homo sapiens
  misc_feature 1..159: note = chr8:143996499-143996658
  misc_feature 1..159: note = hypo
  source 1..159: mol_type = genomic DNA
agggtcaggctcccccgggcgttctgcagcaccttcttcttcagggcctgggagaagtccctggccactgcatccaccatcgggaggaacctctgcacggccttgggcgacagcacatctgggttcagccgcaatcggttgaagcgccattcaggccca

SEQ ID NO: 98986 - DNA, 32 bp, Homo sapiens
  misc_feature 1..32: note = chr8:143998295-143998327
  misc_feature 1..32: note = hypo
  source 1..32: mol_type = genomic DNA
aacccacagtgcagacgcgaccccacaggatg

SEQ ID NO: 98987 - DNA, 33 bp, Homo sapiens; identical to SEQ ID NO: 42057
  misc_feature 1..33: note = chr8:144015246-144015279
  misc_feature 1..33: note = hypo
  source 1..33: mol_type = genomic DNA

SEQ ID NO: 98988 - DNA, 175 bp, Homo sapiens
  misc_feature 1..175: note = chr8:144027680-144027855
  misc_feature 1..175: note = hypo
  source 1..175: mol_type = genomic DNA
cacgcctccccaccacggcaccaggggccggcagtgctgctgtctgcttctccctagggtgcatcaccctcagctcagccaccatcgcaaaggccacaggccaggtgccagaatggcagctgtgtgcgtctcacagctctggagctgggaagtccaagatcgaggtagcagcagg

SEQ ID NO: 98989 - DNA, 119 bp, Homo sapiens
  misc_feature 1..119: note = chr8:144058296-144058415
  misc_feature 1..119: note = hypo
  source 1..119: mol_type = genomic DNA
aatccactggcacctcgatgaagcagaaagcaggacttagccagacactggatccaccggcacctcgatgaagcaggaagcaggacttagccagacacgggatccgccagcgcctcgat

SEQ ID NO: 98990 - DNA, 119 bp, Homo sapiens
  misc_feature 1..119: note = chr8:144069546-144069665
  misc_feature 1..119: note = hypo
  source 1..119: mol_type = genomic DNA
cgccatgtggacttccgatgaaccctagttctgggtccttaggtcaaaacaaccttaatgttattgtaaacacaaaatcctgcccttaagcgagttacaggctgcggtgcaggtggcat

SEQ ID NO: 98991 - DNA, 151 bp, Homo sapiens; identical to SEQ ID NO: 42060
  misc_feature 1..151: note = chr8:144070508-144070659
  misc_feature 1..151: note = hypo
  source 1..151: mol_type = genomic DNA

SEQ ID NO: 98992 - DNA, 61 bp, Homo sapiens
  misc_feature 1..61: note = chr8:144090641-144090702
  misc_feature 1..61: note = hypo
  source 1..61: mol_type = genomic DNA
gttgtctctgcccctcggtggcagctgtttcacctggctacgttgtcggctgtcttccaac

SEQ ID NO: 98993 - DNA, 143 bp, Homo sapiens
  misc_feature 1..143: note = chr8:144099550-144099693
  misc_feature 1..143: note = hyper
  source 1..143: mol_type = genomic DNA
gctcacacccaaacacgtctgctcacccgtgggcttcccaccccgaacacaacgaggactgtccaggtgtcagtgacggtcaccccgacctggtcccctgtccggcctcgccaggtcagcacccgccgcgcgcacagcagggc

SEQ ID NO: 98994 - DNA, 128 bp, Homo sapiens; identical to SEQ ID NO: 42062
  misc_feature 1..128: note = chr8:144164496-144164624
  misc_feature 1..128: note = hypo
  source 1..128: mol_type = genomic DNA

SEQ ID NO: 98995 - DNA, 186 bp, Homo sapiens
  misc_feature 1..186: note = chr8:144190312-144190498
  misc_feature 1..186: note = hypo
  source 1..186: mol_type = genomic DNA
aacacgacaaactagcgtccaagatggagcggcttcggcctccatgatccgcccgcgccgccccactaatccagctctgaccgtctcacctgccctcctcttccgcgatggtccctgagccttagggagggtgcttggggttgtctggcttcagcagcggtgccttggcgtcggaaaacaggtcgg

SEQ ID NO: 98996 - DNA, 264 bp, Homo sapiens
  misc_feature 1..264: note = chr8:144203678-144203942
  misc_feature 1..264: note = hypo
  source 1..264: mol_type = genomic DNA
aaataaaggtgtgaccgggagaagagtggggaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 98997 - DNA, 30 bp, Homo sapiens
  misc_feature 1..30: note = chr8:144204525-144204555
  misc_feature 1..30: note = hypo
  source 1..30: mol_type = genomic DNA
cccttacatgtaacacgctcacacatgcac

SEQ ID NO: 98998 - DNA, 134 bp, Homo sapiens
  misc_feature 1..134: note = chr8:144208693-144208827
  misc_feature 1..134: note = hypo
  source 1..134: mol_type = genomic DNA
tgcaacgccccttcccggcagcacccacgggtattggaggagtggtaggggatgggggaaggaagcttgggtgggtgggtcattggaactcttgtgcatggaagagcgttagatgatcccgacaccagaaaagt

SEQ ID NO: 98999 - DNA, 42 bp, Homo sapiens
  misc_feature 1..42: note = chr8:144209468-144209510
  misc_feature 1..42: note = hypo
  source 1..42: mol_type = genomic DNA
ggcccctgcatcaggcggtcccccagccggcagagcaggctg

SEQ ID NO: 99000 - DNA, 61 bp, Homo sapiens
  misc_feature 1..61: note = chr8:144216486-144216547
  misc_feature 1..61: note = hypo
  source 1..61: mol_type = genomic DNA
aaacacactttctcacgtgcacagaaaacacagactgtcgctgacgcgggataggtaaggt

SEQ ID NO: 99001 - DNA, 42 bp, Homo sapiens
  misc_feature 1..42: note = chr8:144222920-144222962
  misc_feature 1..42: note = hypo
  source 1..42: mol_type = genomic DNA
ggagtacaggcgtgaggcactgcgccccgcctccattttgca

SEQ ID NO: 99002 - DNA, 218 bp, Homo sapiens
  misc_feature 1..218: note = chr8:144226037-144226255
  misc_feature 1..218: note = hypo
  source 1..218: mol_type = genomic DNA
gagtttcatgaagtccgtaaagctgtatttttcctgtcgcatttctataaagcattgtaaagtgacttatgtcagagcattggctcgatgtggtcttctgggacccccttgtgtacttggctcagcgctgcccgcacatgcccacgctgctccgtactgtggcttgctcaccgccgtgtgcaatgttcctttgcgtgtcacagcgcttccttaaccca

SEQ ID NO: 99003 - DNA, 41 bp, Homo sapiens
  misc_feature 1..41: note = chr8:144236655-144236696
  misc_feature 1..41: note = hypo
  source 1..41: mol_type = genomic DNA
ggcatctcagatcaacgggcgaaaggcgggttgtttaataa

SEQ ID NO: 99004 - DNA, 249 bp, Homo sapiens
  misc_feature 1..249: note = chr8:144238806-144239055
  misc_feature 1..249: note = hypo
  source 1..249: mol_type = genomic DNA
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgtttgtgggcgtgtctggtgtctg

SEQ ID NO: 99005 - DNA, 235 bp, Homo sapiens
  misc_feature 1..235: note = chr8:144241199-144241434
  misc_feature 1..235: note = hyper
  source 1..235: mol_type = genomic DNA
cccggaatccaaggccggggtccgcccggagctcgcagagccccacccccagccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 99006 - DNA, 87 bp, Homo sapiens; identical to SEQ ID NO: 3378
  misc_feature 1..87: note = chr8:144241435-144241522
  misc_feature 1..87: note = hyper
  source 1..87: mol_type = genomic DNA

SEQ ID NO: 99007 - DNA, 120 bp, Homo sapiens; identical to SEQ ID NO: 32313
  misc_feature 1..120: note = chr8:144241583-144241703
  misc_feature 1..120: note = hyper
  source 1..120: mol_type = genomic DNA

SEQ ID NO: 99008 - DNA, 546 bp, Homo sapiens
  misc_feature 1..546: note = chr8:144241757-144242303
  misc_feature 1..546: note = hyper
  source 1..546: mol_type = genomic DNA
cggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctgagcatccatgaagacccccaccagaagccgcagccccaggggcttctgtcgccaaatactccca

SEQ ID NO: 99009 - DNA, 30 bp, Homo sapiens
  misc_feature 1..30: note = chr8:144275059-144275089
  misc_feature 1..30: note = hypo
  source 1..30: mol_type = genomic DNA
cccagagctcaaaatcgcccaaactagcca

SEQ ID NO: 99010 - DNA, 104 bp, Homo sapiens
  misc_feature 1..104: note = chr8:144291486-144291590
  misc_feature 1..104: note = hypo
  source 1..104: mol_type = genomic DNA
ccaaacccaatctcacggcaggctgcctcccagagatggcagtgcacaggtctggatctgactcgagctggtgtcaacacgggggagggcgtacagagtaggac

SEQ ID NO: 99011 - DNA, 125 bp, Homo sapiens
  misc_feature 1..125: note = chr8:144292345-144292470
  misc_feature 1..125: note = hypo
  source 1..125: mol_type = genomic DNA
acccactagcctttccggggcgggacagagggaacagcctctcagtggcgagcactaaatttaattcaatctgcgaatcaaatgtgctctgattgtccctaggtgattctcgcaataagcacttg

SEQ ID NO: 99012 - DNA, 317 bp, Homo sapiens
  misc_feature 1..317: note = chr8:144293576-144293893
  misc_feature 1..317: note = hypo
  source 1..317: mol_type = genomic DNA
gtgggggaggcgggccgagggcgagagggcgcagggaggcgggtgggggtggggccacgcgcggaggggcagggaagggcggggcggggcggggcgggacggggctgggggggacaggcatcaggtatgaagagtttggggctggcggggcgtgtccggctgtggcgtgggcaccactatgggagaccctggcttggcaagtgaccttgcagccttggctggggaagggctagatgctgggtgggtgccggtagagtggaaagaatgacaggttcaggtgaattaaggaaggatggttgactcggtggctgggacat

SEQ ID NO: 99013 - DNA, 39 bp, Homo sapiens
  misc_feature 1..39: note = chr8:144303553-144303592
  misc_feature 1..39: note = hypo
  source 1..39: mol_type = genomic DNA
atgggtacggggcaccgggggaggcggccagtgccttag

SEQ ID NO: 99014 - DNA, 147 bp, Homo sapiens; identical to SEQ ID NO: 42070
  misc_feature 1..147: note = chr8:144312859-144313006
  misc_feature 1..147: note = hypo
  source 1..147: mol_type = genomic DNA

SEQ ID NO: 99015 - DNA, 30 bp, Homo sapiens
  misc_feature 1..30: note = chr8:144322593-144322623
  misc_feature 1..30: note = hypo
  source 1..30: mol_type = genomic DNA
ctgtgcccaggatgccgggaggatctcagc

SEQ ID NO: 99016 - DNA, 214 bp, Homo sapiens; identical to SEQ ID NO: 42071
  misc_feature 1..214: note = chr8:144326825-144327039
  misc_feature 1..214: note = hypo
  source 1..214: mol_type = genomic DNA

SEQ ID NO: 99017 - DNA, 434 bp, Homo sapiens
  misc_feature 1..434: note = chr8:144328173-144328607
  misc_feature 1..434: note = hyper
  source 1..434: mol_type = genomic DNA
agtgagcacagccagcggctgggagcacatcccggaggggctgcctgcggcgggaggagcggcaggggccacgtggtgggggacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgggcgcagcctacgtgacagggtcggctcgggaccgag

SEQ ID NO: 99018 - DNA, 149 bp, Homo sapiens; identical to SEQ ID NO: 42072
  misc_feature 1..149: note = chr8:144330269-144330418
  misc_feature 1..149: note = hypo
  source 1..149: mol_type = genomic DNA

SEQ ID NO: 99019 - DNA, 511 bp, Homo sapiens; identical to SEQ ID NO: 42073
  misc_feature 1..511: note = chr8:144343481-144343992
  misc_feature 1..511: note = hypo
  source 1..511: mol_type = genomic DNA

SEQ ID NO: 99020 - DNA, 519 bp, Homo sapiens
  misc_feature 1..519: note = chr8:144344219-144344738
  misc_feature 1..519: note = hypo
  source 1..519: mol_type = genomic DNA
ccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgactt

SEQ ID NO: 99021 - DNA, 37 bp, Homo sapiens
  misc_feature 1..37: note = chr8:144347022-144347059
  misc_feature 1..37: note = hypo
  source 1..37: mol_type = genomic DNA
ggtgactcagcttcccgtgatgcgctggatgcacagg

SEQ ID NO: 99022 - DNA, 30 bp, Homo sapiens
  misc_feature 1..30: note = chr8:144350950-144350980
  misc_feature 1..30: note = hypo
  source 1..30: mol_type = genomic DNA
gctgtgccgcccaggcggtggctgcttcct

SEQ ID NO: 99023 - DNA, 516 bp, Homo sapiens
  misc_feature 1..516: note = chr8:144360029-144360545
  misc_feature 1..516: note = hypo
  source 1..516: mol_type = genomic DNA
ttccagaagagaacccggaggctccgaggtgacgtgtggcttgctcgagatcacacgatcagtgacggcaccagatgaatccctgagctccctgaccagccatccacccaggcccctgctgagacagcgggacctcgtttccaactcagaagcccccggaacgcggctgcccggcttgggagcctgcggcacagggccctgtgcagccccttggggaagacggccccaggctctgccagcccccgccaccctctccagaccatgctctgggggccctatggccaccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctccttgttcagtaacacgcgtgggcagccaggccgaggtgctggctct

SEQ ID NO: 99024 - DNA, 203 bp, Homo sapiens
  misc_feature 1..203: note = chr8:144361658-144361861
  misc_feature 1..203: note = hypo
  source 1..203: mol_type = genomic DNA
cctctctctcctccccgaagtgaccagggatcttcctaaagatcccatggtatctgggagccaaggtttgggatctgccagccctgattccataacccacacttatccttcctcacggagcctgtttctgcctctgacaatggtggttagcgcagcccgctccgcaccgcacatggcggctgcaaggacggcatgggtggggt

SEQ ID NO: 99025 - DNA, 55 bp, Homo sapiens
  misc_feature 1..55: note = chr8:1443699-1443754
  misc_feature 1..55: note = hypo
  source 1..55: mol_type = genomic DNA
ctggcccggcgaggtcggtgtgctgagaccacagtgtgctcgggtcacagtggtg

SEQ ID NO: 99026 - DNA, 15 bp, Homo sapiens
  misc_feature 1..15: note = chr8:144371132-144371147
  misc_feature 1..15: note = hypo
  source 1..15: mol_type = genomic DNA
cggcctggactcggc

SEQ ID NO: 99027 - DNA, 40 bp, Homo sapiens
  misc_feature 1..40: note = chr8:144372463-144372503
  misc_feature 1..40: note = hypo
  source 1..40: mol_type = genomic DNA
gctgggattacattcatgagcctctcgcccacccagtcta

SEQ ID NO: 99028 - DNA, 30 bp, Homo sapiens
  misc_feature 1..30: note = chr8:144380615-144380645
  misc_feature 1..30: note = hypo
  source 1..30: mol_type = genomic DNA
ctcaggtaccagtagcggtcaaagcacctg

SEQ ID NO: 99029 - DNA, 92 bp, Homo sapiens
  misc_feature 1..92: note = chr8:144383315-144383407
  misc_feature 1..92: note = hypo
  source 1..92: mol_type = genomic DNA
attttcccccagaaccgagaaacatgaatctccagagtaaaagcacctaccgatatctcgcacaaagatggaaggaacgacctacatccagg

SEQ ID NO: 99030 - DNA, 35 bp, Homo sapiens; identical to SEQ ID NO: 42080
  misc_feature 1..35: note = chr8:144386583-144386618
  misc_feature 1..35: note = hypo
  source 1..35: mol_type = genomic DNA

SEQ ID NO: 99031 - DNA, 30 bp, Homo sapiens
  misc_feature 1..30: note = chr8:144400398-144400428
  misc_feature 1..30: note = hypo
  source 1..30: mol_type = genomic DNA
catcctcccgtgacacggcccccaccctcc

SEQ ID NO: 99032 - DNA, 30 bp, Homo sapiens
  misc_feature 1..30: note = chr8:144413752-144413782
  misc_feature 1..30: note = hypo
  source 1..30: mol_type = genomic DNA
ccaagcccagctaagcgggaaagggcaagc

SEQ ID NO: 99033 - DNA, 35 bp, Homo sapiens
  misc_feature 1..35: note = chr8:144414248-144414283
  misc_feature 1..35: note = hypo
  source 1..35: mol_type = genomic DNA
gggggacacagccagcgtggcggctacagcccatc

SEQ ID NO: 99034 - DNA, 30 bp, Homo sapiens; identical to SEQ ID NO: 42081
  misc_feature 1..30: note = chr8:144452062-144452092
  misc_feature 1..30: note = hypo
  source 1..30: mol_type = genomic DNA

SEQ ID NO: 99035 - DNA, 99 bp, Homo sapiens
  misc_feature 1..99: note = chr8:144457736-144457835
  misc_feature 1..99: note = hypo
  source 1..99: mol_type = genomic DNA
gacgcagatccagtgcggccagctgcagagccgcagggcccagattcaccagcagattgacaaggagctgcagatgcggacgggcgctgagaacctcta

SEQ ID NO: 99036 - DNA, 30 bp, Homo sapiens
  misc_feature 1..30: note = chr8:144462244-144462274
  misc_feature 1..30: note = hypo
  source 1..30: mol_type = genomic DNA
agagctccccacgcacgagcaggtcttcct

SEQ ID NO: 99037 - DNA, 30 bp, Homo sapiens
  misc_feature 1..30: note = chr8:144463829-144463859
  misc_feature 1..30: note = hypo
  source 1..30: mol_type = genomic DNA
cgcttcggggagactcgcctgtcctcatcg

SEQ ID NO: 99038 - DNA, 30 bp, Homo sapiens
  misc_feature 1..30: note = chr8:144469769-144469799
  misc_feature 1..30: note = hypo
  source 1..30: mol_type = genomic DNA
aggtgtgagccaccacgcccatcctccgag

SEQ ID NO: 99039 - DNA, 30 bp, Homo sapiens
  misc_feature 1..30: note = chr8:144470566-144470596
  misc_feature 1..30: note = hypo
  source 1..30: mol_type = genomic DNA
cgctgcacctccaggcgagcatggtgtgga

SEQ ID NO: 99040 - DNA, 210 bp, Homo sapiens
  misc_feature 1..210: note = chr8:144471625-144471835
  misc_feature 1..210: note = hypo
  source 1..210: mol_type = genomic DNA
cccccacacccccttcggcccctagaccgtgcgccagacatgcattaaggcaggagtgacttatcgagctgtcagggggagcgttttaagacagaattataggggagaggaaaaagatttttaccaaattaatgaaaaatcaatgtggcctcaaaaatccattagccttcataatgcgctggttccaggctgagccgcataatccgatgc

SEQ ID NO: 99041 - DNA, 30 bp, Homo sapiens
  misc_feature 1..30: note = chr8:144474879-144474909
  misc_feature 1..30: note = hypo
  source 1..30: mol_type = genomic DNA
gggtgctcccacctgcgttgagttggggag

SEQ ID NO: 99042 - DNA, 502 bp, Homo sapiens
  misc_feature 1..502: note = chr8:144489693-144490195
  misc_feature 1..502: note = hyper
  source 1..502: mol_type = genomic DNA
ccccaccctccaggtcggggcagccccgggcaccgacggtggcagtcggcgtgtcacctctcctgccatccgcagggcgcagcgggcacgtggcccctccagataagcagagcccggggccccaactcgcttcctcatggcgggcggggggcagccccaggcggcgccatctgacgcccccgccctgcgcgctcctaccccccacgtccgctgccgtctgtcggtcgtggagccgcgctaggccacggggtcccggccagacgggagcgccagcccctccccctgtcccgatgtccccaaacccaggctcagcccctccctccccgacccgatgacacccctgggtcctagaatgctgctgggggcgggagaccggagaagaagcaggtgcacggggaggtgggtgtcctgccctctgcgaggagcccaccccctggaccttctcctagcgctaagatcgggttcaagcaccaaacccgtcccgcctcgcccaggtccccgg

SEQ ID NO: 99043 - DNA, 346 bp, Homo sapiens
  misc_feature 1..346: note = chr8:144503380-144503726
  misc_feature 1..346: note = hyper
  source 1..346: mol_type = genomic DNA
tgcaattcatcttcccgtctctcttcccatacctgagcctcgtgccgcccgggattgcggcgcccgcgccaccacgctggggtaatggtcccagcaccgctgccctgcgtcctgccgcgccccagcccgcgcgtctcacacaccgcgactgcgtgtctacaggtgccgcctcttgacgcctctgctgcaccgccagtgccccgctcggcaaagcacagcccctccccagcactgcagcaaatgggcaggagacccccgcccggccgggggagcaggggcaacggcagggccccagtagagagggtggagctggagccgaggccgggccaggcgcctgcggggccta

SEQ ID NO: 99044 - DNA, 30 bp, Homo sapiens
  misc_feature 1..30: note = chr8:144508721-144508751
  misc_feature 1..30: note = hyper
  source 1..30: mol_type = genomic DNA
aagcagggggacagacgaaagagagaaaga

SEQ ID NO: 99045 - DNA, 3353 bp, Homo sapiens
  misc_feature 1..3353: note = chr8:144509019-144512372
  misc_feature 1..3353: note = hyper
  source 1..3353: mol_type = genomic DNA
acacagctccctgcccgccgctcccaccccaaaaaggccgcctctgatccaggctgccagaagtcgctgggtcctgtactttctcggccagggaaaggctctgtgcaaagggctcctgggggcggcgatggtgaaaactaaggtgtcccatgtcctctgctctttacaacttcggactatgaaaaacgagccagcagattcccgtccaagaatgtgcccaaggctccccgcccctccttggggagagatggcctgtgtaagcgaaggcccgggccgggcggctgagccacccgtggctgcctggaacccgcctgtccctgccggcgtagtcttttcaactccatcttccgccccacatttctgtaattcccaccagcattctcctccacagagatgccttcacggccagctcccctgctgggattctgcttgaactcccgcagagacccaaaagcaaagggggaggcggcagggactgacggaggactcgccttcctctcttcctccaggtctctccgcttgaaacgataaaacaaactcaggagactcactcacagaggattccgtcccgtccccagaaagaacctccgcttacccccgatggaaaagcagcacagccccctcccaagaaaggcgagtttggaagcccttgcaggccagaagccctctctccaaatttgcaaaccacggaccctcgcctgcctctcttccggcagtgaagggagggaaccatcaacgacgtgtcctgcagccgccctgggccctgtgaactgagatttctggggtactgcctcctcccctgtgctcccagtccatgcccagccagccgttcagaggagcaagggtaggctgcgccttcaggtgggagacgggcagactccgagggctggggacagttctggccaccaggatgcagcggtgtgtcccaccaaggacacctcctgccctgcacccccagcctgcctcagtgactctccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgcgccgtggtgcgcgccgtggtggccgctgccgatgagcgcctccaccgcgtcctcgggcgtcaggttgagcgcctcggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 99046 - DNA, 30 bp, Homo sapiens
  misc_feature 1..30: note = chr8:144516420-144516450
  misc_feature 1..30: note = hypo
  source 1..30: mol_type = genomic DNA
tgtgccaccaggcatcgtcaggctgttggc

SEQ ID NO: 99047 - DNA, 30 bp, Homo sapiens
  misc_feature 1..30: note = chr8:144519943-144519973
  misc_feature 1..30: note = hypo
  source 1..30: mol_type = genomic DNA
gttgccaatggcagtcggggacaggcctgg

SEQ ID NO: 99048 - DNA, 142 bp, Homo sapiens
  misc_feature 1..142: note = chr8:144521622-144521764
  misc_feature 1..142: note = hypo
  source 1..142: mol_type = genomic DNA
gtttacagaaagggtcgtttgcagccataaaatcctcttttctctcctaaacaaggctgagtggagccatttaccaagccccaaatgctcatcgggggagagggaacatctgttctctccaggagtgcgtggtgatcttcca

SEQ ID NO: 99049 - DNA, 30 bp, Homo sapiens
  misc_feature 1..30: note = chr8:144523644-144523674
  misc_feature 1..30: note = hypo
  source 1..30: mol_type = genomic DNA
agcacagagggagcccgggaaggtgggtgt

SEQ ID NO: 99050 - DNA, 77 bp, Homo sapiens
  misc_feature 1..77: note = chr8:144552565-144552642
  misc_feature 1..77: note = hypo
  source 1..77: mol_type = genomic DNA
atgagggtcttggtgcggagggaccaacgcgggggtgctcagggcagcccccgttctcaggccgggacccttgtccc

SEQ ID NO: 99051 - DNA, 241 bp, Homo sapiens
  misc_feature 1..241: note = chr8:144573164-144573405
  misc_feature 1..241: note = hypo
  source 1..241: mol_type = genomic DNA
gcacccaggtagcgccgggtgacaaggacattttatttcttcctgtcaggggtggtttttcagtttccaggaatgtccatgcttgcccctccctccagggagcccaggcaccaactggcagacacacacatatccacggctgggcagatggggcaggagggcccaggcacagggggctccgccctccccggcctgaggggaattccacggatcccacaggaacccccggggggcccttgag

SEQ ID NO: 99052 - DNA, 105 bp, Homo sapiens
  misc_feature 1..105: note = chr8:144589977-144590082
  misc_feature 1..105: note = hypo
  source 1..105: mol_type = genomic DNA
gagaggcgaggccggcgtcttcttgacaatgcggtagcgggtcttgatcaccttgctggtgggtgcagtccgcacggcatgcaggctggacgctgtagagaaaac

SEQ ID NO: 99053 - DNA, 98 bp, Homo sapiens
  misc_feature 1..98: note = chr8:144591105-144591203
  misc_feature 1..98: note = hypo
  source 1..98: mol_type = genomic DNA
ttccagagccctaaacgcaacggaccttgagcagccagggcccctccttgaggccgagcttctagcccatctctccacagactcgctcactctcctgc

SEQ ID NO: 99054 - DNA, 137 bp, Homo sapiens
  misc_feature 1..137: note = chr8:144636432-144636569
  misc_feature 1..137: note = hypo
  source 1..137: mol_type = genomic DNA
atataaatgcagatgcgtgcctgcatcaacgagcgggagcacattgggcaaatgcacgtgtacatgccctacgtgaacacaaacccgtggacacaacacgcacgtgcatgcacccgcacacagacacgcgcacaaac

SEQ ID NO: 99055 - DNA, 197 bp, Homo sapiens
  misc_feature 1..197: note = chr8:144636689-144636886
  misc_feature 1..197: note = hypo
  source 1..197: mol_type = genomic DNA
ctcacgtgcacaaacgcacacaacacgcacgtgcatacacgcgcgcaaacgcacacaacacgcacgtgcatacacgcgcacaacgcgcacacaacactcaggtgcataaacgcgcgcaaacgcacaacacacacgtgcatacacacgtgcacaaacacgctcaacacgcacgtgcaagcacccgcatacaaacaggc

SEQ ID NO: 99056 - DNA, 261 bp, Homo sapiens
  misc_feature 1..261: note = chr8:144650869-144651130
  misc_feature 1..261: note = hyper
  source 1..261: mol_type = genomic DNA
gcgcggattgagtcccgtgtctgcgtgggagggcgcagtcagggcaggcggagacagagaggggctgcaagggtgggagggggcggccagcgcggagcgaggaagcggcgggtctagggaaggctgctgactcggtgtgatctggggacagggaacagggcctggagctggacctggttgggaagcctggagagcccctgcagggggtggggcttgaagggatggggtccggaaggaaaagtcgagcggggaggagcttgg

SEQ ID NO: 99057 - DNA, 65 bp, Homo sapiens
  misc_feature 1..65: note = chr8:144651594-144651659
  misc_feature 1..65: note = hyper
  source 1..65: mol_type = genomic DNA
cggggcgtttgctcacgtcgtccagtagcggagggaggcgcggtcccagctccgcgctcaggagc

SEQ ID NO: 99058 - DNA, 293 bp, Homo sapiens
  misc_feature 1..293: note = chr8:144651706-144651999
  misc_feature 1..293: note = hyper
  source 1..293: mol_type = genomic DNA
cgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccgg

SEQ ID NO: 99059 - DNA, 199 bp, Homo sapiens
  misc_feature 1..199: note = chr8:144653759-144653958
  misc_feature 1..199: note = hyper
  source 1..199: mol_type = genomic DNA
ggggccagactccaccgccaagcgggaagagggaaggaagccgcgtggggaccgcagggccaggacggttgggttaccgatcggcgggcagagagcggggtagcagcgcacacaccacgtcccgcgcatgctccagggccagtgcgctcagcactcgcagggccgccctccagggcctcccctccgctaggctgggcac

SEQ ID NO: 99060 - DNA, 175 bp, Homo sapiens; identical to SEQ ID NO: 42087
  misc_feature 1..175: note = chr8:144656770-144656945
  misc_feature 1..175: note = hypo
  source 1..175: mol_type = genomic DNA

SEQ ID NO: 99061 - DNA, 83 bp, Homo sapiens
  misc_feature 1..83: note = chr8:144658208-144658291
  misc_feature 1..83: note = hypo
  source 1..83: mol_type = genomic DNA
cccccagccaccctccgcctacccactcatccaccccacctcctgggccagtcgggccagcgcctcctcgtcaatgttgttgc

SEQ ID NO: 99062 - DNA, 30 bp, Homo sapiens
  misc_feature 1..30: note = chr8:144661901-144661931
  misc_feature 1..30: note = hypo
  source 1..30: mol_type = genomic DNA
gtctcagtctttaatcgtggcagggcctca

SEQ ID NO: 99063 - DNA, 378 bp, Homo sapiens
  misc_feature 1..378: note = chr8:144668612-144668990
  misc_feature 1..378: note = hypo
  source 1..378: mol_type = genomic DNA
tgcctgaggctgtgacgacaggcaaaggcgcccatgtctgcgggggaaggagtgccaggcctggccccacaccaagtgcacaggcgccggcaggagggccctgagcagacccggcccgggggcccggccaaggccgcctgccccgagaccccactcccagcacccacagcagagccactgggccagggtgcctctgccttcctggcctggctgaatccgctttgtgtgccccggccactcctgtcgggcagcagagccgcccagccgccccacgtgcagctctcacctggcgggaggcacctgccacaggcccgttcatctgctcgtagaatctcctttctgcgtcgtcatatttgaacttgtcgaaccagatcttct

SEQ ID NO: 99064 - DNA, 119 bp, Homo sapiens
  misc_feature 1..119: note = chr8:144675999-144676118
  misc_feature 1..119: note = hypo
  source 1..119: mol_type = genomic DNA
acctcctcatttccccgcttcccgcattcccaagcatgggaggacctgccggacgcagcgcaccatctctcctaacagagaccaagtctgagcttcaaagcttgcgcagacgacaggca

SEQ ID NO: 99065 - DNA, 191 bp, Homo sapiens
  misc_feature 1..191: note = chr8:144677837-144678028
  misc_feature 1..191: note = hypo
  source 1..191: mol_type = genomic DNA
gccccgccccaaccacgtcttttcttaaatgccactgcaggccagctccatggccagccctgcttgaggggctctggccgacctgcctgcccggcgcagcccctgtgcctcctgggtgactccagcacggcacaggctttctggaaccccagacaatacccacgccacacctcacacggcacccttggctg

SEQ ID NO: 99066 - DNA, 231 bp, Homo sapiens
  misc_feature 1..231: note = chr8:144681590-144681821
  misc_feature 1..231: note = hypo
  source 1..231: mol_type = genomic DNA
cagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccatggggggcggagaggacgaggaggaggccaccgactatggagggac

SEQ ID NO: 99067 - DNA, 30 bp, Homo sapiens
  misc_feature 1..30: note = chr8:144682361-144682391
  misc_feature 1..30: note = hypo
  source 1..30: mol_type = genomic DNA
actcctgtctgctatcgagccctggtgcta

SEQ ID NO: 99068 - DNA, 126 bp, Homo sapiens
  misc_feature 1..126: note = chr8:144683678-144683804
  misc_feature 1..126: note = hypo
  source 1..126: mol_type = genomic DNA
gagaagctgacttcacggccgcggtgccagtgagggctgcatagccaggccttgtctgtagtctgggcggcccgtggcgctgcccttcagcccaactactcattgccgctgcgtctttggcgaggc

SEQ ID NO: 99069 - DNA, 122 bp, Homo sapiens; identical to SEQ ID NO: 42092
  misc_feature 1..122: note = chr8:144685577-144685699
  misc_feature 1..122: note = hypo
  source 1..122: mol_type = genomic DNA

SEQ ID NO: 99070 - DNA, 30 bp, Homo sapiens
  misc_feature 1..30: note = chr8:144688031-144688061
  misc_feature 1..30: note = hypo
  source 1..30: mol_type = genomic DNA
cagcagcatcttggccgtcccctgaggaga

SEQ ID NO: 99071 - DNA, 80 bp, Homo sapiens
  misc_feature 1..80: note = chr8:145236678-145236758
  misc_feature 1..80: note = hypo
  source 1..80: mol_type = genomic DNA
agggcggagacagaacggggccgctggggcgcctgtctctgtgctgcacgcacatcgccccttcccgccactcctctggg

SEQ ID NO: 99072 - DNA, 30 bp, Homo sapiens
  misc_feature 1..30: note = chr8:145697556-145697586
  misc_feature 1..30: note = hypo
  source 1..30: mol_type = genomic DNA
ctgcagtcgctgttccgggagatgggggcc

SEQ ID NO: 99073 - DNA, 192 bp, Homo sapiens
  misc_feature 1..192: note = chr8:145697791-145697983
  misc_feature 1..192: note = hyper
  source 1..192: mol_type = genomic DNA
cccagaaggccagggcgggatccaggtggctggcctcacccactgggacgtgcccaacctggagacattgcaccaggtagggctgcaccgctctccgagaccccgccccgtgcttccacttgggggcggggaccctgcacctgaccagcccttcgccccgccttccagatgctgaaactggggaggagcaac

SEQ ID NO: 99074 - skipped

SEQ ID NO: 99075 - DNA, 578 bp, Homo sapiens
  misc_feature 1..578: note = chr8:145700223-145700801
  misc_feature 1..578: note = hyper
  source 1..578: mol_type = genomic DNA
ctcactgggtggtggcgggggactgggcggccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcccttggcctggggctttgcagggtccttgggcacctgggtgtgggggtcagacatgggtggggctgcccaaccttggatgctcaggacttccgcgcgcgctccgcccccgggctccgaccctggcctgccccaccttgcggaagcatcggttggaggaaaggttgtggcgaatggagtctttccagccctcgtagtcttccctgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaa

SEQ ID NO: 99076 - DNA, 30 bp, Homo sapiens
  misc_feature 1..30: note = chr8:145702531-145702561
  misc_feature 1..30: note = hypo
  source 1..30: mol_type = genomic DNA
atttttggtagggaccgggcctgcctatgt

SEQ ID NO: 99077 - DNA, 168 bp, Homo sapiens
  misc_feature 1..168: note = chr8:145728372-145728540
  misc_feature 1..168: note = hypo
  source 1..168: mol_type = genomic DNA
tcccttgccagggggcgggcaggggctggctctgcctggggccaggcccatgttaacctgtgccccggcctgggggccagaggggcaggcctgcgcacggggaggctgttgtggcagcggaacagagacgtgcacggtgagaggcctgggggccggctgtccagggct

SEQ ID NO: 99078 - DNA, 185 bp, Homo sapiens; identical to SEQ ID NO: 42093
  misc_feature 1..185: note = chr8:145739768-145739953
  misc_feature 1..185: note = hypo
  source 1..185: mol_type = genomic DNA

SEQ ID NO: 99079 - DNA, 86 bp, Homo sapiens
  misc_feature 1..86: note = chr8:145745121-145745207
  misc_feature 1..86: note = hypo
  source 1..86: mol_type = genomic DNA
gtgttcttgagcacacggcaggtgctgcagtgccagccagctgcctgccaggccctgcccttgctgccacgcgaactcttccccct

SEQ ID NO: 99080 - DNA, 30 bp, Homo sapiens
  misc_feature 1..30: note = chr8:145751684-145751714
  misc_feature 1..30: note = hypo
  source 1..30: mol_type = genomic DNA
ccaagaagttgggggcgttatctgggccct

SEQ ID NO: 99081 - DNA, 30 bp, Homo sapiens
  misc_feature 1..30: note = chr8:145751965-145751995
  misc_feature 1..30: note = hypo
  source 1..30: mol_type = genomic DNA
gggcggggtgtcacacgcaggattccgcga

SEQ ID NO: 99082 - DNA, 521 bp, Homo sapiens
  misc_feature 1..521: note = chr8:145753251-145753772
  misc_feature 1..521: note = hypo
  source 1..521: mol_type = genomic DNA
cgacggtaagaggttcgcctggcctcactcagcggggctcctgagcgcaggacgcccactccttggtgcgctgggcccgtcggcagagtcggggagcccatcaggggctgcccggaagggagaaagaaggggctggagagggaggcacagcattacctttgaagcaggtgatgaaattcttcattttggaatcatccaggaaaagctgcagatagagggccaggccgtgataagtcccagcgtgcaggtgggggcggggaagctcaggaggtcctgaagctcgggaggtcctgaaccggcccgagcccacttttcctgcttgtctgtgcacaccgcatgcagggaggcgcgtgaaaggtaaacctgggggccccgccgacttatccgcgtctatgcgcacctctgctccctggtcagccaattctttcccgcaccttttccctcttttcaagtttgtaatcagttgtaccacctcctccgcggagactacctggcctgctgcctcccggacatgcagctgc

SEQ ID NO: 99083 - DNA, 30 bp, Homo sapiens
  misc_feature 1..30: note = chr8:145755230-145755260
  misc_feature 1..30: note = hyper
  source 1..30: mol_type = genomic DNA
ccccaccccacccaccgagagcctgccagg

SEQ ID NO: 99084 - DNA, 166 bp, Homo sapiens
  misc_feature 1..166: note = chr8:145758526-145758692
  misc_feature 1..166: note = hypo
  source 1..166: mol_type = genomic DNA
ctggtcaccgttgagcgccagcacctcctcagagagccgtgtctgcacccagggcagctggcgctcggggtagcgctctctctgcatgcccatgacctcctgcagtgcgctgccgaacatggacgggctgaacacggcgttcttggcatgccggatctcctccacg

SEQ ID NO: 99085 - DNA, 86 bp, Homo sapiens
  misc_feature 1..86: note = chr8:145806186-145806272
  misc_feature 1..86: note = hyper
  source 1..86: mol_type = genomic DNA
ccattcacctggccccgcccatagcagctgcccccgccctcacctgccgctgtcctccttcactgtcccaaacgccgcgggccgcc

SEQ ID NO: 99086 - skipped

SEQ ID NO: 99087 - DNA, 18 bp, Homo sapiens
  misc_feature 1..18: note = chr8:145919061-145919079
  misc_feature 1..18: note = hypo
  source 1..18: mol_type = genomic DNA
ggccgtaaaattctttga

SEQ ID NO: 99088 - DNA, 131 bp, Homo sapiens; identical to SEQ ID NO: 32325
  misc_feature 1..131: note = chr8:145925298-145925429
  misc_feature 1..131: note = hyper
  source 1..131: mol_type = genomic DNA

SEQ ID NO: 99089 - DNA, 264 bp, Homo sapiens
  misc_feature 1..264: note = chr8:145925458-145925722
  misc_feature 1..264: note = hyper
  source 1..264: mol_type = genomic DNA
cgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcact

SEQ ID NO: 99090 - DNA, 43 bp, Homo sapiens
  misc_feature 1..43: note = chr8:145925938-145925981
  misc_feature 1..43: note = hyper
  source 1..43: mol_type = genomic DNA
tcaaggttgcgggggcgtggtcacggagcggagccaataaaag

SEQ ID NO: 99091 - DNA, 192 bp, Homo sapiens; identical to SEQ ID NO: 42098
  misc_feature 1..192: note = chr8:145979452-145979644
  misc_feature 1..192: note = hypo
  source 1..192: mol_type = genomic DNA

SEQ ID NO: 99092 - DNA, 136 bp, Homo sapiens
  misc_feature 1..136: note = chr8:146013511-146013647
  misc_feature 1..136: note = hypo
  source 1..136: mol_type = genomic DNA
ccagcctggcaatagcgagagcctgtctaaaataaacaggccctgctgggtcactgcctaggtgtggtgggcgcccaaagacaggtggggccataccagcaggatcaggaaagcaagatcacgaaatggggggtaa

SEQ ID NO: 99093 - DNA, 30 bp, Homo sapiens
  misc_feature 1..30: note = chr8:146015447-146015477
  misc_feature 1..30: note = hypo
  source 1..30: mol_type = genomic DNA
ctccacagcatgtgccgctagacaacccca

SEQ ID NO: 99094 - DNA, 34 bp, Homo sapiens
  misc_feature 1..34: note = chr8:146036285-146036319
  misc_feature 1..34: note = hypo
  source 1..34: mol_type = genomic DNA
gtgcagatcccatggcgagcgtgggatccagccc

SEQ ID NO: 99095 - DNA, 30 bp, Homo sapiens; identical to SEQ ID NO: 42100
  misc_feature 1..30: note = chr8:146050247-146050277
  misc_feature 1..30: note = hypo
  source 1..30: mol_type = genomic DNA

SEQ ID NO: 99096 - DNA, 34 bp, Homo sapiens
  misc_feature 1..34: note = chr8:146055565-146055599
  misc_feature 1..34: note = hypo
  source 1..34: mol_type = genomic DNA
ctctgctgcatcacacgcccgagagagtgcctgg

SEQ ID NO: 99097 - DNA, 98 bp, Homo sapiens; identical to SEQ ID NO: 5087
  misc_feature 1..98: note = chr8:146079215-146079313
  misc_feature 1..98: note = hypo
  source 1..98: mol_type = genomic DNA

SEQ ID NO: 99098 - DNA, 30 bp, Homo sapiens
  misc_feature 1..30: note = chr8:1463086-1463116
  misc_feature 1..30: note = hypo
  source 1..30: mol_type = genomic DNA
caagagcacagccagcgggcaggagcacgc

SEQ ID NO: 99099 - DNA, 183 bp, Homo sapiens
  misc_feature 1..183: note = chr8:1471481-1471664
  misc_feature 1..183: note = hypo
  source 1..183: mol_type = genomic DNA
cagagaacagcgtcacggggtcaccgtcccacttcccaccccgcgcctcacagcacagacgggggatttgccggcctcacgccggccgagccactgctgacttcacgcagccccagccatgcccccacgcagacacacggagccccaaggcgggccagatctcagggccggatggggctgtgg

SEQ ID NO: 99100 - DNA, 101 bp, Homo sapiens
  misc_feature 1..101: note = chr8:14898126-14898227
  misc_feature 1..101: note = hypo
  source 1..101: mol_type = genomic DNA
tctcaaaacaaaaaagtgatttcacttccaagtaaaatgaatatgattatatttagttgatcgtactgcttttatttgaaatactgcgcattattataaat

SEQ ID NO: 99101 - DNA, 84 bp, Homo sapiens
  misc_feature 1..84: note = chr8:1501600-1501684
  misc_feature 1..84: note = hypo
  source 1..84: mol_type = genomic DNA
cagccctgttttattcggcgtgttcacggtcagcagccccgttgtgcttggcgtgttcacgggcagccccgttagactttgggt

SEQ ID NO: 99102 - DNA, 30 bp, Homo sapiens
  misc_feature 1..30: note = chr8:1507113-1507143
  misc_feature 1..30: note = hypo
  source 1..30: mol_type = genomic DNA
gataatgtttttcctcggttccagtgcctc

SEQ ID NO: 99103 - DNA, 201 bp, Homo sapiens; identical to SEQ ID NO: 31800
  misc_feature 1..201: note = chr8:15094366-15094567
  misc_feature 1..201: note = hyper
  source 1..201: mol_type = genomic DNA

SEQ ID NO: 99104 - DNA, 126 bp, Homo sapiens
  misc_feature 1..126: note = chr8:15094645-15094771
  misc_feature 1..126: note = hyper
  source 1..126: mol_type = genomic DNA
cgtgccgggctggggcacaggcgggatcggagccgggaagaggaggcaaagtggcggcgcagctcggacaactttgctgggaaagcaggcgacagcgggcagagctggtgccgctgccccccccgg

SEQ ID NO: 99105 - DNA, 11 bp, Homo sapiens
  misc_feature 1..11: note = chr8:15095073-15095084
  misc_feature 1..11: note = hyper
  source 1..11: mol_type = genomic DNA
ccgcccggacc

SEQ ID NO: 99106 - DNA, 51 bp, Homo sapiens; identical to SEQ ID NO: 31802
  misc_feature 1..51: note = chr8:15095356-15095407
  misc_feature 1..51: note = hyper
  source 1..51: mol_type = genomic DNA

SEQ ID NO: 99107 - DNA, 33 bp, Homo sapiens
  misc_feature 1..33: note = chr8:15171865-15171898
  misc_feature 1..33: note = hypo
  source 1..33: mol_type = genomic DNA
cacaacctccttccacgacgttttcgcatctgt

SEQ ID NO: 99108 - DNA, 130 bp, Homo sapiens
  misc_feature 1..130: note = chr8:15398217-15398347
  misc_feature 1..130: note = hyper
  source 1..130: mol_type = genomic DNA
tgggaggccctggggcgtttccgggacgtggagttagcagggttctgacttgaaaaacgacggcaaagcgtgttcttgactgcttctgagcacctcacacctttcagacccagggcgcctttattcccag

SEQ ID NO: 99109 - DNA, 39 bp, Homo sapiens
  misc_feature 1..39: note = chr8:1569815-1569854
  misc_feature 1..39: note = hypo
  source 1..39: mol_type = genomic DNA
agcggggtcacatctcggaggcaccgtcagcaccaggag

SEQ ID NO: 99110 - DNA, 30 bp, Homo sapiens
  misc_feature 1..30: note = chr8:1574119-1574149
  misc_feature 1..30: note = hypo
  source 1..30: mol_type = genomic DNA
atctctggcctgtggcgggtgctcagcctc

SEQ ID NO: 99111 - DNA, 162 bp, Homo sapiens
  misc_feature 1..162: note = chr8:1574846-1575008
  misc_feature 1..162: note = hypo
  source 1..162: mol_type = genomic DNA
acctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccagagctac

SEQ ID NO: 99112 - DNA, 39 bp, Homo sapiens
  misc_feature 1..39: note = chr8:1579143-1579182
  misc_feature 1..39: note = hypo
  source 1..39: mol_type = genomic DNA
gaggtccgggtgtcccgagggtctcggcgggaggtccgg

SEQ ID NO: 99113 - DNA, 87 bp, Homo sapiens
  misc_feature 1..87: note = chr8:1581006-1581093
  misc_feature 1..87: note = hypo
  source 1..87: mol_type = genomic DNA
gatcaatgggcaattcgagtccgtgtgcgagtccgtcttcagtgaagttgaatctcaggccatggatgccctcgacctcccgggatg

SEQ ID NO: 99114 - DNA, 301 bp, Homo sapiens
  misc_feature 1..301: note = chr8:1588688-1588989
  misc_feature 1..301: note = hypo
  source 1..301: mol_type = genomic DNA
tgatccccattagaacgtctcagaaactgccaaccaccatggcttccatgaagccccaagaatccttcagcaaagctccatgttgcaaactaaagcccagggtgtgcatcatgaagacgccatccctgtgtcccgggttcagaggcttgtacccgggactcgggcatgagaccccattacgggcctgagcacagcaccaagaccgtcaaacgctaaaaacaggcacaggtggaagtctcacgtggcccgcccccccgcatctagacttgtgttttacagtaaatgacgaaatgcagtccag

SEQ ID NO: 99115 - DNA, 87 bp, Homo sapiens
  misc_feature 1..87: note = chr8:1592418-1592505
  misc_feature 1..87: note = hypo
  source 1..87: mol_type = genomic DNA
gcctgaccctaagcccgcccgaccaagagcctcgtctcggctctgtgcaagagccagaggagtgaagactgccgtcctctgtggggt

SEQ ID NO: 99116 - DNA, 90 bp, Homo sapiens
  misc_feature 1..90: note = chr8:1613724-1613814
  misc_feature 1..90: note = hypo
  source 1..90: mol_type = genomic DNA
tttaatctatattcccgcgtctctctgttgcctttgattttttactacccctattgctgggactcaaaacttcttcggaatcaatatttc

SEQ ID NO: 99117 - DNA, 51 bp, Homo sapiens
  misc_feature 1..51: note = chr8:1616193-1616244
  misc_feature 1..51: note = hypo
  source 1..51: mol_type = genomic DNA
tgctgctggatttgtcggtatttttaaatgatgccacgcctgcgtgctgtc

SEQ ID NO: 99118 - DNA, 38 bp, Homo sapiens; identical to SEQ ID NO: 41686
  misc_feature 1..38: note = chr8:1645305-1645343
  misc_feature 1..38: note = hypo
  source 1..38: mol_type = genomic DNA

SEQ ID NO: 99119 - DNA, 53 bp, Homo sapiens
  misc_feature 1..53: note = chr8:16460002-16460055
  misc_feature 1..53: note = hypo
  source 1..53: mol_type = genomic DNA
acactcaaccctaaacgctgcagtggggttgaagcccgcgctccccacgacct

SEQ ID NO: 99120 - DNA, 30 bp, Homo sapiens
  misc_feature 1..30: note = chr8:16687802-16687832
  misc_feature 1..30: note = hypo
  source 1..30: mol_type = genomic DNA
tttacattaaggaaccgccaaaaatccttg

SEQ ID NO: 99121 - DNA, 26 bp, Homo sapiens
  misc_feature 1..26: note = chr8:16760265-16760291
  misc_feature 1..26: note = hypo
  source 1..26: mol_type = genomic DNA
tcgctgggtaaaccacgtgaaaagaa

SEQ ID NO: 99122 - DNA, 367 bp, Homo sapiens
  misc_feature 1..367: note = chr8:16858724-16859091
  misc_feature 1..367: note = hyper
  source 1..367: mol_type = genomic DNA
tgcccagagcagccccgggtgcataatcagctgcataactgtggggcatgtttaaagaagcccggcgcttcctgttattaatttttgtaaagtggacggcatgggggaaaatgagaaaggaaatcggagagaaacatacagggattttttttaaaactgactgcgaggtaagcagtgcgagaaccgtgatgccgagtgcaccaggtcttggtgtccccggcagtgggaagggcaaggggaaggcaggaaggagcttgcgaagcgcccaccctttctcctcccgcccccagcatctggagctgctgccctgctagaggctgcggcgacaaaccagcaggaaaatttctccccgcggctgctctggcca

SEQ ID NO: 99123 - DNA, 135 bp, Homo sapiens
  misc_feature 1..135: note = chr8:16859352-16859487
  misc_feature 1..135: note = hyper
  source 1..135: mol_type = genomic DNA
gatgccgtgcaggtgcgccagctgcgcagcccccggcccgccgcgcgcgctccgctccgccgcgctcctgcgctcgcccagcagcggcggccgctccccggcaggaggcaacaggaaatgcgaacccacctgctg

SEQ ID NO: 99124 - DNA, 41 bp, Homo sapiens; identical to SEQ ID NO: 31804
  misc_feature 1..41: note = chr8:16884323-16884364
  misc_feature 1..41: note = hyper
  source 1..41: mol_type = genomic DNA

SEQ ID NO: 99125 - DNA, 987 bp, Homo sapiens
  misc_feature 1..987: note = chr8:16884365-16885352
  misc_feature 1..987: note = hyper
  source 1..987: mol_type = genomic DNA
ggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaagctcgcggcaccgacttctcgcgagatttcggcgacccccccccccgcccccgcccctccgttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagacc

SEQ ID NO: 99126 - DNA, 30 bp, Homo sapiens
  misc_feature 1..30: note = chr8:17003919-17003949
  misc_feature 1..30: note = hypo
  source 1..30: mol_type = genomic DNA
ggcatatgtagcctccgctgaagcagaaat

SEQ ID NO: 99127 - DNA, 29 bp, Homo sapiens
  misc_feature 1..29: note = chr8:17271090-17271119
  misc_feature 1..29: note = hyper
  source 1..29: mol_type = genomic DNA
ggcggagcactatacggccactgttctcc

SEQ ID NO: 99128 - DNA, 149 bp, Homo sapiens
  misc_feature 1..149: note = chr8:17354451-17354600
  misc_feature 1..149: note = hyper
  source 1..149: mol_type = genomic DNA
ccggggattggtcagcgcggccggggcccggcgggaggcgggctcggggtcgcgttccgggagcgcggaggaggcggtgccgcccggccccgcgccccgcccccgccccgggtggctacacagaggggcgcccacgtgcccagccctcc

SEQ ID NO: 99129 - DNA, 47 bp, Homo sapiens
  misc_feature 1..47: note = chr8:17659282-17659329
  misc_feature 1..47: note = hyper
  source 1..47: mol_type = genomic DNA
tggccacctgcaggccgaggggcctcgcaccgcggggcgtatagaag

SEQ ID NO: 99130 - DNA, 30 bp, Homo sapiens
  misc_feature 1..30: note = chr8:1771721-1771751
  misc_feature 1..30: note = hyper
  source 1..30: mol_type = genomic DNA
accctccccaaggggcgcagctctgagccg

SEQ ID NO: 99131 - DNA, 495 bp, Homo sapiens
  misc_feature 1..495: note = chr8:1772198-1772693
  misc_feature 1..495: note = hyper
  source 1..495: mol_type = genomic DNA
gggaacagcgggggacggcggggaacagcgggggacggcggggaacagcaggggactgcgggtcgcgtcctggccgccgaggtgagtgcgggccccgcggaccgtgggtcccctcgcgggcttctggtttcctttgagagttgcacttctgcccggctcccccgaaatcgctgggtcccacccggaggtggctgcgcccccgaccccctgcgcagatgtttcagggaaggggctgagaccccctccccccgagcagctcccccttccgcggcgcccccggcccctcaggataacggcgcgggcctgggcggggggagcagggactggcagcagggacccctggccccaggggcaggagcgaactccgatcggcggaaggagcccgaggggcgagctggcttcgcctggggggtcgtgcagtaacttagattttccggtaaaggagaagaatgcggtccgcctcaggatgcagagaaggaccggtgtaaggaaagc

SEQ ID NO: 99132 - DNA, 139 bp, Homo sapiens
  misc_feature 1..139: note = chr8:1778994-1779133
  misc_feature 1..139: note = hypo
  source 1..139: mol_type = genomic DNA
aggagccatggcaggcgaggcgccaagagaatggggtcattgcctgaaatgccactggagccgagagatgagctgagcccacgtccacagaagcccattcccagtgggaggaacagcgtctgcgcggccctgaggtggt

SEQ ID NO: 99133 - DNA, 38 bp, Homo sapiens
  misc_feature 1..38: note = chr8:1784057-1784095
  misc_feature 1..38: note = hypo
  source 1..38: mol_type = genomic DNA
acaatccaggccaggcgccgtggctcacacctgtaatc

SEQ ID NO: 99134 - DNA, 84 bp, Homo sapiens
  misc_feature 1..84: note = chr8:17974435-17974519
  misc_feature 1..84: note = hypo
  source 1..84: mol_type = genomic DNA
tgaaacactgtgcctcgggttacagacagtctaatgacataatgacatgtataaacacatctccaagagtgctctaagtgaggt

SEQ ID NO: 99135 - DNA, 30 bp, Homo sapiens
  misc_feature 1..30: note = chr8:18062915-18062945
  misc_feature 1..30: note = hypo
  source 1..30: mol_type = genomic DNA
acaggagtggttgttcggggcaggtgagga

SEQ ID NO: 99136 - DNA, 30 bp, Homo sapiens
  misc_feature 1..30: note = chr8:1811759-1811789
  misc_feature 1..30: note = hypo
  source 1..30: mol_type = genomic DNA
cgtggcccgcacccacgcagtacagccatc

SEQ ID NO: 99137 - DNA, 40 bp, Homo sapiens
  misc_feature 1..40: note = chr8:18244635-18244675
  misc_feature 1..40: note = hyper
  source 1..40: mol_type = genomic DNA
ggtcctggacgggatcgtccccttgcgggcccagtgcagg

SEQ ID NO: 99138 - DNA, 32 bp, Homo sapiens
  misc_feature 1..32: note = chr8:1857610-1857642
  misc_feature 1..32: note = hypo
  source 1..32: mol_type = genomic DNA
ggccgtggttgctaacgcgaaaccaagtaagt

SEQ ID NO: 99139 - DNA, 41 bp, Homo sapiens
  misc_feature 1..41: note = chr8:18806532-18806573
  misc_feature 1..41: note = hypo
  source 1..41: mol_type = genomic DNA
gaatatagttatacacggtgaaaccccgtctctactaaaaa

SEQ ID NO: 99140 - DNA, 30 bp, Homo sapiens
  misc_feature 1..30: note = chr8:18870173-18870203
  misc_feature 1..30: note = hyper
  source 1..30: mol_type = genomic DNA
tacttacctagctaccgggctttgcaaaat

SEQ ID NO: 99141 - DNA, 144 bp, Homo sapiens
  misc_feature 1..144: note = chr8:18871433-18871577
  misc_feature 1..144: note = hyper
  source 1..144: mol_type = genomic DNA
caggggcggggcctccgggggaggctggaggcgatccagaccctcgcagtgcagccctcgagcggcccggaccgtccgctgcctcccgcagccgcgcgcccgccctgggcccagcctccagcccgcgagcgaaaacctgcctgt

SEQ ID NO: 99142 - DNA, 18 bp, Homo sapiens
  misc_feature 1..18: note = chr8:19016279-19016297
  misc_feature 1..18: note = hypo
  source 1..18: mol_type = genomic DNA
aaggaagaagtgggccgg

SEQ ID NO: 99143 - DNA, 37 bp, Homo sapiens
  misc_feature 1..37: note = chr8:19170992-19171029
  misc_feature 1..37: note = hyper
  source 1..37: mol_type = genomic DNA
cctaccccggactaccgcagctcggggacagcgcgcg

SEQ ID NO: 99144 - DNA, 30 bp, Homo sapiens
  misc_feature 1..30: note = chr8:1921312-1921342
  misc_feature 1..30: note = hyper
  source 1..30: mol_type = genomic DNA
ccagcaggggtccagcgttaattagaaccc

SEQ ID NO: 99145 - DNA, 35 bp, Homo sapiens
  misc_feature 1..35: note = chr8:1921544-1921579
  misc_feature 1..35: note = hyper
  source 1..35: mol_type = genomic DNA
taaatatgtcaacaacgcatcgcctctacttttac

SEQ ID NO: 99146 - DNA, 74 bp, Homo sapiens
  misc_feature 1..74: note = chr8:1922587-1922661
  misc_feature 1..74: note = hyper
  source 1..74: mol_type = genomic DNA
ctcccggggttgctccgcttggctctcggcggtcgcggggatcggctgtccggagcgaacgggggtctctcctg

SEQ ID NO: 99147 - DNA, 774 bp, Homo sapiens
  misc_feature 1..774: note = chr8:19614007-19614781
  misc_feature 1..774: note = hyper
  source 1..774: mol_type = genomic DNA
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggcgccgcgccctccgcctgccaagccggtccccggcccctgcccgtgccctgggcccccggcgggcagcggcggagggaggccaggcgcggcaccgtcctccgcagctgcacgagccaccccgaggtcgcggggtgggcgggcgcgagctaggcgcgcggggctgtggggatctgccggcgccactgacgcccccgcgcggcacaccgcgcccggctggcccgggaggggacccgactcacccgaagcgccctgctagctgcccggcccggctccggccgctgccgccgtcgctgaactttccctcctgcgcggccgccgcggact

SEQ ID NO: 99148 - DNA, 422 bp, Homo sapiens
  misc_feature 1..422: note = chr8:19614842-19615264
  misc_feature 1..422: note = hyper
  source 1..422: mol_type = genomic DNA
cggcggcggcggcggctcgggcgggcgggcgcaacagcggccaagcctggcgccccgccgcagggtaggtccggcgggggcggccaaggccgggctggggtcgcggttggccgcgtacctccgcgtcacccacggcctctctgcagtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 99149 - DNA, 119 bp, Homo sapiens
  misc_feature 1..119: note = chr8:19797490-19797609
  misc_feature 1..119: note = hyper
  source 1..119: mol_type = genomic DNA
ccccgcccggggactcgcgggccgactgtggccccttctggggaagccggggcgcggggaggcgttccgggcatctcagccgcacggggtacgctcgccctcggcggggcccctcgctc

SEQ ID NO: 99150 - DNA, 342 bp, Homo sapiens
  misc_feature 1..342: note = chr8:19797677-19798019
  misc_feature 1..342: note = hyper
  source 1..342: mol_type = genomic DNA
cgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 99151 - DNA, 34 bp, Homo sapiens
  misc_feature 1..34: note = chr8:20110445-20110479
  misc_feature 1..34: note = hypo
  source 1..34: mol_type = genomic DNA
gtgcaggacctgctgcgcgcgctggctcttctgc

SEQ ID NO: 99152 - DNA, 661 bp, Homo sapiens; identical to SEQ ID NO: 31812
  misc_feature 1..661: note = chr8:20160990-20161651
  misc_feature 1..661: note = hyper
  source 1..661: mol_type = genomic DNA

SEQ ID NO: 99153 - DNA, 68 bp, Homo sapiens
  misc_feature 1..68: note = chr8:20161666-20161734
  misc_feature 1..68: note = hyper
  source 1..68: mol_type = genomic DNA
cgcggggtcccgggtcccgtctctctgctctcacttccatcagccccattgggcgaccctgccccctc

SEQ ID NO: 99154 - DNA, 37 bp, Homo sapiens
  misc_feature 1..37: note = chr8:20317340-20317377
  misc_feature 1..37: note = hypo
  source 1..37: mol_type = genomic DNA
ccagcagtggacacacgcggctatgcacatgcaaccc

SEQ ID NO: 99155 - DNA, 36 bp, Homo sapiens
  misc_feature 1..36: note = chr8:20317437-20317473
  misc_feature 1..36: note = hypo
  source 1..36: mol_type = genomic DNA
ctagaaactcacagaaatttccgagcaaaaccctta

SEQ ID NO: 99156 - DNA, 130 bp, Homo sapiens
  misc_feature 1..130: note = chr8:20431789-20431919
  misc_feature 1..130: note = hypo
  source 1..130: mol_type = genomic DNA
aaagggcgtttctttcgcaggtaggagagagactgtcttccctctccctgcctttctgggtatgaggaagggagcacattggctgcaggggctgcaggcagccatcttgacgccacgtgggaaacgaggt

SEQ ID NO: 99157 - DNA, 63 bp, Homo sapiens
  misc_feature 1..63: note = chr8:21302252-21302315
  misc_feature 1..63: note = hypo
  source 1..63: mol_type = genomic DNA
tgtcacactcctgctcgccgtgcacctggagagcctttgtagctcatccgacaatggagcagc

SEQ ID NO: 99158 - DNA, 173 bp, Homo sapiens; identical to SEQ ID NO: 41723
  misc_feature 1..173: note = chr8:21393876-21394049
  misc_feature 1..173: note = hypo
  source 1..173: mol_type = genomic DNA

SEQ ID NO: 99159 - DNA, 64 bp, Homo sapiens
  misc_feature 1..64: note = chr8:21546878-21546942
  misc_feature 1..64: note = hypo
  source 1..64: mol_type = genomic DNA
gctaaaccagagacccggtgggctcctcagtgagcaggcgagtcatgggcgaaagtccagattg

SEQ ID NO: 99160 - DNA, 183 bp, Homo sapiens
  misc_feature 1..183: note = chr8:21563318-21563501
  misc_feature 1..183: note = hypo
  source 1..183: mol_type = genomic DNA
tgatgcagagaaggccgggctcaggctgtctcccccagctggccctgagctgggctgcggcccctgccctgctgagatgggggcagcaaggacccacagagcccaggtgagcaggaagagcttaccaatcatgccagcataagagcccagacacgcctggtaattgtccgcagggcagctggt

SEQ ID NO: 99161 - DNA, 79 bp, Homo sapiens
  misc_feature 1..79: note = chr8:21585266-21585345
  misc_feature 1..79: note = hypo
  source 1..79: mol_type = genomic DNA
tcctctccttaccaccgcggtctctccgcaatgacagcccatgtccagggactgtctggattcacggaaaatactttga

SEQ ID NO: 99162 - DNA, 170 bp, Homo sapiens
  misc_feature 1..170: note = chr8:21608043-21608213
  misc_feature 1..170: note = hypo
  source 1..170: mol_type = genomic DNA
gcctggcaatgcaagcgccctcctgccagcaccaccggggctgccgcggcactcaccgacacaggtggtcagtccggcacacgccacgcaggtccaggcagttgggcttctccttgtcctcataggagcagctgggcaggatggtttgccggcggcgctcagcgcacgcc

SEQ ID NO: 99163 - DNA, 135 bp, Homo sapiens
  misc_feature 1..135: note = chr8:21842170-21842305
  misc_feature 1..135: note = hypo
  source 1..135: mol_type = genomic DNA
atcccctggaggatacggggctggtccagcagcagttggaccagctgtccaccattgggcgttgtgaatatgagaagacgtgtgcactcctcgtgcagttgtttgaccagtcggcccagtcgtaccaggagctgc

SEQ ID NO: 99164 - DNA, 77 bp, Homo sapiens
  misc_feature 1..77: note = chr8:21868044-21868121
  misc_feature 1..77: note = hyper
  source 1..77: mol_type = genomic DNA
agtgctaatcagcggcgctgttcccgggctgggtgcagctgctaaggacaaggcccctgctccgaagaacgcggtgg

SEQ ID NO: 99165 - DNA, 334 bp, Homo sapiens
  misc_feature 1..334: note = chr8:21881693-21882027
  misc_feature 1..334: note = hyper
  source 1..334: mol_type = genomic DNA
cccaccccacctgcccgctgcggctctccgcgggagatctcaccgttctggagacagggctcgctcgctctcacggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcct

SEQ ID NO: 99166 - DNA, 30 bp, Homo sapiens
  misc_feature 1..30: note = chr8:21927030-21927060
  misc_feature 1..30: note = hypo
  source 1..30: mol_type = genomic DNA
taggtcttctcggcacgacctcattgtttc

SEQ ID NO: 99167 - DNA, 30 bp, Homo sapiens
  misc_feature 1..30: note = chr8:21959580-21959610
  misc_feature 1..30: note = hypo
  source 1..30: mol_type = genomic DNA
tcccacccccacacacgttcacagtggcca

SEQ ID NO: 99168 - DNA, 44 bp, Homo sapiens
  misc_feature 1..44: note = chr8:21987424-21987468
  misc_feature 1..44: note = hyper
  source 1..44: mol_type = genomic DNA
cgccctggcccccagcgggaagagcgcgccggcacaggggaggg

SEQ ID NO: 99169 - DNA, 214 bp, Homo sapiens
  misc_feature 1..214: note = chr8:21987861-21988075
  misc_feature 1..214: note = hyper
  source 1..214: mol_type = genomic DNA
gctccgtacgggcaccgcaggctcggctcagaaatcccccgccacgagtgtccccagacggcgcgctcctggcgcttacctgggcttcaccggccggtcgcggcgcgggcggtggcggtcgtcgtggccggcaccgggcgcctgctccccatgggccagctccggggcctcccggccggcgggcgaggacgcgttctcccgctctgtctgctca

SEQ ID NO: 99170 - DNA, 56 bp, Homo sapiens
  misc_feature 1..56: note = chr8:21988412-21988468
  misc_feature 1..56: note = hyper
  source 1..56: mol_type = genomic DNA
ccaggagagaggcaccggcgagggcgcagcaccgcgcagcgcggctaatggaggta

SEQ ID NO: 99171 - DNA, 37 bp, Homo sapiens
  misc_feature 1..37: note = chr8:22005505-22005542
  misc_feature 1..37: note = hypo
  source 1..37: mol_type = genomic DNA
tcctgggccagtccacggggtgcgcctgtacacactg

SEQ ID NO: 99172 - DNA, 62 bp, Homo sapiens
  misc_feature 1..62: note = chr8:22013920-22013982
  misc_feature 1..62: note = hyper
  source 1..62: mol_type = genomic DNA
gcaagagcagctgggcgggcaggggggcgtcttggggggcctcttagcgctgacttgcagca

SEQ ID NO: 99173 - DNA, 133 bp, Homo sapiens
  misc_feature 1..133: note = chr8:22089510-22089643
  misc_feature 1..133: note = hyper
  source 1..133: mol_type = genomic DNA
ctgcccctggtgagacgatgttcccagctgagcagcgcaagaagagaggcaagagcgaaatcaaagcagcgtggaggagagagaggcagagaagggagaaagaacgagagagccagaccgaatctgcctccac

SEQ ID NO: 99174 - DNA, 17 bp, Homo sapiens
  misc_feature 1..17: note = chr8:22101764-22101781
  misc_feature 1..17: note = hypo
  source 1..17: mol_type = genomic DNA
tacgacaactctgtgaa

SEQ ID NO: 99175 - DNA, 30 bp, Homo sapiens
  misc_feature 1..30: note = chr8:22297450-22297480
  misc_feature 1..30: note = hypo
  source 1..30: mol_type = genomic DNA
agtcccctagaggaacgggattaatttaaa

SEQ ID NO: 99176 - DNA, 43 bp, Homo sapiens
  misc_feature 1..43: note = chr8:22549491-22549534
  misc_feature 1..43: note = hyper
  source 1..43: mol_type = genomic DNA
gctttgtcctcggagcgtagaagggtgtcgccctcaaagggag

SEQ ID NO: 99177 - DNA, 203 bp, Homo sapiens
  misc_feature 1..203: note = chr8:22562486-22562689
  misc_feature 1..203: note = hyper
  source 1..203: mol_type = genomic DNA
tagaccccaaacgaaagaaaaagtatgccgcaatggaaactcgaactaatcttcccctcttgccccacttccctcccgcggtcacacttccggcggccaccacagggtattttgggtttgaaaacaaagcgtcagatctatttgagcaacttttgttccattggagtagaagcccaggggcctgtggccgctctgggctcggc

SEQ ID NO: 99178 - DNA, 30 bp, Homo sapiens; identical to SEQ ID NO: 9416
  misc_feature 1..30: note = chr8:22613837-22613867
  misc_feature 1..30: note = hyper
  source 1..30: mol_type = genomic DNA

SEQ ID NO: 99179 - DNA, 30 bp, Homo sapiens
  misc_feature 1..30: note = chr8:22694146-22694176
  misc_feature 1..30: note = hypo
  source 1..30: mol_type = genomic DNA
ggggtgtgggccagccgggtggcgagttca

SEQ ID NO: 99180 - DNA, 30 bp, Homo sapiens
  misc_feature 1..30: note = chr8:22708858-22708888
  misc_feature 1..30: note = hypo
  source 1..30: mol_type = genomic DNA
cagttccttctgagtcgattcttgagaagg

SEQ ID NO: 99181 - DNA, 235 bp, Homo sapiens
  misc_feature 1..235: note = chr8:22722223-22722458
  misc_feature 1..235: note = hyper
  source 1..235: mol_type = genomic DNA
tgtgtagcaccttctcggcagagctcaggaaagggcggaaggggtgagaaaataggtagccagaggtggaagtagctgaccaagtcctagcgggtagtacgcaccacagtaaaacaccacgggggccgctgggcaccgccgagcgccaggctggtgaactgacccgcagcgcaccccatctgtgtgggaaggtcggggcaggggacccagggcgggatggcggtgctggaccccg

SEQ ID NO: 99182 - DNA, 69 bp, Homo sapiens
  misc_feature 1..69: note = chr8:22723292-22723361
  misc_feature 1..69: note = hyper
  source 1..69: mol_type = genomic DNA
ggccactcccgggggcgcgagcggcggcgcctagagggacccccaccccgggctcgaactcccgacaag

SEQ ID NO: 99183 - DNA, 184 bp, Homo sapiens
  misc_feature 1..184: note = chr8:22760486-22760670
  misc_feature 1..184: note = hypo
  source 1..184: mol_type = genomic DNA
cctttctcattacaccgtagggacctcataaataggagggccttgtaatagcctgacgggcctgaaaagatggcagtggtatttcaggtacaacctgaaacttggattccatctcgctctgatagccttctactcccatagcttaagcaagaagaatcaccccggaaaccgcgaaatgttgaga

SEQ ID NO: 99184 - DNA, 438 bp, Homo sapiens
  misc_feature 1..438: note = chr8:22960583-22961021
  misc_feature 1..438: note = hyper
  source 1..438: mol_type = genomic DNA
ggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctca

SEQ ID NO: 99185 - DNA, 398 bp, Homo sapiens
  misc_feature 1..398: note = chr8:23021192-23021590
  misc_feature 1..398: note = hyper
  source 1..398: mol_type = genomic DNA
cgcaggcgacccgggccaagcatccccaccgtgtccccctctctccctgcccactcccggcgccaggtgcgctcttccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 99186 - DNA, 579 bp, Homo sapiens
  misc_feature 1..579: note = chr8:23260467-23261046
  misc_feature 1..579: note = hyper
  source 1..579: mol_type = genomic DNA
ctcacaccctcgccccgctccgccccgcactccggctgttttttgatggtcttagctcgggcacggagaggagggaacctcgcttgttctcccaatcatctctattccagcgctgattcctgggacacctcgagcaggcagccacacccagagggcttccaaatttgggctggtgagaaggggcgcggtgggcaaagcgcctgcgtaaaagttgtaggcacttcagaccaccggaccaacggctcaagattgggatcagctgtagccgtgggttcgctcgtgcccgttctttccaactccagggcttctaggtgatgaaggcgggagagggtccctggtccccggagaggcagggcgacttgggagtgcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtcccagcccagcacgctctacatccccaaaaccacagccccgagggcagtcactg

SEQ ID NO: 99187 - DNA, 552 bp, Homo sapiens
  misc_feature 1..552: note = chr8:23261347-23261899
  misc_feature 1..552: note = hyper
  source 1..552: mol_type = genomic DNA
acccccaggcactgtcgagaggcagccccgcgcaggacgaagcctggagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttctcgagcagagggggcggctctggtctccgatggctggagaaagcaagcaccaagcgtaggtagccgcgcgctggagtcgcgcgtttactcttttcccccttacttttaactagaggaggatggcaaacccctccccggacccacccccttccccgaaggcggccgccgcagcaggcccggcctccggcctcttttgttgtaattcgagagcggccactcccagggccagagggagctccgcgggggaggccaaggcctgcggggcagcccttcccaggctcctcgcgcccgggtttccggagcctgagatgccgggaagggggcctttcctcgggagattcctcta

SEQ ID NO: 99188 - DNA, 254 bp, Homo sapiens
  misc_feature 1..254: note = chr8:23290404-23290658
  misc_feature 1..254: note = hypo
  source 1..254: mol_type = genomic DNA
ttccttttgagtcttcgtggagctgtgagctggatcacaaggtccccggggcattctgggcgggaaggccctcctccatccagagggcggcggccgagctgctccggggagtgcgcctgtggatgcgccgcagccgcagcaggtacagcaggatggccagcagcaccaccaggaagcagccagagaacaggtagtggttgtagacaaaggaaacgccccgccagtgggtgtgactggctcggaaggcctcctgc

SEQ ID NO: 99189 - DNA, 30 bp, Homo sapiens; identical to SEQ ID NO: 41728
  misc_feature 1..30: note = chr8:23331189-23331219
  misc_feature 1..30: note = hypo
  source 1..30: mol_type = genomic DNA

SEQ ID NO: 99190 - DNA, 30 bp, Homo sapiens; identical to SEQ ID NO: 41729
  misc_feature 1..30: note = chr8:23340639-23340669
  misc_feature 1..30: note = hypo
  source 1..30: mol_type = genomic DNA

SEQ ID NO: 99191 - DNA, 30 bp, Homo sapiens
  misc_feature 1..30: note = chr8:23345865-23345895
  misc_feature 1..30: note = hypo
  source 1..30: mol_type = genomic DNA
gccctgggagccctgcgagttgcggaagag

SEQ ID NO: 99192 - DNA, 136 bp, Homo sapiens
  misc_feature 1..136: note = chr8:23380707-23380843
  misc_feature 1..136: note = hypo
  source 1..136: mol_type = genomic DNA
ttttaagtcacctagtttgtgtcattttgttagagcactcccaggacacaaatattttacgctttctgagctttaggtgcagcagaatattcaggtagagctgccgggaggcacatgaatacgtgggtgggactgg

SEQ ID NO: 99193 - DNA, 30 bp, Homo sapiens; identical to SEQ ID NO: 41731
  misc_feature 1..30: note = chr8:23395420-23395450
  misc_feature 1..30: note = hypo
  source 1..30: mol_type = genomic DNA

SEQ ID NO: 99194 - DNA, 38 bp, Homo sapiens; identical to SEQ ID NO: 15103
  misc_feature 1..38: note = chr8:23399594-23399632
  misc_feature 1..38: note = hypo
  source 1..38: mol_type = genomic DNA

SEQ ID NO: 99195 - DNA, 152 bp, Homo sapiens; identical to SEQ ID NO: 15104
  misc_feature 1..152: note = chr8:23423918-23424070
  misc_feature 1..152: note = hypo
  source 1..152: mol_type = genomic DNA

SEQ ID NO: 99196 - DNA, 30 bp, Homo sapiens
  misc_feature 1..30: note = chr8:23424483-23424513
  misc_feature 1..30: note = hypo
  source 1..30: mol_type = genomic DNA
tttgagggagagaggcggggtgggggggtg

SEQ ID NO: 99197 - DNA, 53 bp, Homo sapiens
  misc_feature 1..53: note = chr8:23430870-23430923
  misc_feature 1..53: note = hypo
  source 1..53: mol_type = genomic DNA
gctctgccaggctgccgtgcaagggaataccgacgagacgagctgcactgtct

SEQ ID NO: 99198 - DNA, 264 bp, Homo sapiens
  misc_feature 1..264: note = chr8:23559338-23559602
  misc_feature 1..264: note = hyper
  source 1..264: mol_type = genomic DNA
ttccaggagagcagtcgtggccagaaaagagtgctcctctggattaacggagtcccctggggcgcggccttatggggatgtttaagtcccaaaggaagaggctcaaagcaggttactcttcgtgaacttcccggatcctcaagttcccagctcttcagcccccttcccgccctcccgtcctcttctctttcttccccaacagctgtcattaattggaggatggtaggcccgctagatcaccatctccattcaccgccgatgccc

SEQ ID NO: 99199 - DNA, 1257 bp, Homo sapiens
  misc_feature 1..1257: note = chr8:23559665-23560922
  misc_feature 1..1257: note = hyper
  source 1..1257: mol_type = genomic DNA
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatttgcttcttagaatgtgtgt

SEQ ID NO: 99200 - DNA, 30 bp, Homo sapiens
  misc_feature 1..30: note = chr8:23562792-23562822
  misc_feature 1..30: note = hyper
  source 1..30: mol_type = genomic DNA
gagttagtgagtagccggcctgcaggccgg

SEQ ID NO: 99201 - DNA, 233 bp, Homo sapiens
  misc_feature 1..233: note = chr8:23563791-23564024
  misc_feature 1..233: note = hyper
  source 1..233: mol_type = genomic DNA
cccccacattccccccgtaggaggcaagacctgagcgcttactcacgtggctcccccatccgttccgcgtccatctccaagactgcctcacagggacccccaggaggctccgaaccatccagctttctgtcaccgccgccgccaccagcgttgtgaacctctgaccctcgcggctctgcgtccattctcaggtactgaaagttttccgggctcttccgcacccgcggatgtgg

SEQ ID NO: 99202 - DNA, 218 bp, Homo sapiens
  misc_feature 1..218: note = chr8:23564192-23564410
  misc_feature 1..218: note = hyper
  source 1..218: mol_type = genomic DNA
cgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctccagtccccagtcgccttcctgggagg

SEQ ID NO: 99203 - DNA, 490 bp, Homo sapiens
  misc_feature 1..490: note = chr8:23564781-23565271
  misc_feature 1..490: note = hyper
  source 1..490: mol_type = genomic DNA
cagaatccaggtctgcggagtcccgacccgccacttcctaggagcagcttctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagcgtgccagcttgtgtgcgcgtataaatgcggcgcccgccgaagggctgggaagatttgactcgcattagatctccagaaaaggcccttggttacggcgggcaccgagtaaatggcgcagtgtggcacaaaggttaccaacacggagatagcgccaacagatccagcccctgctgttactactcctggatcagggaaacgtgatttggtgtca

SEQ ID NO: 99204 - DNA, 52 bp, Homo sapiens
  misc_feature 1..52: note = chr8:23566803-23566855
  misc_feature 1..52: note = hyper
  source 1..52: mol_type = genomic DNA
gtttacaatcatcaccgggcacccacaagagaccctgaacttagaatatttc

SEQ ID NO: 99205 - DNA, 314 bp, Homo sapiens
  misc_feature 1..314: note = chr8:23566900-23567214
  misc_feature 1..314: note = hyper
  source 1..314: mol_type = genomic DNA
cgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgaccagagtc

SEQ ID NO: 99206 - DNA, 272 bp, Homo sapiens
  misc_feature 1..272: note = chr8:23567311-23567583
  misc_feature 1..272: note = hyper
  source 1..272: mol_type = genomic DNA
cgctcccggcgtagacctggggataggggtccctgtcgcgctcgccccacccctgcagggagcaaggccgtccttctgcagcaccgcgccacgcggcgggaatttgcagtgtcctgctttctggtttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattc

SEQ ID NO: 99207 - DNA, 125 bp, Homo sapiens
  misc_feature 1..125: note = chr8:23567657-23567782
  misc_feature 1..125: note = hyper
  source 1..125: mol_type = genomic DNA
cgctggcgcccaggaaagccggggaggaaactaggaagggaggcgacagcagaaaagccagagagtccagagactcctaggcaggcctccgtgcagccccaacagcgtggtgccgggaggtgtgt

SEQ ID NO: 99208 - DNA, 18 bp, Homo sapiens
  misc_feature 1..18: note = chr8:23567842-23567860
  misc_feature 1..18: note = hyper
  source 1..18: mol_type = genomic DNA
catcgtgatcacctctgt

SEQ ID NO: 99209 - DNA, 386 bp, Homo sapiens
  misc_feature 1..386: note = chr8:23571643-23572029
  misc_feature 1..386: note = hyper
  source 1..386: mol_type = genomic DNA
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccgggggtttgcgggcgccgagctgcctccgcgcgc

SEQ ID NO: 99210 - DNA, 243 bp, Homo sapiens
  misc_feature 1..243: note = chr8:23572030-23572273
  misc_feature 1..243: note = hyper
  source 1..243: mol_type = genomic DNA
ttccactccttcagcgtggaaaagaaaaccctcagcggccagagaggcggcggggccttcccggatcgctgattcggggagccgcaggcggggacgctgctgggcgacgcttatctgcgccgcgctcgccagctccgtttcaattaacattccagtgccgccgcccgccgcgggagcggagtccccaccagcccctggaaaaataaactctaggcctagcggctgtgcgtgcgtgtgtgtgtg

SEQ ID NO: 99211 - DNA, 329 bp, Homo sapiens
  misc_feature 1..329: note = chr8:23572333-23572662
  misc_feature 1..329: note = hyper
  source 1..329: mol_type = genomic DNA
agtcccagatcagtgcagtccagagctgcctatccccgggtcgcggttccctgcggggtcgagcctgcgccgggctgcagctctctgtcccactgcgcggcgggatggcagctgctcttttaataaactagcagtcggcggtctgagccctacaatatccccaaagcctggtgtgcgatggaacacatggctgcgtccccagaccccgagaggggagttgcacacacattgctgaccttgagggtcagacagaccctttctcgtctagtttttagcatcagatgtaacctcagcttgggcttctatgatctcatcgatgtccttttgag

SEQ ID NO: 99212 - DNA, 46 bp, Homo sapiens; identical to SEQ ID NO: 3213
  misc_feature 1..46: note = chr8:23583971-23584017
  misc_feature 1..46: note = hyper
  source 1..46: mol_type = genomic DNA

SEQ ID NO: 99213 - DNA, 308 bp, Homo sapiens; identical to SEQ ID NO: 3214
  misc_feature 1..308: note = chr8:23584093-23584401
  misc_feature 1..308: note = hyper
  source 1..308: mol_type = genomic DNA

SEQ ID NO: 99214 - DNA, 240 bp, Homo sapiens
  misc_feature 1..240: note = chr8:23584581-23584821
  misc_feature 1..240: note = hyper
  source 1..240: mol_type = genomic DNA
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctactcctg

SEQ ID NO: 99215 - DNA, 49 bp, Homo sapiens
  misc_feature 1..49: note = chr8:23585236-23585285
  misc_feature 1..49: note = hyper
  source 1..49: mol_type = genomic DNA
cagctgccccacacccggctgcgcgtgcctttctcgcttggatccctgg

SEQ ID NO: 99216 - DNA, 30 bp, Homo sapiens
  misc_feature 1..30: note = chr8:24272681-24272711
  misc_feature 1..30: note = hyper
  source 1..30: mol_type = genomic DNA
acccgggaccttttacgccctcgtgtggcc

SEQ ID NO: 99217 - DNA, 128 bp, Homo sapiens; identical to SEQ ID NO: 41648
  misc_feature 1..128: note = chr8:245097-245225
  misc_feature 1..128: note = hypo
  source 1..128: mol_type = genomic DNA

SEQ ID NO: 99218 - DNA, 69 bp, Homo sapiens; identical to SEQ ID NO: 9432
  misc_feature 1..69: note = chr8:24770293-24770362
  misc_feature 1..69: note = hyper
  source 1..69: mol_type = genomic DNA

SEQ ID NO: 99219 - DNA, 168 bp, Homo sapiens; identical to SEQ ID NO: 31838
  misc_feature 1..168: note = chr8:24770413-24770581
  misc_feature 1..168: note = hyper
  source 1..168: mol_type = genomic DNA

SEQ ID NO: 99220 - DNA, 232 bp, Homo sapiens; identical to SEQ ID NO: 31839
  misc_feature 1..232: note = chr8:24770893-24771125
  misc_feature 1..232: note = hyper
  source 1..232: mol_type = genomic DNA

SEQ ID NO: 99221 - DNA, 226 bp, Homo sapiens; identical to SEQ ID NO: 31840
  misc_feature 1..226: note = chr8:24771349-24771575
  misc_feature 1..226: note = hyper
  source 1..226: mol_type = genomic DNA

SEQ ID NO: 99222 - DNA, 137 bp, Homo sapiens
  misc_feature 1..137: note = chr8:24772604-24772741
  misc_feature 1..137: note = hyper
  source 1..137: mol_type = genomic DNA
gacctttttcagaaacgtgcatcttttccagttctaattttgcacgcttgcacgtttaaagcaggagggatgaattcggtagtggataaatcagcaactttaggatagcttatgcagaaacgcgtgtattctctact

SEQ ID NO: 99223 - DNA, 41 bp, Homo sapiens; identical to SEQ ID NO: 31841
  misc_feature 1..41: note = chr8:24799514-24799555
  misc_feature 1..41: note = hyper
  source 1..41: mol_type = genomic DNA

SEQ ID NO: 99224 - DNA, 68 bp, Homo sapiens
  misc_feature 1..68: note = chr8:24812768-24812836
  misc_feature 1..68: note = hyper
  source 1..68: mol_type = genomic DNA
gccggtgcagcagcacggagcacactcccagactacagtggcgcccgcactcacgcccttcaagtgcc

SEQ ID NO: 99225 - DNA, 324 bp, Homo sapiens; identical to SEQ ID NO: 31842
  misc_feature 1..324: note = chr8:24813140-24813464
  misc_feature 1..324: note = hyper
  source 1..324: mol_type = genomic DNA

SEQ ID NO: 99226 - DNA, 276 bp, Homo sapiens; identical to SEQ ID NO: 3219
  misc_feature 1..276: note = chr8:24813618-24813894
  misc_feature 1..276: note = hyper
  source 1..276: mol_type = genomic DNA

SEQ ID NO: 99227 - DNA, 418 bp, Homo sapiens; identical to SEQ ID NO: 3220
  misc_feature 1..418: note = chr8:24814010-24814428
  misc_feature 1..418: note = hyper
  source 1..418: mol_type = genomic DNA

SEQ ID NO: 99228 - DNA, 375 bp, Homo sapiens
  misc_feature 1..375: note = chr8:24815060-24815435
  misc_feature 1..375: note = hyper
  source 1..375: mol_type = genomic DNA
cttgctaccaccaaccgcagcacatttaaagtccgctttcctctttttacacatgtgtagcacacgacctgatgatttcgataagccttgcagttggctgattttcagggaagccgctgcggccagccctgagcgctgggtgtggtctctggggaggagaactcggcacccaggcttcttcaggaacggatagaaaatagccatagccgcgtgactcttcccccgatacaatgtaataacccgaaaacagatgcagtcaggaatgcatggatttccttcaggaagcacccagatgcttgaaactggcgcacgcggtagcgcacgtggatacaaccctacggtttgcagggcattttcacacgcatgatgttagga

SEQ ID NO: 99229 - DNA, 215 bp, Homo sapiens
  misc_feature 1..215: note = chr8:24816391-24816606
  misc_feature 1..215: note = hyper
  source 1..215: mol_type = genomic DNA
tgaagcctttgactgcagaggaggctgcccagaaaggagaggggcggcgggtgctgcagagggatgcttcagagagaagaaaccattggggcacctgctgcctgccgtcccctgggtagctggaaaaaagaggaacacaggagcaaagggtgagaatgggaccctttcctgtgctgaacccggcccacagagtgggggaaggggcagatccacag

SEQ ID NO: 99230 - DNA, 25 bp, Homo sapiens
  misc_feature 1..25: note = chr8:24816694-24816719
  misc_feature 1..25: note = hyper
  source 1..25: mol_type = genomic DNA
cgaatccagccggggtctgagtttt

SEQ ID NO: 99231 - DNA, 2149 bp, Homo sapiens
  misc_feature 1..2149: note = chr8:24857402-24859551
  misc_feature 1..2149: note = hyper
  source 1..2149: mol_type = genomic DNA
gataagactttcagccgacaactaaataacgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagctgaggactgggacatggtggggtgcgtcggcgagggtcccctgaccctgcacaaacccaggggtgtggtgtggatgacccgggaagccgcacccagagctggcggtatgtcaggccatagagaaaaagggatgttcctaggctaaaggagacatcggggctggggatgacatcccaaaactcccagcgccggggagctcaggctcgggcggtgcctggctcccctccccggttcccgccgcaggaggctgctgagtcactcccgcctgagccacggccgcccccagccagccacgcgattggcgggttagcccgggcgcagcgccctcttcccagctcccgcacccccagggcttcccgcaggcagagggtgggagccccggcgagcgaccagttggggcttggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggaggtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttctccactttttcacttcgatctaattggtcttcaaggttcccgaggctgcgcacca

SEQ ID NO: 99232 - DNA, 398 bp, Homo sapiens
  misc_feature 1..398: note = chr8:25041548-25041946
  misc_feature 1..398: note = hyper
  source 1..398: mol_type = genomic DNA
ggatcccctagcaaacggtctgatacttctgaggagcccacctcccttgcaccagctctccggtgataaaagttctgctttccaggctctaagcggtggccccgggagattcagtctgccctgagtccggcttctcccgctcgcggcgcgggttcaagctccagggggtgaaggcagaagtcaactgctcattcattcaacaaatatttattgcgcgcccgcttagtgccaggcaccggaggtgccccgagcaagaagccgctctcgctgatccgtttccgctccccaagtgtccggcgcgcgccgtgggagcgcagcccgcatccctcgcccaccggccgcccggcctgggcgtgcccggctcctccagcgcagccctctgtcgggagccggacccc

SEQ ID NO: 99233 - DNA, 36 bp, Homo sapiens
  misc_feature 1..36: note = chr8:25042248-25042284
  misc_feature 1..36: note = hyper
  source 1..36: mol_type = genomic DNA
gggcacgggcacgggcgcgggcggcgcggcgaggag

SEQ ID NO: 99234 - DNA, 96 bp, Homo sapiens
  misc_feature 1..96: note = chr8:25042737-25042833
  misc_feature 1..96: note = hyper
  source 1..96: mol_type = genomic DNA
ccagggaaatgtcaacgcgaggggggcgcgcctgctgctcttttggggccgcagctctgtggctcgccccggtgcgcccagcgtgggtttcacctg

SEQ ID NO: 99235 - DNA, 41 bp, Homo sapiens; identical to SEQ ID NO: 41735
  misc_feature 1..41: note = chr8:25318815-25318856
  misc_feature 1..41: note = hypo
  source 1..41: mol_type = genomic DNA

SEQ ID NO: 99236 - DNA, 44 bp, Homo sapiens
  misc_feature 1..44: note = chr8:2536006-2536050
  misc_feature 1..44: note = hypo
  source 1..44: mol_type = genomic DNA
agaataaggatgcttcggttagaaattgtcgatggaagagcatt

SEQ ID NO: 99237 - DNA, 30 bp, Homo sapiens
  misc_feature 1..30: note = chr8:2537563-2537593
  misc_feature 1..30: note = hypo
  source 1..30: mol_type = genomic DNA
ggcgcctgtccaatccgcccatttttttgt

SEQ ID NO: 99238 - DNA, 34 bp, Homo sapiens
  misc_feature 1..34: note = chr8:2538299-2538333
  misc_feature 1..34: note = hypo
  source 1..34: mol_type = genomic DNA
aaactcgattgtgctcgagcgtccgtaaagacca

SEQ ID NO: 99239 - DNA, 216 bp, Homo sapiens; identical to SEQ ID NO: 41736
  misc_feature 1..216: note = chr8:25397045-25397261
  misc_feature 1..216: note = hypo
  source 1..216: mol_type = genomic DNA

SEQ ID NO: 99240 - DNA, 138 bp, Homo sapiens
  misc_feature 1..138: note = chr8:25899282-25899420
  misc_feature 1..138: note = hyper
  source 1..138: mol_type = genomic DNA
cccagagaaggggagcggcggccttgggtgtactttttaactagtccaaggggcgtttgctccgccgtcagtccataaccaggcgctactaaggcctccaggctcggtgcgcagagccgggagcgctcctccagctcc

SEQ ID NO: 99241 - DNA, 285 bp, Homo sapiens; identical to SEQ ID NO: 31853
  misc_feature 1..285: note = chr8:25900408-25900693
  misc_feature 1..285: note = hyper
  source 1..285: mol_type = genomic DNA

SEQ ID NO: 99242 - DNA, 237 bp, Homo sapiens; identical to SEQ ID NO: 3223
  misc_feature 1..237: note = chr8:25900780-25901017
  misc_feature 1..237: note = hyper
  source 1..237: mol_type = genomic DNA

SEQ ID NO: 99243 - DNA, 1167 bp, Homo sapiens
  misc_feature 1..1167: note = chr8:25901018-25902185
  misc_feature 1..1167: note = hyper
  source 1..1167: mol_type = genomic DNA
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggccagtttgggaaagggatcatttctccgtgtgatgttggcacttaaatgtgggtggccaggagggcagcaggggaagcgagggtagtggaagaagttcatcggctctttgggggtagaagggctgcctctctcgcagacaaggacctggaggccacaaatcccaactcagtagtggtgatgagagagtgggaccgtaatgtcttcgtagggtggcaccccggacatggtatttactatcccagcacgcagacgcctaaacacaaagtcaacttcagggatccgcaaaaccagaggctggcgatccctgagccagtctagctgctggtggccttttctcgcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 99244 - DNA, 30 bp, Homo sapiens
  misc_feature 1..30: note = chr8:25902535-25902565
  misc_feature 1..30: note = hyper
  source 1..30: mol_type = genomic DNA
cctttgcttcactggcgaggtgcggactga

SEQ ID NO: 99245 - DNA, 126 bp, Homo sapiens
  misc_feature 1..126: note = chr8:25902843-25902969
  misc_feature 1..126: note = hyper
  source 1..126: mol_type = genomic DNA
ggagccgagaggaggcggtggctgcgagcgccacggagcccggctgcagccgcgcgcgggccccatgaatgggttactacggccctggctgcgggaggcggagctgcggcccgataaggagcctca

SEQ ID NO: 99246 - DNA, 899 bp, Homo sapiens
  misc_feature 1..899: note = chr8:25903468-25904367
  misc_feature 1..899: note = hyper
  source 1..899: mol_type = genomic DNA
ggtggggcggacaagcgaggggcaagtgctgctcaaatacagtgctggggaaaacggtccaggacctaaggaaaacacccgcgggcgggcgggcgcgagcggcagtcgcacccgtgtggaggagaggttgctgacagatcgaggcgggctgagtgcgcgagcggccggggagtattcccgcgggtcctccggttccctccccacctctccgttcccgaagcccccggtagtgggcggggagggacgggggagtcgtggaaacttcgcccaccgcgcgcggtcgccgcggtgctggccgcgggctggtggccggcaggcggtggcagcagcctcaccgaacagctgaaaccctagacggttttttaactgcgcggggctgctcgcggtgcctattaaacatcctcctggctgggtgtcattttcttgcttctccttttgtattctgatctgcgcatagatctgctgctgctgaaatctagaacaccagcgcgaaaacagatttgaagacaatgaatgcaaatctgtgctcaaagaccatctgccgtggaggagacaatcagctgttcgtagttcgagcgattgcgccccagtctcccggtctcattacggggagggcatttgcgagcgcctggactgcgttcagggcactttctcccctcttgggtctcagatttgagagaccagatcccttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 99247 - DNA, 64 bp, Homo sapiens
  misc_feature 1..64: note = chr8:25904571-25904635
  misc_feature 1..64: note = hyper
  source 1..64: mol_type = genomic DNA
ttggactggaaggggcgggagagccatacagggcgattgggaaatggatcgggtggctagtaaa

SEQ ID NO: 99248 - DNA, 731 bp, Homo sapiens
  misc_feature 1..731: note = chr8:25904898-25905629
  misc_feature 1..731: note = hyper
  source 1..731: mol_type = genomic DNA
agagtgtggaacagccgtgagcccttcaagacatgcctatgagcccggtgatttttttttcaagggggctttgatcagctgtacctccacgttgccccggaaaggtgcgcagggcacccggagaggcctctggtcagcagtgggcctgggccaagccccaacagtttacccctcaggctcaggttggctggggttaaagggcaaagtcagggtcgagggcaccagcttttctcggcggtaacagctgccacccaaattatgccccctcaggaagcgaatgaattgttcctttctcccagctccctgctgcccgccccaaaacagacggggccgcgctcggcgggcgcccctcctcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 99249 - DNA, 143 bp, Homo sapiens
  misc_feature 1..143: note = chr8:25905695-25905838
  misc_feature 1..143: note = hyper
  source 1..143: mol_type = genomic DNA
cgatctcgtgcaacacaaaacctgccccgagctgtgcgggggcctggcaagcgcagctgcggccccgggaagcccaatcccgcgggactgcggagcccacgcgctcctcaggctccggccaactagctcggttctgcctctag

SEQ ID NO: 99250 - DNA, 88 bp, Homo sapiens
  misc_feature 1..88: note = chr8:25906080-25906168
  misc_feature 1..88: note = hyper
  source 1..88: mol_type = genomic DNA
cgccaagtctctcctcccgatcagaggttcggaaattttacttagaaactgctctcctggctgtgttcctgtccggcaggacactggg

SEQ ID NO: 99251 - DNA, 57 bp, Homo sapiens; identical to SEQ ID NO: 31863
  misc_feature 1..57: note = chr8:25907271-25907328
  misc_feature 1..57: note = hyper
  source 1..57: mol_type = genomic DNA

SEQ ID NO: 99252 - DNA, 33 bp, Homo sapiens
  misc_feature 1..33: note = chr8:25908392-25908425
  misc_feature 1..33: note = hyper
  source 1..33: mol_type = genomic DNA
ccccctcacctgccgcgagccgggcaatcattt

SEQ ID NO: 99253 - DNA, 15 bp, Homo sapiens
  misc_feature 1..15: note = chr8:25908502-25908517
  misc_feature 1..15: note = hyper
  source 1..15: mol_type = genomic DNA
cgctctcctggccgg

SEQ ID NO: 99254 - DNA, 637 bp, Homo sapiens
  misc_feature 1..637: note = chr8:25908962-25909599
  misc_feature 1..637: note = hyper
  source 1..637: mol_type = genomic DNA
gctttgcttgccttacggataagacagcttaggtgaaagtatctggcacgcagtaggtgttcaataaacgcttgctttccttcagcatctgcaggtgtaagatgaggatgatcacatctgcttatggaattcactgggtcctgagtctcctatggggatgggtttcctttcccccgacctatgcgctcctgaggcagggattctgactcgcttgtccttgcagctcctttgcctggcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagac

SEQ ID NO: 99255 - DNA, 99 bp, Homo sapiens
  misc_feature 1..99: note = chr8:25909600-25909699
  misc_feature 1..99: note = hyper
  source 1..99: mol_type = genomic DNA
cggctcgcctgacactactggtctctgtctcccgagagccagagccgagctccccgagtggtgctttccagagcccgcattaaacgaagctgggaggga

SEQ ID NO: 99256 - DNA, 30 bp, Homo sapiens
  misc_feature 1..30: note = chr8:26187766-26187796
  misc_feature 1..30: note = hypo
  source 1..30: mol_type = genomic DNA
cacatttttgtctttcgtcttttatttctc

SEQ ID NO: 99257 - DNA, 124 bp, Homo sapiens
  misc_feature 1..124: note = chr8:26267081-26267205
  misc_feature 1..124: note = hypo
  source 1..124: mol_type = genomic DNA
actgtgtgactgttgcgtgggggttgatgtggggcaggtgtaggagtttaatacattgctgcctatacagcagttcattgcccttaagcgattggtgtctataccttgccgtctctctttcagt

SEQ ID NO: 99258 - DNA, 30 bp, Homo sapiens
  misc_feature 1..30: note = chr8:26267880-26267910
  misc_feature 1..30: note = hypo
  source 1..30: mol_type = genomic DNA
atctatattggaaagcgactgagcacaccc

SEQ ID NO: 99259 - DNA, 200 bp, Homo sapiens
  misc_feature 1..200: note = chr8:26306037-26306237
  misc_feature 1..200: note = hyper
  source 1..200: mol_type = genomic DNA
ggccggggaatgcaccgagctgcgcgcttccagcgccgtcggtctggggtttctgccattctaactcccaaggcttttctattttgggcttaaaaagatgcagagtccccttttatcggtcaggcttgtagcagaaggttcaggtccaagaggaccttttggatttagtcctttctgtcggctcccgcagtcaaaacccc

SEQ ID NO: 99260 - DNA, 38 bp, Homo sapiens
  misc_feature 1..38: note = chr8:26370063-26370101
  misc_feature 1..38: note = hyper
  source 1..38: mol_type = genomic DNA
ggatccctggttacacggccctacgcggtggccctgcg

SEQ ID NO: 99261 - skipped

SEQ ID NO: 99262 - DNA, 659 bp, Homo sapiens
  misc_feature 1..659: note = chr8:26370553-26371212
  misc_feature 1..659: note = hyper
  source 1..659: mol_type = genomic DNA
ggggaaccaggcggggctctggggcgcaggggaaagctggagatttgggaagggggtttcagtttgttttttctctctttttttttttttttttttttttttggtggaggaagcagaataaaccaaatcgcgacacgttcctgcgcccttcttggcgcagtggcgcagacacggtccatggcgccttgcgcaatagagtcggtctgcaccccgtctttaagtcgtggccctgggctggaattcccgactgcactctttgctacacccccatagaccgcagacctgcgtctctctctatattcctctcccatctgctacgcccctctgaatttcttcccgccatgttgtgtgccccccccccactcccccgtcaccccaaccacaccaaagtggatgcacgaagcgggaaccttctcgtttcagtctctgctccctgcagcctgccaaggcgagtggacaaactgaagctggggtgtccagcgtcttggctgcccccctcctgtccaccctgcctgtgctatccttgctcatcttcagtgccatcccgcttcccacaccctgagtagcctggcgcccggcttgtccccttttcccatccatcagctcacacccagggtaacggggcgggacccctatccacagtgcgccctcgcccccgg

SEQ ID NO: 99263 - DNA, 480 bp, Homo sapiens
  misc_feature 1..480: note = chr8:26371670-26372150
  misc_feature 1..480: note = hyper
  source 1..480: mol_type = genomic DNA
gggagggtgggtcgccggctcgccagccctccttcctttctgtgcaccttgcggtgggcggcgaacggcagccgcggcagcagctagggggcttgtgcacacagcgagggagacttagggactggcagacggacggacggacggcgaggaccctacccgagcccccgagccatggccgagagaaagcaatccgggaaggcggcagaggacgaagaggtccctgctttttttaaaaacctgggctccggcagccccaagccccggcagaaattctgtggcatgttctgcccggtggaagggtcctcggagaacaagaccatcgacttcgactcgctgtcggtgggccggggctcggggcaggtggtggctcagcagcgggacgtcgcccacttgggcccggacccgcagccgccgtactcgcggcagggccggcgcgccggcggagagccatctgttgaatcgggccggaaggtggagatc

SEQ ID NO: 99264 - DNA, 500 bp, Homo sapiens
  misc_feature 1..500: note = chr8:26372420-26372920
  misc_feature 1..500: note = hyper
  source 1..500: mol_type = genomic DNA
gcttgagaggtggggcgtgggcatagggaatgggctgatcccctgctggggcgggcggtggtcgtctgggagggggttggccgcggttccattcttctgaaaccctcccgggcggcttccgattgcagctgcggctgggtgccccaccctttttttgagcggctcagagcgtgcggtggaggctttgcgtgaaggcccgcggctccccggtggtcgggaggggcgggggttcggacggccgctccctacagcctccgcccgcgccttctgcgctcacgtcccgagctccgaggccaggaccatggtcagcgccccccggaccccctccgagcaccgcaccgcccttgactcctgctcgcagcgtgagaagagccaggaaggctgtggagtcacccgaggaaaccgagacgctcctaaatagcctatgtggggaacaaagttccaataagtgtctcagccggggcttcacagagcgctccccaaaccgctatgtgggaggc

SEQ ID NO: 99265 - DNA, 56 bp, Homo sapiens; identical to SEQ ID NO: 41689
  misc_feature 1..56: note = chr8:2652772-2652828
  misc_feature 1..56: note = hypo
  source 1..56: mol_type = genomic DNA

SEQ ID NO: 99266 - DNA, 135 bp, Homo sapiens
  misc_feature 1..135: note = chr8:26629344-26629479
  misc_feature 1..135: note = hypo
  source 1..135: mol_type = genomic DNA
cctcattctgtataacgctgaggggatcatcacataggataaggtcaatgtcgtttctaaagcagctggggtaaatgatgacggcttttggcctggcttgtctgccaaggccctggccatcgtcaacttcgggag

SEQ ID NO: 99267 - DNA, 159 bp, Homo sapiens
  misc_feature 1..159: note = chr8:26637232-26637391
  misc_feature 1..159: note = hypo
  source 1..159: mol_type = genomic DNA
tgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctc

SEQ ID NO: 99268 - DNA, 64 bp, Homo sapiens
  misc_feature 1..64: note = chr8:26721627-26721691
  misc_feature 1..64: note = hyper
  source 1..64: mol_type = genomic DNA
gcagccagcagaggacgaagcagccgaccacgatgcccagcgttttggccgctttcttctcccg

SEQ ID NO: 99269 - DNA, 30 bp, Homo sapiens
  misc_feature 1..30: note = chr8:26722735-26722765
  misc_feature 1..30: note = hyper
  source 1..30: mol_type = genomic DNA
accctctccacctgccgggctggcctagcc

SEQ ID NO: 99270 - DNA, 598 bp, Homo sapiens
  misc_feature 1..598: note = chr8:26722986-26723584
  misc_feature 1..598: note = hyper
  source 1..598: mol_type = genomic DNA
ccgatggttgggtagcgcagcgctacaggttgggcgctgctcctggcccgcagttacctacattttgagctgccccaccgaaggctcctgctctctccagcttctaggagcacaggtcaggggacgtaggtgtggaatatgtgctgagacccaggaggctgcggggcatcgtttgaccgcgtccacctgaaagagcgcaaagagaaaggcggctttgagctaggcgccccagggaaagaggctgtgctgagcttgacgggttgggggacaccagttgggagccgggttggttctgcggtccagaagctgcttcgcccggcagcggtggaggcgacttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttcc

SEQ ID NO: 99271 - DNA, 855 bp, Homo sapiens; identical to SEQ ID NO: 31872
  misc_feature 1..855: note = chr8:26723585-26724440
  misc_feature 1..855: note = hyper
  source 1..855: mol_type = genomic DNA

SEQ ID NO: 99272 - DNA, 169 bp, Homo sapiens; identical to SEQ ID NO: 31873
  misc_feature 1..169: note = chr8:26724484-26724653
  misc_feature 1..169: note = hyper
  source 1..169: mol_type = genomic DNA

SEQ ID NO: 99273 - DNA, 150 bp, Homo sapiens
  misc_feature 1..150: note = chr8:26852267-26852417
  misc_feature 1..150: note = hypo
  source 1..150: mol_type = genomic DNA
atttttatcagactgcgaaaagcattgttgtcacaaaagagtttaagaaccggttctaggacttgaggacttttaccactgtttctgaaacctcactgtctttttttttttttaatcgcactccatcacccagactgaagtgcagtagtg

SEQ ID NO: 99274 - DNA, 38 bp, Homo sapiens
  misc_feature 1..38: note = chr8:273114-273152
  misc_feature 1..38: note = hypo
  source 1..38: mol_type = genomic DNA
attcaccccagagggcgaggagccggatagatgtccgt

SEQ ID NO: 99275 - DNA, 30 bp, Homo sapiens
  misc_feature 1..30: note = chr8:27320956-27320986
  misc_feature 1..30: note = hypo
  source 1..30: mol_type = genomic DNA
tgaacagcaggtactcgccgatgagcggga

SEQ ID NO: 99276 - DNA, 30 bp, Homo sapiens
  misc_feature 1..30: note = chr8:27449851-27449881
  misc_feature 1..30: note = hyper
  source 1..30: mol_type = genomic DNA
cctcgtttctcccagcgctgccctccccat

SEQ ID NO: 99277 - DNA, 39 bp, Homo sapiens
  misc_feature 1..39: note = chr8:27472031-27472070
  misc_feature 1..39: note = hyper
  source 1..39: mol_type = genomic DNA
tggcttcctgggctccgtcgaaagcgcaggggttgtgac

SEQ ID NO: 99278 - DNA, 440 bp, Homo sapiens
  misc_feature 1..440: note = chr8:27491124-27491564
  misc_feature 1..440: note = hyper
  source 1..440: mol_type = genomic DNA
ccattgcggccgcagcgcgggcagggaggacgccgcgggagcccgggttcgaggctgggctgtggggctgcgggggcgcacgggcgaggtaggcggggcgcggggcccccgcggcggcacaaagaggccggccgcggcagttttgaaaataccaaggaagttgatctgggccggggcccaagaagtgacgaggagggagggaggcttgcgagcgagggaggaaaggagggagagggagaggagaaggcgggaaggagggagggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccg

SEQ ID NO: 99279 - DNA, 30 bp, Homo sapiens
  misc_feature 1..30: note = chr8:27779779-27779809
  misc_feature 1..30: note = hypo
  source 1..30: mol_type = genomic DNA
gggagacttgagcaccgctggggaggaagg

SEQ ID NO: 99280 - DNA, 100 bp, Homo sapiens
  misc_feature 1..100: note = chr8:27914736-27914836
  misc_feature 1..100: note = hypo
  source 1..100: mol_type = genomic DNA
gtcatttcagatgtacgattcatcttgtaaacagatgaagtaaacttatgctattgataaatacggtgccgtattgtaaatgtattttctcttccttatg

SEQ ID NO: 99281 - DNA, 30 bp, Homo sapiens; identical to SEQ ID NO: 41739
  misc_feature 1..30: note = chr8:27931084-27931114
  misc_feature 1..30: note = hypo
  source 1..30: mol_type = genomic DNA

SEQ ID NO: 99282 - DNA, 234 bp, Homo sapiens
  misc_feature 1..234: note = chr8:28209327-28209561
  misc_feature 1..234: note = hypo
  source 1..234: mol_type = genomic DNA
tgtgggagggagatgcggtataatcaggggcaccctgcccccttcaaacccagcggggaccgcggtagggagggaagtgattgcttgaggccacccagcaagccagggacggagcccaagagaacacccaggtgcctcgctcctgacgggtgtcaccaggattatgtgttgcacatcaacgggaattatttttcctggcacctaaggctcattctctcccggaacatgtgccaa

SEQ ID NO: 99283 - DNA, 121 bp, Homo sapiens
  misc_feature 1..121: note = chr8:28221168-28221289
  misc_feature 1..121: note = hyper
  source 1..121: mol_type = genomic DNA
ctaatggcctccccacgttctagagcaggaagtttggggtttctaccactgaaaatgaagaaagggtagtatttcccaaattcctgggctcccagtcttcagacggcgcctgaaatgtttg

SEQ ID NO: 99284 - DNA, 34 bp, Homo sapiens
  misc_feature 1..34: note = chr8:28515693-28515727
  misc_feature 1..34: note = hyper
  source 1..34: mol_type = genomic DNA
gcatatgcttgacaccggacggtgggtggggggg

SEQ ID NO: 99285 - DNA, 30 bp, Homo sapiens
  misc_feature 1..30: note = chr8:28926240-28926270
  misc_feature 1..30: note = hypo
  source 1..30: mol_type = genomic DNA
ccatagtgacaccagcggacccaaaaacaa

SEQ ID NO: 99286 - DNA, 30 bp, Homo sapiens; identical to SEQ ID NO: 41740
  misc_feature 1..30: note = chr8:28938557-28938587
  misc_feature 1..30: note = hypo
  source 1..30: mol_type = genomic DNA

SEQ ID NO: 99287 - DNA, 30 bp, Homo sapiens; identical to SEQ ID NO: 41741
  misc_feature 1..30: note = chr8:29157762-29157792
  misc_feature 1..30: note = hypo
  source 1..30: mol_type = genomic DNA

SEQ ID NO: 99288 - DNA, 218 bp, Homo sapiens
  misc_feature 1..218: note = chr8:29209258-29209476
  misc_feature 1..218: note = hyper
  source 1..218: mol_type = genomic DNA
ggtccacatttgttgcggagctggaccctggaaaatgtacccgcaaagaatgaccttttgaaaggacttcagcagctctgggtccgattcatgtttctgggcatccctttttcctggtcacgtagcagccctccccatccccatttctcttttgcatttaatttcccagaggcggcttttggctgggggtttgtgcacgcacgcggtggggaccgtgc

SEQ ID NO: 99289 - DNA, 140 bp, Homo sapiens
  misc_feature 1..140: note = chr8:29209803-29209943
  misc_feature 1..140: note = hyper
  source 1..140: mol_type = genomic DNA
tcccccactgggccccgaatgcctcgacccccgggccctactcggatgagctgtaggggcaccgcttgggcaaggtgatatttccttttgctccgggctccaaaatggcttacgatggcactgcacggatcctttctctt

SEQ ID NO: 99290 - DNA, 35 bp, Homo sapiens
  misc_feature 1..35: note = chr8:29387332-29387367
  misc_feature 1..35: note = hyper
  source 1..35: mol_type = genomic DNA
ccaaacaacaaaccacgcggcgttctctggtggct

SEQ ID NO: 99291 - DNA, 77 bp, Homo sapiens
  misc_feature 1..77: note = chr8:29387636-29387713
  misc_feature 1..77: note = hyper
  source 1..77: mol_type = genomic DNA
tcaatggtgtacccacgtggagttcattatttatctccgaaagccctgtctgtctctcattccgacccttaaacgaa

SEQ ID NO: 99292 - DNA, 28 bp, Homo sapiens
  misc_feature 1..28: note = chr8:29596408-29596436
  misc_feature 1..28: note = hypo
  source 1..28: mol_type = genomic DNA
tttttaggctgggcacggtagttcatgc

SEQ ID NO: 99293 - DNA, 28 bp, Homo sapiens
  misc_feature 1..28: note = chr8:29596676-29596704
  misc_feature 1..28: note = hypo
  source 1..28: mol_type = genomic DNA
cagaacaagactccgtctcaaaaaaaaa

SEQ ID NO: 99294 - DNA, 129 bp, Homo sapiens
  misc_feature 1..129: note = chr8:299672-299801
  misc_feature 1..129: note = hypo
  source 1..129: mol_type = genomic DNA
cacctggagaggccacgagggacgttcctccggagcactgagccgggactgcgacaaggggtcctagcagggagccacgagggcaccggcccctccgtccacatcctccaggctcggaggcctctgccc

SEQ ID NO: 99295 - DNA, 111 bp, Homo sapiens
  misc_feature 1..111: note = chr8:30241501-30241612
  misc_feature 1..111: note = hyper
  source 1..111: mol_type = genomic DNA
ctgtcctgaaaaagccggcccggagtgggctgtccccggtgtccctcgagttctcatgctgtcattcaagcagcagaggaagaaccgggtctggctcgggaagggtgggct

SEQ ID NO: 99296 - DNA, 67 bp, Homo sapiens
  misc_feature 1..67: note = chr8:30242630-30242697
  misc_feature 1..67: note = hyper
  source 1..67: mol_type = genomic DNA
agaaggagaacaccccgagcgaggccaaccttcaggaggaggaggtactgggcggctcggtgtggtg

SEQ ID NO: 99297 - DNA, 117 bp, Homo sapiens
  misc_feature 1..117: note = chr8:30243058-30243175
  misc_feature 1..117: note = hyper
  source 1..117: mol_type = genomic DNA
tttaaggaagaaactcgggggaaagttctcgttaaaagatacctctattccctgccccctccctttccgtgttaaaagttcttggtgaaatatctttctagccgaggttttttggat

SEQ ID NO: 99298 - DNA, 159 bp, Homo sapiens
  misc_feature 1..159: note = chr8:30243388-30243547
  misc_feature 1..159: note = hyper
  source 1..159: mol_type = genomic DNA
aaagttttgtgactgcggagcgttccttcggtggaaacaaaattgagtagatgtggtcagaaggggagtcggactcaggaacaaacgtttcagaattcagtaggatatttgtggtatcctaccaaatgactctttttgcaggtacgttatctggagtcc

SEQ ID NO: 99299 - DNA, 87 bp, Homo sapiens
  misc_feature 1..87: note = chr8:3036403-3036490
  misc_feature 1..87: note = hypo
  source 1..87: mol_type = genomic DNA
cctgataccatttgacgctaattgtagtaaggttaattctacaaatactttctataatctatatttctttttttttttttttttgag

SEQ ID NO: 99300 - DNA, 148 bp, Homo sapiens
  misc_feature 1..148: note = chr8:3040630-3040778
  misc_feature 1..148: note = hypo
  source 1..148: mol_type = genomic DNA
ctatccctgaaacatcgagtaggtctctaacgcctaatctatctatccctgaaacatcgagtaggtctctaacgcctaatctatctatccctgaaatatcgagtaggtctctaacgtttcttaacgataccatcggcatccatccacg

SEQ ID NO: 99301 - DNA, 615 bp, Homo sapiens
  misc_feature 1..615: note = chr8:30769168-30769783
  misc_feature 1..615: note = hyper
  source 1..615: mol_type = genomic DNA
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcaggggagaatgaggcgcgcggactgccagtcacccgggcggcgttccc

SEQ ID NO: 99302 - DNA, 288 bp, Homo sapiens
  misc_feature 1..288: note = chr8:30769822-30770110
  misc_feature 1..288: note = hyper
  source 1..288: mol_type = genomic DNA
cgagttgcggtcccggggcggcggggctcccgccccctccccgcccccgcggatatccccacgcaccacgaagatccccacgcgccctgcgcaacgcggctgctccgcgctgccttctgctgactacaaactgcgcctccagggagccagggcgaggcggaggccaccaccaagttgtggcgctctctcctctcgctgcctcagagcagcgagtttctcctcagctgcaaacaaggacgcagggccagctccgtggggctcagcgggggcagagggagagcgaaagcg

SEQ ID NO: 99303 - DNA, 31 bp, Homo sapiens
  misc_feature 1..31: note = chr8:30770157-30770188
  misc_feature 1..31: note = hyper
  source 1..31: mol_type = genomic DNA
cggctgccctggccctcggaggcccaccttt

SEQ ID NO: 99304 - DNA, 30 bp, Homo sapiens
  misc_feature 1..30: note = chr8:308732-308762
  misc_feature 1..30: note = hypo
  source 1..30: mol_type = genomic DNA
tttatcattgtagttcgtcacattgtcaga

SEQ ID NO: 99305 - DNA, 435 bp, Homo sapiens
  misc_feature 1..435: note = chr8:30890092-30890527
  misc_feature 1..435: note = hyper
  source 1..435: mol_type = genomic DNA
ttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccggctcccccggcgccgcagcgcggggctccagccactgccggccggttggcggccgccgctccggctctgcccgcgctccccgcatccctccgccgcccccggggccgc

SEQ ID NO: 99306 - DNA, 609 bp, Homo sapiens
  misc_feature 1..609: note = chr8:31496433-31497042
  misc_feature 1..609: note = hyper
  source 1..609: mol_type = genomic DNA
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgc

SEQ ID NO: 99307 - DNA, 35 bp, Homo sapiens
  misc_feature 1..35: note = chr8:31497043-31497078
  misc_feature 1..35: note = hyper
  source 1..35: mol_type = genomic DNA
ctctctcccagccgcttgctcgcagccccagcagc

SEQ ID NO: 99308 - DNA, 535 bp, Homo sapiens
  misc_feature 1..535: note = chr8:31497426-31497961
  misc_feature 1..535: note = hyper
  source 1..535: mol_type = genomic DNA
ggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 99309 - DNA, 36 bp, Homo sapiens
  misc_feature 1..36: note = chr8:31498297-31498333
  misc_feature 1..36: note = hyper
  source 1..36: mol_type = genomic DNA
gggcgcgcgggcagcggggctcgacggccgcccgag

SEQ ID NO: 99310 - DNA, 30 bp, Homo sapiens
  misc_feature 1..30: note = chr8:31728987-31729017
  misc_feature 1..30: note = hypo
  source 1..30: mol_type = genomic DNA
gcattaaacttttctcggtgttctctaatt

SEQ ID NO: 99311 - DNA, 208 bp, Homo sapiens
  misc_feature 1..208: note = chr8:32277303-32277511
  misc_feature 1..208: note = hypo
  source 1..208: mol_type = genomic DNA
ttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagtt

SEQ ID NO: 99312 - DNA, 158 bp, Homo sapiens; identical to SEQ ID NO: 31883
  misc_feature 1..158: note = chr8:32404798-32404956
  misc_feature 1..158: note = hyper
  source 1..158: mol_type = genomic DNA

SEQ ID NO: 99313 - DNA, 339 bp, Homo sapiens
  misc_feature 1..339: note = chr8:32405453-32405792
  misc_feature 1..339: note = hyper
  source 1..339: mol_type = genomic DNA
agcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgc

SEQ ID NO: 99314 - DNA, 444 bp, Homo sapiens
  misc_feature 1..444: note = chr8:32405793-32406237
  misc_feature 1..444: note = hyper
  source 1..444: mol_type = genomic DNA
gggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctc

SEQ ID NO: 99315 - DNA, 577 bp, Homo sapiens
  misc_feature 1..577: note = chr8:32406351-32406928
  misc_feature 1..577: note = hyper
  source 1..577: mol_type = genomic DNA
cgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 99316 - DNA, 53 bp, Homo sapiens; identical to SEQ ID NO: 9466
  misc_feature 1..53: note = chr8:32406929-32406982
  misc_feature 1..53: note = hyper
  source 1..53: mol_type = genomic DNA

SEQ ID NO: 99317 - DNA, 30 bp, Homo sapiens
  misc_feature 1..30: note = chr8:3245048-3245078
  misc_feature 1..30: note = hypo
  source 1..30: mol_type = genomic DNA
ggttcctctcacagacgaggggctcgtcgt

SEQ ID NO: 99318 - DNA, 148 bp, Homo sapiens; identical to SEQ ID NO: 41744
  misc_feature 1..148: note = chr8:32987430-32987578
  misc_feature 1..148: note = hypo
  source 1..148: mol_type = genomic DNA

SEQ ID NO: 99319 - DNA, 439 bp, Homo sapiens
  misc_feature 1..439: note = chr8:33371767-33372206
  misc_feature 1..439: note = hyper
  source 1..439: mol_type = genomic DNA
tgcaatactttagctggtttctggagctagcgttttaaagcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcatgggtcgcaggcggcgcccggaacgggccaggggagctggaggctgcagactcgggctcggcgggtgtaggaaccagtggtgtttgcttgggttttgagaaggcgcgagaagggtcgcgcctgtgcgaccgccctgtgttgggtcccccacgccgcgtcggcattgcttgttccctcttcctgcgctttcctggagggtagaattgcgtccgattggccttcagt

SEQ ID NO: 99320 - DNA, 450 bp, Homo sapiens
  misc_feature 1..450: note = chr8:33456975-33457425
  misc_feature 1..450: note = hyper
  source 1..450: mol_type = genomic DNA
caggtccatggctgtcgccccagtcctcgccagcctggcagccgggccccgcgcgcggagggagggcgcccgggagagagaggctggctcgctgggctcgggtgcccgcttcccggtcccctccctcccccgtcgcccctagctgggcgcctctccccagcgtggagagccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaagggactcggtctcacattcggtggcccgagtcgccaggcagcgtgg

SEQ ID NO: 99321 - DNA, 30 bp, Homo sapiens
  misc_feature 1..30: note = chr8:33578771-33578801
  misc_feature 1..30: note = hypo
  source 1..30: mol_type = genomic DNA
acggccacaggaccacgcttttgttcctgt

SEQ ID NO: 99322 - DNA, 89 bp, Homo sapiens
  misc_feature 1..89: note = chr8:35092605-35092694
  misc_feature 1..89: note = hyper
  source 1..89: mol_type = genomic DNA
agtagatgaacaaaacggaggtctcctggaagcaggtgactgagttaggcaaccgagatgcccacatatctgtgcggcgttcgccccaa

SEQ ID NO: 99323 - DNA, 124 bp, Homo sapiens; identical to SEQ ID NO: 31892
  misc_feature 1..124: note = chr8:35093036-35093160
  misc_feature 1..124: note = hyper
  source 1..124: mol_type = genomic DNA

SEQ ID NO: 99324 - DNA, 318 bp, Homo sapiens
  misc_feature 1..318: note = chr8:35093225-35093543
  misc_feature 1..318: note = hyper
  source 1..318: mol_type = genomic DNA
cgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggtaagcgctgggcggagcgggcagctgggggcgagggcgcaggggcgccagcctgacggagcgggacctgcaccgatggcgttggcttcccaacttgcgccctgcacctcggcgctccaagcccaaccggatgggagc

SEQ ID NO: 99325 - skipped

SEQ ID NO: 99326 - DNA, 23 bp, Homo sapiens
  misc_feature 1..23: note = chr8:35093951-35093974
  misc_feature 1..23: note = hyper
  source 1..23: mol_type = genomic DNA
gccagccctggagctcgggagag

SEQ ID NO: 99327 - DNA, 32 bp, Homo sapiens
  misc_feature 1..32: note = chr8:35094035-35094067
  misc_feature 1..32: note = hyper
  source 1..32: mol_type = genomic DNA
cgaggctgctcaccaggcgcctcctctccctt

SEQ ID NO: 99328 - DNA, 26 bp, Homo sapiens
  misc_feature 1..26: note = chr8:36179048-36179074
  misc_feature 1..26: note = hypo
  source 1..26: mol_type = genomic DNA
ggccgagacctgcagcggaacctagg

SEQ ID NO: 99329 - DNA, 204 bp, Homo sapiens
  misc_feature 1..204: note = chr8:36852809-36853013
  misc_feature 1..204: note = hypo
  source 1..204: mol_type = genomic DNA
ttgatcctgacctaacgggtcagtgagcgctcagagtgaagcagacttaccctgctgccctgtgtgtgtatggcagatagggcatagaatttgactcaacactttcattccctctctgactcattttgctattaattgtcacctccttcacaagactgccccatcaaagatcctgtggaaattatttaccgagagatttctcag

SEQ ID NO: 99330 - DNA, 34 bp, Homo sapiens
  misc_feature 1..34: note = chr8:37552075-37552109
  misc_feature 1..34: note = hyper
  source 1..34: mol_type = genomic DNA
gcctccactggccgccgagcgcacggagaagtgg

SEQ ID NO: 99331 - DNA, 494 bp, Homo sapiens
  misc_feature 1..494: note = chr8:37552317-37552811
  misc_feature 1..494: note = hyper
  source 1..494: mol_type = genomic DNA
aagtgctttttcccccggagtgagaaggatgggggggcggaggggttgtgttgccgagcagcgcttagagagagatccccctccagggacacccgcctcgcccgtgatctcggtctctcctcgtagcagctgggcgcggtacagtgaggaacttcacgcccctcagcaggacacggtaagaagcctgtaacacaccagacaccgagcctctaacgcagggcgcaggcacagcgcgcacagcctggggtcccgcgcttggtcgccgaccatgtcactccagaagggagacaaacttgcaggcttcagacaagacgggctcaaagtagttggagctgcctacgccgcgtcccgagaacagtgggtgcctccgaggctcgggcgcttccaagtgaacacaccaaggggaggccaagtaggggaaggagagcggggccgaggagagccggagcagctctggagaaggacccgggctcccgaggcgaggcctgccccca

SEQ ID NO: 99332 - DNA, 30 bp, Homo sapiens
  misc_feature 1..30: note = chr8:37595317-37595347
  misc_feature 1..30: note = hyper
  source 1..30: mol_type = genomic DNA
tggatatgagtcactcgcagggagctcagc

SEQ ID NO: 99333 - DNA, 63 bp, Homo sapiens; identical to SEQ ID NO: 31896
  misc_feature 1..63: note = chr8:37655313-37655376
  misc_feature 1..63: note = hyper
  source 1..63: mol_type = genomic DNA

SEQ ID NO: 99334 - DNA, 516 bp, Homo sapiens; identical to SEQ ID NO: 31897
  misc_feature 1..516: note = chr8:37655475-37655991
  misc_feature 1..516: note = hyper
  source 1..516: mol_type = genomic DNA

SEQ ID NO: 99335 - DNA, 165 bp, Homo sapiens; identical to SEQ ID NO: 31898
  misc_feature 1..165: note = chr8:37656049-37656214
  misc_feature 1..165: note = hyper
  source 1..165: mol_type = genomic DNA

SEQ ID NO: 99336 - DNA, 44 bp, Homo sapiens
  misc_feature 1..44: note = chr8:3769055-3769099
  misc_feature 1..44: note = hypo
  source 1..44: mol_type = genomic DNA
aaaaaaaaaaaaaaagaagaagaagaaaacgaaggctatataac

SEQ ID NO: 99337 - DNA, 47 bp, Homo sapiens
  misc_feature 1..47: note = chr8:37706125-37706172
  misc_feature 1..47: note = hypo
  source 1..47: mol_type = genomic DNA
tgcgactaacttgttcgttttcccctgtgcttcgggaatatgttacc

SEQ ID NO: 99338 - DNA, 30 bp, Homo sapiens
  misc_feature 1..30: note = chr8:37708497-37708527
  misc_feature 1..30: note = hypo
  source 1..30: mol_type = genomic DNA
cacaataatacccaacggtcctttctcttc

SEQ ID NO: 99339 - DNA, 30 bp, Homo sapiens
  misc_feature 1..30: note = chr8:37721639-37721669
  misc_feature 1..30: note = hypo
  source 1..30: mol_type = genomic DNA
tgccccgtcctcacccgtggccgtctaggc

SEQ ID NO: 99340 - DNA, 59 bp, Homo sapiens
  misc_feature 1..59: note = chr8:37762770-37762829
  misc_feature 1..59: note = hypo
  source 1..59: mol_type = genomic DNA
aagatccataaatgacgtgcaagccttcagcatggacagaaaaccggacagaaaatgat

SEQ ID NO: 99341 - DNA, 783 bp, Homo sapiens
  misc_feature 1..783: note = chr8:37822626-37823409
  misc_feature 1..783: note = hyper
  source 1..783: mol_type = genomic DNA
ggtcccattttggttcgctactcctcgttcccttttctctccaagcaaagccatcccaccttctcttaataaactccacactcaaaaagttgacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 99342 - DNA, 65 bp, Homo sapiens; identical to SEQ ID NO: 31900
  misc_feature 1..65: note = chr8:37823410-37823475
  misc_feature 1..65: note = hyper
  source 1..65: mol_type = genomic DNA

SEQ ID NO: 99343 - DNA, 56 bp, Homo sapiens; identical to SEQ ID NO: 31901
  misc_feature 1..56: note = chr8:37823476-37823532
  misc_feature 1..56: note = hyper
  source 1..56: mol_type = genomic DNA

SEQ ID NO: 99344 - DNA, 30 bp, Homo sapiens
  misc_feature 1..30: note = chr8:37891941-37891971
  misc_feature 1..30: note = hypo
  source 1..30: mol_type = genomic DNA
agataatttaattgccgaagggagtgtcat

SEQ ID NO: 99345 - DNA, 30 bp, Homo sapiens
  misc_feature 1..30: note = chr8:37935813-37935843
  misc_feature 1..30: note = hypo
  source 1..30: mol_type = genomic DNA
ggttctaggtgcctacgatacatcagtaaa

SEQ ID NO: 99346 - DNA, 99 bp, Homo sapiens
  misc_feature 1..99: note = chr8:37961833-37961932
  misc_feature 1..99: note = hypo
  source 1..99: mol_type = genomic DNA
gacagagcgagactctgtctcaaacaaacaacaacaagaaaacacaaaattctgcgaccatatgttaaaactgctacaatactacgtatttgggaggag

SEQ ID NO: 99347 - DNA, 30 bp, Homo sapiens; identical to SEQ ID NO: 41747
  misc_feature 1..30: note = chr8:38005823-38005853
  misc_feature 1..30: note = hypo
  source 1..30: mol_type = genomic DNA

SEQ ID NO: 99348 - DNA, 415 bp, Homo sapiens
  misc_feature 1..415: note = chr8:38008209-38008624
  misc_feature 1..415: note = hyper
  source 1..415: mol_type = genomic DNA
ggcctgagcctcatccgctgagagctggccaacccctcatcgcctccttcccgcagcgctcacccttcatgttgcgcatgtgtctgtaggagctcccagcgcacagcttgaatgtcgctagcagcattgtttcctggcaaatgtggcagtggtggggtcgctgccgctgctgctgccgccgctgctgctgcctcttctctcaagggtggttcttcgtccttcctgagcccctcaagcttcgcctctgagtcccgcagctgcagcctggacctggtgttctgcgtcttaaatgtcccccgctgaaggctgtgcatcatcatcaggagataaaaacgccatcactcactgtgcaaaggaaggggtcaaggatagagcgattgcctcacactgctgctttggccgtttgtggggagct

SEQ ID NO: 99349 - DNA, 30 bp, Homo sapiens
  misc_feature 1..30: note = chr8:38257005-38257035
  misc_feature 1..30: note = hypo
  source 1..30: mol_type = genomic DNA
tcattcttgtctgggcgctgtggctcaagc

SEQ ID NO: 99350 - DNA, 579 bp, Homo sapiens
  misc_feature 1..579: note = chr8:38323156-38323735
  misc_feature 1..579: note = hyper
  source 1..579: mol_type = genomic DNA
gaggctgctgaacctcggtcaccgagaggaaggtggatgacccgggcgtgggggtgattacccagaccaaggcgcgtcccacggggccctgctacttcgcttttaaacaagcctcagggaggaaaccgggagcccgggccaagggaggaaaatggccactttctgctaaacagtctcaaggctagatagtattccaaaaaaagcgctggtccggaggtgcaaagggtagggcacatctgcggaggaaacagtcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagc

SEQ ID NO: 99351 - DNA, 540 bp, Homo sapiens
  misc_feature 1..540: note = chr8:38323755-38324295
  misc_feature 1..540: note = hyper
  source 1..540: mol_type = genomic DNA
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtctccagaaatgttaaggagggaggtggtcaagacaggctgaagaatctgagttttaatttgggggagggggaggggaggaagagggaagttaataatgcggctgcggtgtacccgtgtggggtgaaacggaaccagatgcgg

SEQ ID NO: 99352 - DNA, 88 bp, Homo sapiens
  misc_feature 1..88: note = chr8:38324661-38324749
  misc_feature 1..88: note = hyper
  source 1..88: mol_type = genomic DNA
gaaccagattgggaccgaacggtccttccgcccccatcccacacctcggcttaacgaccgtgggttgtcctcccgttccccaaacttc

SEQ ID NO: 99353 - DNA, 50 bp, Homo sapiens
  misc_feature 1..50: note = chr8:38324811-38324861
  misc_feature 1..50: note = hyper
  source 1..50: mol_type = genomic DNA
cgctctcagctcaagcagattcagccatttggtgacgacacctccttaaa

SEQ ID NO: 99354 - DNA, 974 bp, Homo sapiens
  misc_feature 1..974: note = chr8:38325076-38326050
  misc_feature 1..974: note = hyper
  source 1..974: mol_type = genomic DNA
acataacacacacaacgcatcccacctcgccgcccactcccgccctcctccccagtccaggaaaccgcgggcctcgccgccttcgccccgggcctgtccctcccgggactcactgaggagccgccgccgcctcgccagctcccgagcgcgagttggaggaaaagttgggcggcgggaagagcggcgggacgagcgcagggagggggcgcaggagacgcggacggagggaagggaggggagacccaaggggcgcggatcgcccgggagggagccaggaggtgaaaggggcgggcggcgagcggagggaggcgccggccccggctgggctgcggcgggcaaagcgcgcagccgggaggctccggcgccgggggccgctcgggacgccaagcccgccccagatccgggggcgccgcggctcttacctcgctcggcgtggaggttccgcctcgggagagtccgccgtggcttgtgcgagcgggcgtgtgcccgcgtccccggctccggcccgccgcccccgggctctgttcgggtcctggcggggtcgcaagagctccgcggccggcgctcgactcccggcggcgctcggtgctcggcgcctccagcccgggcgggaacaatggagccggagctggtgccccggaggcggggcggggggagggctcccgtccgccacccggggtctccagaccttgtgcccccctcctccagaacgcagcggcggcgcctcactttccttgcagaccgggctccatcgccctgcggaggccccggcgccgcggcgtgcccgactgcagcacgggtaccgtgcgccctgcggggcgccccgagctcggaccggagaaaagtccttgggttccgcggcttttcaagcagcggcgcgctcgcggccggggaaggcgaggtcgccgcaatgcgctacgaggggtctcggtcccgtccggacgtggccgcccagctcccggcacacccgggtt

SEQ ID NO: 99355 - DNA, 218 bp, Homo sapiens
  misc_feature 1..218: note = chr8:38326276-38326494
  misc_feature 1..218: note = hyper
  source 1..218: mol_type = genomic DNA
gcgggccgagctgtccggcgctctgcccttctcttcctacagcctggtctcctttggcgtttgcgcccctgcatctgagcacgtcccagagggcgccggaatgtcaggccctagacatagcagcggtttgggggctagggggcaggtgaagagacgccgcagccttgaggttgtacctggtagcgtgggctttggagtctgtgcgccttggggaaatg

SEQ ID NO: 99356 - DNA, 76 bp, Homo sapiens
  misc_feature 1..76: note = chr8:38400221-38400297
  misc_feature 1..76: note = hypo
  source 1..76: mol_type = genomic DNA
aacatgccgggattacggactagagccaccccacccagccacttagcatgttttaaaagttcgtcaattttggcat

SEQ ID NO: 99357 - DNA, 94 bp, Homo sapiens
  misc_feature 1..94: note = chr8:38614414-38614508
  misc_feature 1..94: note = hyper
  source 1..94: mol_type = genomic DNA
cggggcctcttcccgcggcttcccttccagccccggacccagcgggcggagagggcgacgtccgcggatcgcggagtcccgggggcgcccgcag

SEQ ID NO: 99358 - DNA, 272 bp, Homo sapiens
  misc_feature 1..272: note = chr8:38614788-38615060
  misc_feature 1..272: note = hyper
  source 1..272: mol_type = genomic DNA
ctgggcacagccgcccgccgcccagcacaggagggtgcagccccggccccaagttctgcgccatgggaggctcccactctcagaccccgaggggccgggaacccgccggggagaggcacccgagacccacggagaccgcgtgagtcccagagccctctccaagggccgcctttgggggtttgcgtgccagcccgggatggagcgcgctggggcccgtcccagaaaggctgggaaggtggggttcccgctggcggcagcggggcacgagcgct

SEQ ID NO: 99359 - DNA, 31 bp, Homo sapiens; identical to SEQ ID NO: 41748
  misc_feature 1..31: note = chr8:38786050-38786081
  misc_feature 1..31: note = hypo
  source 1..31: mol_type = genomic DNA

SEQ ID NO: 99360 - DNA, 23 bp, Homo sapiens
  misc_feature 1..23: note = chr8:38857793-38857816
  misc_feature 1..23: note = hypo
  source 1..23: mol_type = genomic DNA
agccaccgcgccccagcctctct

SEQ ID NO: 99361 - DNA, 30 bp, Homo sapiens
  misc_feature 1..30: note = chr8:38965524-38965554
  misc_feature 1..30: note = hypo
  source 1..30: mol_type = genomic DNA
cagcaccagggctcacgcctgtaatcccag

SEQ ID NO: 99362 - DNA, 46 bp, Homo sapiens
  misc_feature 1..46: note = chr8:39695645-39695691
  misc_feature 1..46: note = hypo
  source 1..46: mol_type = genomic DNA
ttactactgtccatccgcagcccgccgagcccgctgagcagaaaca

SEQ ID NO: 99363 - DNA, 77 bp, Homo sapiens
  misc_feature 1..77: note = chr8:39756231-39756308
  misc_feature 1..77: note = hypo
  source 1..77: mol_type = genomic DNA
taatgttagtattttgaggaacccccatattgctttccacagttgctgtactaatttacatccgcaccaacagcgca

SEQ ID NO: 99364 - DNA, 177 bp, Homo sapiens
  misc_feature 1..177: note = chr8:40630277-40630454
  misc_feature 1..177: note = hypo
  source 1..177: mol_type = genomic DNA
ccagctaaaataagccgaggacctcaataaaacaggaaaacctggaacaaagagtgattctcacatgccaccacatttgaggtcattccggggagaagaggagccaatagggaagggacagcaaacaccaaacatctagaacacgggttcctgcaaaacaaccggctgatgcgagat

SEQ ID NO: 99365 - DNA, 30 bp, Homo sapiens
  misc_feature 1..30: note = chr8:40707573-40707603
  misc_feature 1..30: note = hypo
  source 1..30: mol_type = genomic DNA
ctgacagtatgttaccgtcctcaggcagca

SEQ ID NO: 99366 - DNA, 53 bp, Homo sapiens
  misc_feature 1..53: note = chr8:40782590-40782643
  misc_feature 1..53: note = hypo
  source 1..53: mol_type = genomic DNA
gggcctccatgaatgcgaccactcaggcgccctaccctcgtcttcctgggtcc

SEQ ID NO: 99367 - DNA, 30 bp, Homo sapiens
  misc_feature 1..30: note = chr8:41137920-41137950
  misc_feature 1..30: note = hypo
  source 1..30: mol_type = genomic DNA
ctattttctggaattcgcactccctgccct

SEQ ID NO: 99368 - DNA, 171 bp, Homo sapiens
  misc_feature 1..171: note = chr8:41146864-41147035
  misc_feature 1..171: note = hypo
  source 1..171: mol_type = genomic DNA
acagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtagg

SEQ ID NO: 99369 - DNA, 210 bp, Homo sapiens
  misc_feature 1..210: note = chr8:41165709-41165919
  misc_feature 1..210: note = hyper
  source 1..210: mol_type = genomic DNA
tttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccc

SEQ ID NO: 99370 - DNA, 152 bp, Homo sapiens; identical to SEQ ID NO: 3231
  misc_feature 1..152: note = chr8:41166000-41166152
  misc_feature 1..152: note = hyper
  source 1..152: mol_type = genomic DNA

SEQ ID NO: 99371 - DNA, 414 bp, Homo sapiens; identical to SEQ ID NO: 3232
  misc_feature 1..414: note = chr8:41166266-41166680
  misc_feature 1..414: note = hyper
  source 1..414: mol_type = genomic DNA

SEQ ID NO: 99372 - DNA, 244 bp, Homo sapiens; identical to SEQ ID NO: 3233
  misc_feature 1..244: note = chr8:41166745-41166989
  misc_feature 1..244: note = hyper
  source 1..244: mol_type = genomic DNA

SEQ ID NO: 99373 - DNA, 346 bp, Homo sapiens
  misc_feature 1..346: note = chr8:41167025-41167371
  misc_feature 1..346: note = hyper
  source 1..346: mol_type = genomic DNA
cgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttg

SEQ ID NO: 99374 - DNA, 226 bp, Homo sapiens
  misc_feature 1..226: note = chr8:41424669-41424895
  misc_feature 1..226: note = hyper
  source 1..226: mol_type = genomic DNA
ctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttgaagccactgcgggcacagcctgaagagggccggtgtcccgcgtgcagcctccc

SEQ ID NO: 99375 - DNA, 37 bp, Homo sapiens
  misc_feature 1..37: note = chr8:41488146-41488183
  misc_feature 1..37: note = hypo
  source 1..37: mol_type = genomic DNA
ggagggcgtgggcctcgggggccggcacagccagccc

SEQ ID NO: 99376 - DNA, 564 bp, Homo sapiens
  misc_feature 1..564: note = chr8:41503824-41504388
  misc_feature 1..564: note = hyper
  source 1..564: mol_type = genomic DNA
gctgctcctcctccacgcgcccctcatccaaagaaagactcagtccctgcgcccccaggagcgtggggaaggggaggggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcctgcttttacagctaaacaaatggctcaacaacggagtgactgtcacattcacgtttctgttggggaaggacaataaaatttaaaaacgtgagcgcggcagccctcccct

SEQ ID NO: 99377 - DNA, 30 bp, Homo sapiens; identical to SEQ ID NO: 41750
  misc_feature 1..30: note = chr8:41510183-41510213
  misc_feature 1..30: note = hypo
  source 1..30: mol_type = genomic DNA

SEQ ID NO: 99378 - DNA, 62 bp, Homo sapiens
  misc_feature 1..62: note = chr8:41511045-41511107
  misc_feature 1..62: note = hyper
  source 1..62: mol_type = genomic DNA
cggagtctggagctgcggggtccgcgggggcgctaagggggctactgggttggctgcagcag

SEQ ID NO: 99379 - DNA, 93 bp, Homo sapiens
  misc_feature 1..93: note = chr8:41511147-41511240
  misc_feature 1..93: note = hyper
  source 1..93: mol_type = genomic DNA
cgagccctgagcccagcttccttgggccgtcaccgaatcggtcccagccgcgctgtgcggcccccctgccgtggcccccgggatgggggagga

SEQ ID NO: 99380 - DNA, 109 bp, Homo sapiens
  misc_feature 1..109: note = chr8:41511443-41511552
  misc_feature 1..109: note = hyper
  source 1..109: mol_type = genomic DNA
cggggcctgcctggccgggggtgcaccggggcggatttgtgtgggaagcagggcccctctccgctcacaggccccgcggccagggggcctctgacgtggagggggcttc

SEQ ID NO: 99381 - DNA, 120 bp, Homo sapiens
  misc_feature 1..120: note = chr8:41523651-41523771
  misc_feature 1..120: note = hypo
  source 1..120: mol_type = genomic DNA
ctcatctgtgaagcacggattaaagtgctctccccaccctttctcaaggctgctgggacaatcatgccgcttatgaatgctaacactatgaatgataatggcaaacgcttgtgatagtgc

SEQ ID NO: 99382 - DNA, 147 bp, Homo sapiens
  misc_feature 1..147: note = chr8:41530122-41530269
  misc_feature 1..147: note = hypo
  source 1..147: mol_type = genomic DNA
caactcggggccccgcggttcctctgagagtgccccctccaacttccactcgtgacctgtggcatcagagtcctcagccttgctacactccagagaggagtcctcagcagtgaccagagaaggcgtgaggcccgcagaccacacctg

SEQ ID NO: 99383 - DNA, 203 bp, Homo sapiens
  misc_feature 1..203: note = chr8:41531574-41531777
  misc_feature 1..203: note = hypo
  source 1..203: mol_type = genomic DNA
acatgcaactgcccccgggctgtgctttgattcaagccaggcgggctcctttcttgccccctcagcctccgctcggggcctcagcctccgctcggggcctcagctcctgatcacctgctcccctgcttttacatcactagctccatttattctcatccactcactgttcaaccaaaataagagaggtccgattacatgccagg

SEQ ID NO: 99384 - DNA, 29 bp, Homo sapiens
  misc_feature 1..29: note = chr8:41535372-41535401
  misc_feature 1..29: note = hypo
  source 1..29: mol_type = genomic DNA
gccaggattacaagcgtgaaccactgcac

SEQ ID NO: 99385 - DNA, 136 bp, Homo sapiens
  misc_feature 1..136: note = chr8:41539808-41539944
  misc_feature 1..136: note = hypo
  source 1..136: mol_type = genomic DNA
tctctggcaagtcctcgagtgccacccgcttcccttgcaccatgagtccccctggccccgactccggtctgtttctcctgcaccatgcacgttaactgctggtgtgtgatacaattccccgcgtggctctcctcac

SEQ ID NO: 99386 - DNA, 79 bp, Homo sapiens
  misc_feature 1..79: note = chr8:41540907-41540986
  misc_feature 1..79: note = hypo
  source 1..79: mol_type = genomic DNA
acagggagggctcagcgagcagggtcccctggtaggggctccgtgcccaggcccacctgggactcgccctcagccgcgc

SEQ ID NO: 99387 - DNA, 62 bp, Homo sapiens
  misc_feature 1..62: note = chr8:41546283-41546345
  misc_feature 1..62: note = hypo
  source 1..62: mol_type = genomic DNA
gggaagctgaagaagcgcacatgcgttattaatcacagtcgtaataacggcaagcccacgtc

SEQ ID NO: 99388 - DNA, 99 bp, Homo sapiens
  misc_feature 1..99: note = chr8:41552691-41552790
  misc_feature 1..99: note = hypo
  source 1..99: mol_type = genomic DNA
taccttcgtccatcccgttgaggatctgatccaggtagctctctccatagcggctcctgtgctccttccacacggagccgttttcgctcctcagaacca

SEQ ID NO: 99389 - DNA, 381 bp, Homo sapiens
  misc_feature 1..381: note = chr8:41553990-41554371
  misc_feature 1..381: note = hypo
  source 1..381: mol_type = genomic DNA
ggtgatgcgggtgggcgctgcgcacgtccgtggcgggatcaccactcgcaggccgttgtggcgacttcctctcatggaaccaccccgggcgtcaaccatgaagctcaccagaaacctaggagtggggcagatgcacgttgggcttctgcatcccctctcggagatggagacaggagtccccgagccctgcgcccgccactcaccctgtatgcaccgggctggccaccgggctgatgttgtctgaggtctcggtggccgggctgctggggatgagggagtcctcatcatactctttagatgcctgaggagagagaaagggtcctcctgtcccacctcctcccgggccagctggatgccgtgccagggcgtggaggcttggaa

SEQ ID NO: 99390 - DNA, 107 bp, Homo sapiens
  misc_feature 1..107: note = chr8:41566310-41566417
  misc_feature 1..107: note = hypo
  source 1..107: mol_type = genomic DNA
gccattggcttgtttcgagagcagcagagccaccatctctgcgtggccctcctgggcggccaggtgaaggggcgtcacaccttgcaccgactcggcgtttgctgagc

SEQ ID NO: 99391 - DNA, 30 bp, Homo sapiens
  misc_feature 1..30: note = chr8:41582836-41582866
  misc_feature 1..30: note = hypo
  source 1..30: mol_type = genomic DNA
agtgcctccgaacaccggagagcgtgccca

SEQ ID NO: 99392 - DNA, 52 bp, Homo sapiens; identical to SEQ ID NO: 41754
  misc_feature 1..52: note = chr8:41594902-41594954
  misc_feature 1..52: note = hypo
  source 1..52: mol_type = genomic DNA

SEQ ID NO: 99393 - DNA, 30 bp, Homo sapiens
  misc_feature 1..30: note = chr8:41599293-41599323
  misc_feature 1..30: note = hypo
  source 1..30: mol_type = genomic DNA
gctttttgtcattgtcggggtaggagccat

SEQ ID NO: 99394 - DNA, 117 bp, Homo sapiens
  misc_feature 1..117: note = chr8:41611241-41611358
  misc_feature 1..117: note = hypo
  source 1..117: mol_type = genomic DNA
ctgttcccatctttacgtccctgtctctgtcgctgagtgttgtgactctcgcccctacctgtaagctccagcacaatcccagctccaccttgcctggcttctcgtgctgtctgcact

SEQ ID NO: 99395 - DNA, 15 bp, Homo sapiens
  misc_feature 1..15: note = chr8:41624546-41624561
  misc_feature 1..15: note = hyper
  source 1..15: mol_type = genomic DNA
gcggctccacgctcc

SEQ ID NO: 99396 - DNA, 708 bp, Homo sapiens
  misc_feature 1..708: note = chr8:41624633-41625341
  misc_feature 1..708: note = hyper
  source 1..708: mol_type = genomic DNA
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgaggagctccaagctgcatggcctccctccctgcctcccgcctccccgaatgc

SEQ ID NO: 99397 - DNA, 30 bp, Homo sapiens
  misc_feature 1..30: note = chr8:41632351-41632381
  misc_feature 1..30: note = hypo
  source 1..30: mol_type = genomic DNA
tgtggactggggagccgagactagagtgga

SEQ ID NO: 99398 - DNA, 25 bp, Homo sapiens
  misc_feature 1..25: note = chr8:41638209-41638234
  misc_feature 1..25: note = hypo
  source 1..25: mol_type = genomic DNA
atgcctgtgtgtgcacgtgtgcctg

SEQ ID NO: 99399 - DNA, 218 bp, Homo sapiens
  misc_feature 1..218: note = chr8:41643385-41643603
  misc_feature 1..218: note = hypo
  source 1..218: mol_type = genomic DNA
ggtccacttggtagccgagggtccgagctgacctcatgctttccgcactgtcgggcagcgttgtcatcagcggtactctccgcctgggaaccctcccgcgtctcttctccctgtactctggagtgccccttacagccaacttaaaggcacctccctgcagatcgtcccttgattccctccgatgcagttttctctcctcctcccgagtttccaaagca

SEQ ID NO: 99400 - DNA, 15 bp, Homo sapiens
  misc_feature 1..15: note = chr8:41655043-41655058
  misc_feature 1..15: note = hyper
  source 1..15: mol_type = genomic DNA
cagaatagggcatgc

SEQ ID NO: 99401 - DNA, 193 bp, Homo sapiens
  misc_feature 1..193: note = chr8:41655301-41655494
  misc_feature 1..193: note = hyper
  source 1..193: mol_type = genomic DNA
cgctccccaggcctcggccggcgcggacccctggttgccccggggtcgagagcagccggggagagctgagttcagagcccagagttggacatcaggccacacgctgagagggtagtaaatgaaagggagtccggtttagtcgcgggcagggcatctcctcttctgcttgtctaaaagtcgctgggtgcagggg

SEQ ID NO: 99402 - DNA, 141 bp, Homo sapiens
  misc_feature 1..141: note = chr8:41668167-41668308
  misc_feature 1..141: note = hypo
  source 1..141: mol_type = genomic DNA
ggccttccagagcaacgtgccgccgaagcgtaatagcccgatgggttcatcttgcccgctgcccagaaagccaaaagcgcggagaacaggcactgccccaaagtaagggcctcatgaccacagggccgggagagccaggag

SEQ ID NO: 99403 - DNA, 34 bp, Homo sapiens
  misc_feature 1..34: note = chr8:41685657-41685691
  misc_feature 1..34: note = hyper
  source 1..34: mol_type = genomic DNA
aaatgatggagttcccggtcggtcctccagtgct

SEQ ID NO: 99404 - DNA, 313 bp, Homo sapiens
  misc_feature 1..313: note = chr8:41686308-41686621
  misc_feature 1..313: note = hyper
  source 1..313: mol_type = genomic DNA
cctgaagattttccacgcgaaagtgctggggagagagttgggcctgggaggctgcgccttcttcccgcgaatcccgaaaactgcgcggcaaaggcgggttccgcagaagtcgcgcgtgacccggggcgccgccctcctcggggcccattcggatctgccgcccgtcctctccagagcgccccctggcgccctctaggccatcttgattccaccgccgcagttgaaagaattaataaataaatcctagtctcgcgtctagaccggtccgtgagggtcccctgctcaccggacaccctgccgcaatctctgctgt

SEQ ID NO: 99405 - DNA, 64 bp, Homo sapiens
  misc_feature 1..64: note = chr8:41689272-41689336
  misc_feature 1..64: note = hypo
  source 1..64: mol_type = genomic DNA
atttttatttatcaccgccccagactggagtcaacccacacgtcctcagcgtgtgaatgaatag

SEQ ID NO: 99406 - DNA, 81 bp, Homo sapiens
  misc_feature 1..81: note = chr8:41695929-41696010
  misc_feature 1..81: note = hypo
  source 1..81: mol_type = genomic DNA
atagtaagcacttaccgtgtgccccagactgctgtattatgttttaaagtgattgttaaagatgtaacaatgggctgggca

SEQ ID NO: 99407 - DNA, 30 bp, Homo sapiens
  misc_feature 1..30: note = chr8:41707500-41707530
  misc_feature 1..30: note = hypo
  source 1..30: mol_type = genomic DNA
tcagagccctggcagcggctctcagacagt

SEQ ID NO: 99408 - DNA, 239 bp, Homo sapiens; identical to SEQ ID NO: 31924
  misc_feature 1..239: note = chr8:41733415-41733654
  misc_feature 1..239: note = hyper
  source 1..239: mol_type = genomic DNA

SEQ ID NO: 99409 - DNA, 92 bp, Homo sapiens; identical to SEQ ID NO: 9490
  misc_feature 1..92: note = chr8:41733684-41733776
  misc_feature 1..92: note = hyper
  source 1..92: mol_type = genomic DNA

SEQ ID NO: 99410 - DNA, 30 bp, Homo sapiens
  misc_feature 1..30: note = chr8:41752415-41752445
  misc_feature 1..30: note = hypo
  source 1..30: mol_type = genomic DNA
aaaaaggccccttttcggtcctctaaaggg

SEQ ID NO: 99411 - DNA, 480 bp, Homo sapiens
  misc_feature 1..480: note = chr8:41753273-41753753
  misc_feature 1..480: note = hyper
  source 1..480: mol_type = genomic DNA
ttctgctaccagatccggagggtcaggaaaggtgctccctgagaagggtcaaggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgc

SEQ ID NO: 99412 - DNA, 411 bp, Homo sapiens; identical to SEQ ID NO: 3236
  misc_feature 1..411: note = chr8:41753770-41754181
  misc_feature 1..411: note = hyper
  source 1..411: mol_type = genomic DNA

SEQ ID NO: 99413 - DNA, 1035 bp, Homo sapiens
  misc_feature 1..1035: note = chr8:41754182-41755217
  misc_feature 1..1035: note = hyper
  source 1..1035: mol_type = genomic DNA
aggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctcgggagctgc

SEQ ID NO: 99414 - DNA, 33 bp, Homo sapiens
  misc_feature 1..33: note = chr8:41755524-41755557
  misc_feature 1..33: note = hyper
  source 1..33: mol_type = genomic DNA
cacaggacctccccccgccgccccccccaaccc

SEQ ID NO: 99415 - DNA, 96 bp, Homo sapiens
  misc_feature 1..96: note = chr8:41773327-41773423
  misc_feature 1..96: note = hypo
  source 1..96: mol_type = genomic DNA
tttaatttggtattgcgctggtattatactcaaaatataaccagagccctgaccttcctttcacctccgtcatggcttccccgtcccagccaccat

SEQ ID NO: 99416 - DNA, 69 bp, Homo sapiens
  misc_feature 1..69: note = chr8:41910270-41910339
  misc_feature 1..69: note = hypo
  source 1..69: mol_type = genomic DNA
tccacagacctgggtcgtgtgacttggacaaggtcacacagctagtatgtggcgcgcacctgagcctgg

SEQ ID NO: 99417 - DNA, 211 bp, Homo sapiens
  misc_feature 1..211: note = chr8:42009840-42010051
  misc_feature 1..211: note = hyper
  source 1..211: mol_type = genomic DNA
ctgacttccactccacgccttcgtggatcaggacgactgggaccactcaaaagcgtatccaagtcctgaggtctccaaagcggtggagagacccgcccagcccctcactccccggctgggaactgagattgtggagggtgggcgccctgccgcggcccagtggggctgggggcttccagagtcggggtccagggctcggtgtccgagactc

SEQ ID NO: 99418 - DNA, 59 bp, Homo sapiens
  misc_feature 1..59: note = chr8:42036381-42036440
  misc_feature 1..59: note = hypo
  source 1..59: mol_type = genomic DNA
tgtgcccagcatgggcgcgccactcctggttacctggcaggcgtcgtgcaagtttgcct

SEQ ID NO: 99419 - DNA, 157 bp, Homo sapiens
  misc_feature 1..157: note = chr8:42044825-42044982
  misc_feature 1..157: note = hypo
  source 1..157: mol_type = genomic DNA
ttgggagaaccctgacggatctgacagaatctttccccagctgtagcagcttctcacagggggaatccctccttggggatgtgccctcacctgcagtagttgtggttccccaggcccagcctgatggcgtctggcctccgcccgctgtagggcttct

SEQ ID NO: 99420 - DNA, 30 bp, Homo sapiens
  misc_feature 1..30: note = chr8:42050976-42051006
  misc_feature 1..30: note = hypo
  source 1..30: mol_type = genomic DNA
atattgctgtgcggccggccgtcaccaccg

SEQ ID NO: 99421 - DNA, 179 bp, Homo sapiens
  misc_feature 1..179: note = chr8:42137798-42137977
  misc_feature 1..179: note = hyper
  source 1..179: mol_type = genomic DNA
gtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacct

SEQ ID NO: 99422 - DNA, 176 bp, Homo sapiens
  misc_feature 1..176: note = chr8:42144632-42144808
  misc_feature 1..176: note = hypo
  source 1..176: mol_type = genomic DNA
ggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgc

SEQ ID NO: 99423 - DNA, 30 bp, Homo sapiens
  misc_feature 1..30: note = chr8:42147491-42147521
  misc_feature 1..30: note = hypo
  source 1..30: mol_type = genomic DNA
gtggggctgggtgagcgccactgacccagg

SEQ ID NO: 99424 - DNA, 41 bp, Homo sapiens
  misc_feature 1..41: note = chr8:42333549-42333590
  misc_feature 1..41: note = hypo
  source 1..41: mol_type = genomic DNA
gtctgaccacaggtgcgcttttgattgggtgaagtagccgg

SEQ ID NO: 99425 - DNA, 160 bp, Homo sapiens
  misc_feature 1..160: note = chr8:42333890-42334050
  misc_feature 1..160: note = hypo
  source 1..160: mol_type = genomic DNA
gattacaggcttgagccaccgtgcccggccggtttactgtgtctcaatggaggactcccttgctgtgcaccttgaatatggcagtggctgtactactgtacatgctgtcaaaactcatgaaattcacacaggtgaaccacaggagcgccctgggtgggaa

SEQ ID NO: 99426 - DNA, 25 bp, Homo sapiens
  misc_feature 1..25: note = chr8:42399256-42399281
  misc_feature 1..25: note = hypo
  source 1..25: mol_type = genomic DNA
caatatgtcaaataccggccgggcg

SEQ ID NO: 99427 - DNA, 30 bp, Homo sapiens
  misc_feature 1..30: note = chr8:42600848-42600878
  misc_feature 1..30: note = hypo
  source 1..30: mol_type = genomic DNA
gtccctctccctactcgccccacccccacc

SEQ ID NO: 99428 - DNA, 82 bp, Homo sapiens
  misc_feature 1..82: note = chr8:42661169-42661251
  misc_feature 1..82: note = hypo
  source 1..82: mol_type = genomic DNA
attaatgaagtttgaaatctcctgcatactcctccctaattgcatctccctcctactcaaaagtatccggtactttgaatta

SEQ ID NO: 99429 - DNA, 30 bp, Homo sapiens; identical to SEQ ID NO: 15108
  misc_feature 1..30: note = chr8:42699267-42699297
  misc_feature 1..30: note = hypo
  source 1..30: mol_type = genomic DNA

SEQ ID NO: 99430 - DNA, 77 bp, Homo sapiens
  misc_feature 1..77: note = chr8:42749678-42749755
  misc_feature 1..77: note = hypo
  source 1..77: mol_type = genomic DNA
ggaaccaaacacaggcgagacacacatgtgtaattttttttttcttttgagacagattctcgttctgtcgtcaggat

SEQ ID NO: 99431 - DNA, 17 bp, Homo sapiens
  misc_feature 1..17: note = chr8:42749995-42750012
  misc_feature 1..17: note = hypo
  source 1..17: mol_type = genomic DNA
cacgtatgtgtaatttc

SEQ ID NO: 99432 - DNA, 30 bp, Homo sapiens
  misc_feature 1..30: note = chr8:43102377-43102407
  misc_feature 1..30: note = hyper
  source 1..30: mol_type = genomic DNA
ctgctccatcgaccacgagtacccggatcc

SEQ ID NO: 99433 - DNA, 110 bp, Homo sapiens
  misc_feature 1..110: note = chr8:43102486-43102596
  misc_feature 1..110: note = hyper
  source 1..110: mol_type = genomic DNA
cgccgcagaggtcgagcgccgccagatgcgcagaagccgggacttgtacgcccgcgacaggaaagacaggcagcggggcctcagctccaggtgggagggggccctaggcc

SEQ ID NO: 99434 - DNA, 48 bp, Homo sapiens
  misc_feature 1..48: note = chr8:43400747-43400795
  misc_feature 1..48: note = hypo
  source 1..48: mol_type = genomic DNA
cccctgcaagcctggcgtactgaccccatcacccggggggacttattg

SEQ ID NO: 99435 - DNA, 60 bp, Homo sapiens
  misc_feature 1..60: note = chr8:43401723-43401783
  misc_feature 1..60: note = hypo
  source 1..60: mol_type = genomic DNA
tctgccaagatctggcgcagggcctgacgggaaggcactggcctccgagggaccacccca

SEQ ID NO: 99436 - DNA, 48 bp, Homo sapiens
  misc_feature 1..48: note = chr8:43404086-43404134
  misc_feature 1..48: note = hypo
  source 1..48: mol_type = genomic DNA
tttgggtgcccaccacggaccgcggggtcagagcgaggaactccaagg

SEQ ID NO: 99437 - DNA, 192 bp, Homo sapiens
  misc_feature 1..192: note = chr8:43416667-43416859
  misc_feature 1..192: note = hypo
  source 1..192: mol_type = genomic DNA
ccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagc

SEQ ID NO: 99438 - DNA, 37 bp, Homo sapiens
  misc_feature 1..37: note = chr8:4671648-4671685
  misc_feature 1..37: note = hypo
  source 1..37: mol_type = genomic DNA
tcttggaatatataacgaattccgtgaaaactgcaag

SEQ ID NO: 99439 - DNA, 177 bp, Homo sapiens
  misc_feature 1..177: note = chr8:46935227-46935404
  misc_feature 1..177: note = hypo
  source 1..177: mol_type = genomic DNA
aggggctgctgggaacgcctgggcctccgtgtaaggccttcaggttctcccatggcctggctgctttatttccttggctgcctcaacatcccctttcaaccctaatgtgctgtccccttttcccaggggccttcttgagagtttgtggtgccccccggtgtgcgagacacgcaccct

SEQ ID NO: 99440 - DNA, 30 bp, Homo sapiens
  misc_feature 1..30: note = chr8:47015663-47015693
  misc_feature 1..30: note = hypo
  source 1..30: mol_type = genomic DNA
acgcacgccaccctgcggccctgttttcgc

SEQ ID NO: 99441 - DNA, 30 bp, Homo sapiens
  misc_feature 1..30: note = chr8:47015813-47015843
  misc_feature 1..30: note = hypo
  source 1..30: mol_type = genomic DNA
cattttgtgttgtctcgccattcttctcta

SEQ ID NO: 99442 - DNA, 48 bp, Homo sapiens
  misc_feature 1..48: note = chr8:47016307-47016355
  misc_feature 1..48: note = hypo
  source 1..48: mol_type = genomic DNA
gaccacgctaccctgcggctctgctttcacttgcgaaggccttccgcc

SEQ ID NO: 99443 - DNA, 30 bp, Homo sapiens
  misc_feature 1..30: note = chr8:47021923-47021953
  misc_feature 1..30: note = hypo
  source 1..30: mol_type = genomic DNA
cctttttgggagacacgcagcattccctgc

SEQ ID NO: 99444 - DNA, 179 bp, Homo sapiens
  misc_feature 1..179: note = chr8:47093235-47093414
  misc_feature 1..179: note = hypo
  source 1..179: mol_type = genomic DNA
cttgcgtaggacggtcgtcggggcttcggggatgggagaggcctctttggaagtctcccaccattccctgcggcctcgctgctacccccatctgccagcctcaacatccccatgagtccctatgtcctgtccacaccgcaccgaggccaagttttcgctagtggcggccttctgctaga

SEQ ID NO: 99445 - DNA, 41 bp, Homo sapiens
  misc_feature 1..41: note = chr8:47122214-47122255
  misc_feature 1..41: note = hypo
  source 1..41: mol_type = genomic DNA
agggtggctgggtggcgtgggctggccgcaggcctgaggga

SEQ ID NO: 99446 - DNA, 183 bp, Homo sapiens
  misc_feature 1..183: note = chr8:47138568-47138751
  misc_feature 1..183: note = hypo
  source 1..183: mol_type = genomic DNA
acagggtggcgtgggcgggccacagggactcaaggttatgttgaggcaggcagcggggagaagcggcaagactgcagagaattctgggagtgacccaaagaggcctcttccaacccagaaaccgccaggggtgtctgggggcaggctgtaaagccccagggctcggagcggggtgcctgtgtc

SEQ ID NO: 99447 - DNA, 183 bp, Homo sapiens; identical to SEQ ID NO: 41768
  misc_feature 1..183: note = chr8:47155037-47155220
  misc_feature 1..183: note = hypo
  source 1..183: mol_type = genomic DNA

SEQ ID NO: 99448 - DNA, 86 bp, Homo sapiens
  misc_feature 1..86: note = chr8:47159728-47159814
  misc_feature 1..86: note = hypo
  source 1..86: mol_type = genomic DNA
tcccctggctttggccgggagaggtggctcacacctgtaatcccttggctcagcactttgggaggctgaggcgggcggattaagag

SEQ ID NO: 99449 - DNA, 30 bp, Homo sapiens
  misc_feature 1..30: note = chr8:47161038-47161068
  misc_feature 1..30: note = hypo
  source 1..30: mol_type = genomic DNA
aagaagcgacaagaccgtcgggaatgctgg

SEQ ID NO: 99450 - DNA, 108 bp, Homo sapiens; identical to SEQ ID NO: 41769
  misc_feature 1..108: note = chr8:47334490-47334598
  misc_feature 1..108: note = hypo
  source 1..108: mol_type = genomic DNA

SEQ ID NO: 99451 - DNA, 49 bp, Homo sapiens
  misc_feature 1..49: note = chr8:47355877-47355926
  misc_feature 1..49: note = hypo
  source 1..49: mol_type = genomic DNA
cttgtgggggctttccgtgacagatacaggcactcggctccaaagcctg

SEQ ID NO: 99452 - DNA, 177 bp, Homo sapiens
  misc_feature 1..177: note = chr8:47357885-47358062
  misc_feature 1..177: note = hypo
  source 1..177: mol_type = genomic DNA
gccatcctttgggcccgtttctgcttgtgggggctttcaccgagagacccagggacactgctccaaatcctgggactttaaagcccaccccggacagccttgggggattctcaaatgggagagtcctccctgataggctcccagcatcccctgtggtctcgccggttctcccttctg

SEQ ID NO: 99453 - DNA, 162 bp, Homo sapiens
  misc_feature 1..162: note = chr8:47829382-47829544
  misc_feature 1..162: note = hyper
  source 1..162: mol_type = genomic DNA
caggaagccgcgaggcgggattcccagggagaagccaggagcctgaagcgggcgtgcggcgctgcggggccagcagggggcgcgccaggcgcggggagcaggaggccggggcggtggtttccgactctgccagccgcggttggagttcgtcccatgagactg

SEQ ID NO: 99454 - DNA, 255 bp, Homo sapiens
  misc_feature 1..255: note = chr8:48021889-48022144
  misc_feature 1..255: note = hypo
  source 1..255: mol_type = genomic DNA
ctcagtctactttaacgttaaacatatttctgagataagcaacactataacacgttagtgctctatggtgcaacgctaagcaatgtgtgcaaatattactgtaggatacataaaaagtcattctacttatgcaatggtcctaccgttaaaatccattttgatttgttcagtgagcaacataaaagtctcataattagggtaaggcaaatcgtaatcctctgaggctatttcagatggccacgttatgtcatcaag

SEQ ID NO: 99455 - DNA, 130 bp, Homo sapiens
  misc_feature 1..130: note = chr8:48044980-48045110
  misc_feature 1..130: note = hypo
  source 1..130: mol_type = genomic DNA
agccccgaagacactcgtggcggtgctgtgcccaggtggccgcggctgcaggggaggggcagcctggcggaactcgctgcaaatggcctcaaaatcgtggaacataagccgcccacggtctccaggccct

SEQ ID NO: 99456 - DNA, 527 bp, Homo sapiens; identical to SEQ ID NO: 31932
  misc_feature 1..527: note = chr8:48100170-48100697
  misc_feature 1..527: note = hyper
  source 1..527: mol_type = genomic DNA

SEQ ID NO: 99457 - DNA, 191 bp, Homo sapiens
  misc_feature 1..191: note = chr8:48294168-48294359
  misc_feature 1..191: note = hypo
  source 1..191: mol_type = genomic DNA
tcagaagatcctattcgggcaggtctgggcctggtcagtaattgggtgggaggcctcagagagcagaaaccagcgattggcaggaagtggcatgggcagctcacctggcctgcgagtctgggctcagctggacctgccccacgtggcaccaggcgcacaaggtgtcctcacagagccgccccgtggcacgc

SEQ ID NO: 99458 - DNA, 211 bp, Homo sapiens
  misc_feature 1..211: note = chr8:4849052-4849263
  misc_feature 1..211: note = hyper
  source 1..211: mol_type = genomic DNA
gcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaa

SEQ ID NO: 99459 - DNA, 539 bp, Homo sapiens
  misc_feature 1..539: note = chr8:4849296-4849835
  misc_feature 1..539: note = hyper
  source 1..539: mol_type = genomic DNA
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattatt

SEQ ID NO: 99460 - DNA, 91 bp, Homo sapiens; identical to SEQ ID NO: 31745
  misc_feature 1..91: note = chr8:4850232-4850323
  misc_feature 1..91: note = hyper
  source 1..91: mol_type = genomic DNA

SEQ ID NO: 99461 - DNA, 281 bp, Homo sapiens; identical to SEQ ID NO: 31746
  misc_feature 1..281: note = chr8:4850418-4850699
  misc_feature 1..281: note = hyper
  source 1..281: mol_type = genomic DNA

SEQ ID NO: 99462 - DNA, 33 bp, Homo sapiens; identical to SEQ ID NO: 31747
  misc_feature 1..33: note = chr8:4851342-4851375
  misc_feature 1..33: note = hyper
  source 1..33: mol_type = genomic DNA

SEQ ID NO: 99463 - DNA, 30 bp, Homo sapiens; identical to SEQ ID NO: 31748
  misc_feature 1..30: note = chr8:4851581-4851611
  misc_feature 1..30: note = hyper
  source 1..30: mol_type = genomic DNA

SEQ ID NO: 99464 - DNA, 774 bp, Homo sapiens
  misc_feature 1..774: note = chr8:4851814-4852588
  misc_feature 1..774: note = hyper
  source 1..774: mol_type = genomic DNA
gctctaccgcctccccggccaggagcaagtccgtcttacccttcgctgcagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacgagcgccggccgagccgggcaggaaggcaccaaggcggcgaggctgcgggagggggagaagcggggagaggagcgcgcgcagccaggagagacctggagaggaggcagctggagagagagccagcgagtgggagatgcggggaggggggcgcgggggggaggagagatccagtctagagagaaaaggcggagagcgcagaagaagggctgctagtggcacaaggagccgctgccgtggaggctggactcaaccatccttacccacagagaggggaccgaggctgggcacggcgcagtcccagacagacagagcccagcctcggggcctcgggctgcccgcaccgtgctgcgcttcattcggcctcagcgcagcagcgcgcaggctggagaaa

SEQ ID NO: 99465 - DNA, 30 bp, Homo sapiens
  misc_feature 1..30: note = chr8:48601821-48601851
  misc_feature 1..30: note = hypo
  source 1..30: mol_type = genomic DNA
gacccatagctctcccgggttggttggctt

SEQ ID NO: 99466 - DNA, 26 bp, Homo sapiens
  misc_feature 1..26: note = chr8:48675264-48675290
  misc_feature 1..26: note = hypo
  source 1..26: mol_type = genomic DNA
ttttctttctccgtggcacataaagt

SEQ ID NO: 99467 - DNA, 147 bp, Homo sapiens
  misc_feature 1..147: note = chr8:48676735-48676882
  misc_feature 1..147: note = hypo
  source 1..147: mol_type = genomic DNA
ggtgtggttgtgtatcgtttgtgtggtgtgtgatggggtgtgtgtggtgtggttgtgtgtgcccctctcccttaccgctgcctgctctgggcctagcccctgacgctctgcagcgttgaaaacgttgtgtctcgccctccaggccgg

SEQ ID NO: 99468 - DNA, 45 bp, Homo sapiens; identical to SEQ ID NO: 41774
  misc_feature 1..45: note = chr8:48796372-48796417
  misc_feature 1..45: note = hypo
  source 1..45: mol_type = genomic DNA

SEQ ID NO: 99469 - DNA, 30 bp, Homo sapiens
  misc_feature 1..30: note = chr8:49058263-49058293
  misc_feature 1..30: note = hypo
  source 1..30: mol_type = genomic DNA
aattctgggactcagcgagcacattcacac

SEQ ID NO: 99470 - DNA, 30 bp, Homo sapiens
  misc_feature 1..30: note = chr8:49172784-49172814
  misc_feature 1..30: note = hypo
  source 1..30: mol_type = genomic DNA
ccagagcccagccaacggtaaataggactg

SEQ ID NO: 99471 - DNA, 30 bp, Homo sapiens
  misc_feature 1..30: note = chr8:49195117-49195147
  misc_feature 1..30: note = hypo
  source 1..30: mol_type = genomic DNA
tctctgtggaccagacgctcatggggtgtc

SEQ ID NO: 99472 - DNA, 659 bp, Homo sapiens; identical to SEQ ID NO: 31933
  misc_feature 1..659: note = chr8:49292866-49293525
  misc_feature 1..659: note = hyper
  source 1..659: mol_type = genomic DNA

SEQ ID NO: 99473 - DNA, 37 bp, Homo sapiens; identical to SEQ ID NO: 3239
  misc_feature 1..37: note = chr8:49293580-49293617
  misc_feature 1..37: note = hyper
  source 1..37: mol_type = genomic DNA

SEQ ID NO: 99474 - DNA, 332 bp, Homo sapiens
  misc_feature 1..332: note = chr8:49309314-49309646
  misc_feature 1..332: note = hyper
  source 1..332: mol_type = genomic DNA
tccctgcctgagtcccggggcacgtccccggcacaccatcccctctcttgggtgagagtctccgggtgactccccgcagctccccctgctctcacctccaccggcctccccccgccgtggttcccgcggtgcgccctccccaagtcccttcctcccactgccctgggtcccagagcacatccgccggcggcccccacatccctctgcctggagtcccggtccccgcgcacccccgcccccgccctgccttcacctgccgcaggccgcccgccagccccgctgaccgccgcccccgcgcttcgctggcgccagcctctcgatgggtcttgcac

SEQ ID NO: 99475 - DNA, 306 bp, Homo sapiens
  misc_feature 1..306: note = chr8:49334982-49335288
  misc_feature 1..306: note = hypo
  source 1..306: mol_type = genomic DNA
cagctgtgtgggctgcgctgccttcgggggcacgtgacgccacgtgggaagtgctgtgaggctggtgcggagagcaaacctcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggcaaagctgtgtccaaggaggcaaagattggtccgcagctcagaggag

SEQ ID NO: 99476 - DNA, 90 bp, Homo sapiens
  misc_feature 1..90: note = chr8:49382293-49382383
  misc_feature 1..90: note = hypo
  source 1..90: mol_type = genomic DNA
gggcagagagagcaccgtccaggcagaagggagagcgtgagcaaggggcccgtgggactgagtgctgcgtgtcgccgcagaggggcatga

SEQ ID NO: 99477 - DNA, 326 bp, Homo sapiens
  misc_feature 1..326: note = chr8:49390299-49390625
  misc_feature 1..326: note = hypo
  source 1..326: mol_type = genomic DNA
ggttcagtcgggagacgctcaggcgctgacaacagcctccaggtgccgttccctgcgcatggccccatctttgcgggcagtgtccagtgggcttgtgctcacacctgcgctgggggctccacactagacggccctggactactgaaatagtggacagaagggtctcccgagaatgtccagggtgggcaggcagtgctggggagccagcgggaagggaagggagcctgaggcggagaaacgcccacgcgggagctgctagtgcagccgcaagagcaaggcctgggctgcagtaggggggctgggcagtggcccgcagtgtgcagcag

SEQ ID NO: 99478 - DNA, 30 bp, Homo sapiens
  misc_feature 1..30: note = chr8:49418760-49418790
  misc_feature 1..30: note = hypo
  source 1..30: mol_type = genomic DNA
cagtgtgcagagctgcgcctataggctcct

SEQ ID NO: 99479 - DNA, 160 bp, Homo sapiens; identical to SEQ ID NO: 770
  misc_feature 1..160: note = chr8:49468668-49468828
  misc_feature 1..160: note = hyper
  source 1..160: mol_type = genomic DNA

SEQ ID NO: 99480 - DNA, 362 bp, Homo sapiens; identical to SEQ ID NO: 771
  misc_feature 1..362: note = chr8:49468829-49469191
  misc_feature 1..362: note = hyper
  source 1..362: mol_type = genomic DNA

SEQ ID NO: 99481 - DNA, 17 bp, Homo sapiens
  misc_feature 1..17: note = chr8:494853-494870
  misc_feature 1..17: note = hyper
  source 1..17: mol_type = genomic DNA
cgcgggcccagtgggcc

SEQ ID NO: 99482 - DNA, 67 bp, Homo sapiens
  misc_feature 1..67: note = chr8:49496353-49496420
  misc_feature 1..67: note = hypo
  source 1..67: mol_type = genomic DNA
taagaagaattaatccgtggaaagcggtgccatcaaccgacactcgtcctcccgcccttccctgccc

SEQ ID NO: 99483 - DNA, 30 bp, Homo sapiens
  misc_feature 1..30: note = chr8:49527456-49527486
  misc_feature 1..30: note = hypo
  source 1..30: mol_type = genomic DNA
atgtttatgctaacccgtattagcaatggg

SEQ ID NO: 99484 - DNA, 45 bp, Homo sapiens
  misc_feature 1..45: note = chr8:49547039-49547084
  misc_feature 1..45: note = hypo
  source 1..45: mol_type = genomic DNA
tactccaatgttattcgttgctccgggttccgtttgtaaagagca

SEQ ID NO: 99485 - DNA, 175 bp, Homo sapiens
  misc_feature 1..175: note = chr8:495703-495878
  misc_feature 1..175: note = hyper
  source 1..175: mol_type = genomic DNA
gccgggaggaagcctcgcccagccctggtgggcggtggggccgctggggcctggggcgccgcgggctcggcccggactgacggcggtggggggcggggatggggccgtggtgccgggccgcgcagaacccttgggacccccgcggcgcccaggttggggctcagggcccggagaa

SEQ ID NO: 99486 - DNA, 268 bp, Homo sapiens
  misc_feature 1..268: note = chr8:49571915-49572183
  misc_feature 1..268: note = hypo
  source 1..268: mol_type = genomic DNA
ctccaagaaatgaggcgtgggctgtggaacccattgcggctaatcgtaaacaggtgcatcttaaacataggatgccaacctgctccaacatgctgggcaccgggcttagctgcagctaattacgcgtgcgctctgaccgggcggcccacagcggctctgcaggctcagcggggcgagcgcaggaggcgcgggcccgacacgcgtgtttagacctgcgaggctgtcgggggtgcgcctgggactgagctgggctcgtcttcatttccct

SEQ ID NO: 99487 - DNA, 49 bp, Homo sapiens
  misc_feature 1..49: note = chr8:495952-496001
  misc_feature 1..49: note = hyper
  source 1..49: mol_type = genomic DNA
cgcctggttcccaggccgaaaggagccggcgaggcgacccccgatcccg

SEQ ID NO: 99488 - DNA, 267 bp, Homo sapiens; identical to SEQ ID NO: 41778
  misc_feature 1..267: note = chr8:49608941-49609208
  misc_feature 1..267: note = hypo
  source 1..267: mol_type = genomic DNA

SEQ ID NO: 99489 - DNA, 36 bp, Homo sapiens; identical to SEQ ID NO: 31938
  misc_feature 1..36: note = chr8:49647817-49647853
  misc_feature 1..36: note = hyper
  source 1..36: mol_type = genomic DNA

SEQ ID NO: 99490 - DNA, 30 bp, Homo sapiens
  misc_feature 1..30: note = chr8:49747114-49747144
  misc_feature 1..30: note = hypo
  source 1..30: mol_type = genomic DNA
cacggtgtgcaagtgcgtctggaacagggc

SEQ ID NO: 99491 - DNA, 30 bp, Homo sapiens; identical to SEQ ID NO: 41779
  misc_feature 1..30: note = chr8:49773216-49773246
  misc_feature 1..30: note = hypo
  source 1..30: mol_type = genomic DNA

SEQ ID NO: 99492 - DNA, 214 bp, Homo sapiens
  misc_feature 1..214: note = chr8:49782672-49782886
  misc_feature 1..214: note = hyper
  source 1..214: mol_type = genomic DNA
ggaatgcccaagcttcgcccccggctaaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccggg

SEQ ID NO: 99493 - DNA, 215 bp, Homo sapiens
  misc_feature 1..215: note = chr8:49782922-49783137
  misc_feature 1..215: note = hyper
  source 1..215: mol_type = genomic DNA
cgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagcgccgcgtctccggttagtcagagccccaggtaaataaagagctcggtgtctgcggggctctggcctc

SEQ ID NO: 99494 - DNA, 288 bp, Homo sapiens
  misc_feature 1..288: note = chr8:49808681-49808969
  misc_feature 1..288: note = hypo
  source 1..288: mol_type = genomic DNA
tgggagtgacccctgcggagctgacaagccaatgctggagaagtgcacgggcaggctcaggcgcagccactcaatgggcctgtctgtgtcgggggcaggggcacagagaggggcaggtgagtcgaagctgattgggtgaagaaaagacagtgaaaagacggtgagaccaaaggcacagagcgggtttcccgccccagctaccacgctggtctgcagagcggtaagtctaaactggggagaggtcagaggcagcacaggggcctgtggggcaaccgcaggatccgcgac

SEQ ID NO: 99495 - DNA, 260 bp, Homo sapiens
  misc_feature 1..260: note = chr8:49833748-49834008
  misc_feature 1..260: note = hyper
  source 1..260: mol_type = genomic DNA
tatgtgtgtccagttcgctgtagtttggctttttggaggcgttgaaatgcttcttgaccaggaaggagcgcggcatcttgccagcgggtctggcgggcgcccggcgcggataacggtccggcgggaggacacggcggtccctacagcatcgcggcgggccaggctcgggcaggggccgtgctcaggtgcggcagacggacgggccggcgcctctgaagtcacccggctcctttacgaactgagcccgttttggctgggag

SEQ ID NO: 99496 - DNA, 396 bp, Homo sapiens
  misc_feature 1..396: note = chr8:49834319-49834715
  misc_feature 1..396: note = hyper
  source 1..396: mol_type = genomic DNA
cggggacacagtgtccgccaggagaaggaagggccgccctgcaccacaccaggccagcctctggtgttaatgagagcctatatttggaagtggcatctggagaggtttgccttgcacaaagaccaaataattacctcttggcttttgaaaaaggaagggggaagcgggaagacaaaggcgcctgtgagcgcggaggacgctctcctgggactctggcctggagcgggactgcagccttgcgtgcggcgagggcgctgcgctactcagggcttccgcgaagccaggggcagcgcggccgcgtgcaaattaagtactcatgtcaccgtgttagctatggtggcttgaaagaaatgctttgtagccctctaaaggcaggctgatcggaagaactggaag

SEQ ID NO: 99497 - DNA, 222 bp, Homo sapiens; identical to SEQ ID NO: 41781
  misc_feature 1..222: note = chr8:49959230-49959452
  misc_feature 1..222: note = hypo
  source 1..222: mol_type = genomic DNA

SEQ ID NO: 99498 - DNA, 120 bp, Homo sapiens
  misc_feature 1..120: note = chr8:50015571-50015691
  misc_feature 1..120: note = hypo
  source 1..120: mol_type = genomic DNA
ccttgggtggtctatgggaccgggcgtcttggagcagggggctttgctcctcggggaggctcaggctgtgcaagagcccatggcctgggtggggcgcgggaaggctcaggcatggggcac

SEQ ID NO: 99499 - DNA, 99 bp, Homo sapiens
  misc_feature 1..99: note = chr8:50101810-50101909
  misc_feature 1..99: note = hypo
  source 1..99: mol_type = genomic DNA
ataccagctacccgggaggctgaggctgaagaattgcttcagcaggcggagcaatgctgaacccggcattcggaggcttgaacccggcaggtagaggtt

SEQ ID NO: 99500 - DNA, 156 bp, Homo sapiens; identical to SEQ ID NO: 41783
  misc_feature 1..156: note = chr8:50314445-50314601
  misc_feature 1..156: note = hypo
  source 1..156: mol_type = genomic DNA

SEQ ID NO: 99501 - DNA, 58 bp, Homo sapiens; identical to SEQ ID NO: 41784
  misc_feature 1..58: note = chr8:50377787-50377845
  misc_feature 1..58: note = hypo
  source 1..58: mol_type = genomic DNA

SEQ ID NO: 99502 - DNA, 18 bp, Homo sapiens
  misc_feature 1..18: note = chr8:50378196-50378214
  misc_feature 1..18: note = hypo
  source 1..18: mol_type = genomic DNA
aaccgcctgtagacggca

SEQ ID NO: 99503 - DNA, 23 bp, Homo sapiens
  misc_feature 1..23: note = chr8:50482465-50482488
  misc_feature 1..23: note = hypo
  source 1..23: mol_type = genomic DNA
accgtgcccggccatgttgttca

SEQ ID NO: 99504 - DNA, 292 bp, Homo sapiens
  misc_feature 1..292: note = chr8:50822066-50822358
  misc_feature 1..292: note = hyper
  source 1..292: mol_type = genomic DNA
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcggccccttccagc

SEQ ID NO: 99505 - DNA, 1389 bp, Homo sapiens
  misc_feature 1..1389: note = chr8:50822494-50823883
  misc_feature 1..1389: note = hyper
  source 1..1389: mol_type = genomic DNA
cgtcccgagtgattcccggctcagtaacgtttctcctccagggagcccactggaactccactggctgtgccgcctcctcgcccgtcccccgcgcgcgccgcaggccggtgcttggagagcgcaatgtccccgggagggaagatcccctacctggaatggatggttccagaccagcgggaacgcgctctaatccttgatggaagcaagcgtgggaggaaagcacaacgtctaggacttccctgtagtgtcagaacaggaagaagaacctgagaagtcgccggggaagggaggccaggagcaggcgtccggccccttcccacagcccgggagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgccaagagcgggagtgaagagcctgcaaggcccgggagagcgcggattccggagtagggaggcgagggggcagcgtgggagaccagagggaaaatgggctgaaaagccaacaaaaaaaacaacgtaaattgggctttgctctggctttacaaaggcagagattgtcgagccctctgactgtctttgtgccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaaggtagccgagtgcagatgctttttcctgtctttttcattctttcattctctgtcttttaaaattttaacaataacctatcgtttccgcgtggagggtctaagaatcttcactgggtttaatttaggaatttcaaattgggtttctcaaaatttgaatgtggtccccttaattggtaatcaagattgcggagttttccaaaatattccttttcatcttatgtaattaaagatccacgagctttccaaagaagctctggattttccacggtacaaatctata

SEQ ID NO: 99506 - DNA, 174 bp, Homo sapiens; identical to SEQ ID NO: 31948
  misc_feature 1..174: note = chr8:50824134-50824308
  misc_feature 1..174: note = hyper
  source 1..174: mol_type = genomic DNA

SEQ ID NO: 99507 - DNA, 57 bp, Homo sapiens
  misc_feature 1..57: note = chr8:50824352-50824409
  misc_feature 1..57: note = hyper
  source 1..57: mol_type = genomic DNA
cgccacgggcagctgggctacttgctcctcgcagctaaaaggcggtgcctcctatta

SEQ ID NO: 99508 - DNA, 44 bp, Homo sapiens
  misc_feature 1..44: note = chr8:52183842-52183886
  misc_feature 1..44: note = hypo
  source 1..44: mol_type = genomic DNA
ggccagaacaagttccgggtgggcatgggctcagtgggccctgc

SEQ ID NO: 99509 - DNA, 18 bp, Homo sapiens
  misc_feature 1..18: note = chr8:52230574-52230592
  misc_feature 1..18: note = hypo
  source 1..18: mol_type = genomic DNA
gcccggccagtaattgtc

SEQ ID NO: 99510 - DNA, 34 bp, Homo sapiens; identical to SEQ ID NO: 15119
  misc_feature 1..34: note = chr8:52432891-52432925
  misc_feature 1..34: note = hypo
  source 1..34: mol_type = genomic DNA

SEQ ID NO: 99511 - DNA, 143 bp, Homo sapiens
  misc_feature 1..143: note = chr8:53352268-53352411
  misc_feature 1..143: note = hypo
  source 1..143: mol_type = genomic DNA
ggatcccggtacgttcgaaggccgcagggtcgaggccaggaggtttggatgctgaggtttgcgtgcagaggacagagaccagtaacacccagatcctaggcctgagaaactggagaatgaaattaccacgtactgacacagta

SEQ ID NO: 99512 - DNA, 157 bp, Homo sapiens
  misc_feature 1..157: note = chr8:53416425-53416582
  misc_feature 1..157: note = hypo
  source 1..157: mol_type = genomic DNA
tggaatcttggcatacggttgaattgagggtgacctccagcctcaggctatgagaaagagaccttggtgccggagtttgtaaaaggcaaatctcctgcagcggacaagattctagtgccaccaggtgattttccagtgagcacgggcttctcagaga

SEQ ID NO: 99513 - DNA, 49 bp, Homo sapiens; identical to SEQ ID NO: 9511
  misc_feature 1..49: note = chr8:53477121-53477170
  misc_feature 1..49: note = hyper
  source 1..49: mol_type = genomic DNA

SEQ ID NO: 99514 - DNA, 329 bp, Homo sapiens
  misc_feature 1..329: note = chr8:53477408-53477737
  misc_feature 1..329: note = hyper
  source 1..329: mol_type = genomic DNA
gatcccattgccagccggatttctttacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 99515 - DNA, 30 bp, Homo sapiens
  misc_feature 1..30: note = chr8:5347789-5347819
  misc_feature 1..30: note = hypo
  source 1..30: mol_type = genomic DNA
ataaaagtattaaatcgattaaagattgtg

SEQ ID NO: 99516 - DNA, 510 bp, Homo sapiens
  misc_feature 1..510: note = chr8:53477944-53478454
  misc_feature 1..510: note = hyper
  source 1..510: mol_type = genomic DNA
cgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagtagggtaactgccgcgtcgccccggcggttctccctgggctctgtctcccgccgcctccaccccccgagcctcggggtccgtcacggcttcccctggctggcggggtcagtagaacccgcggcgcctaggtccggacggaaaaaagcagggccggggtgcggcctggatgagcggagatctccgcgccttgggctcaaaggtgcggggtgc

SEQ ID NO: 99517 - DNA, 185 bp, Homo sapiens; identical to SEQ ID NO: 31954
  misc_feature 1..185: note = chr8:53478455-53478640
  misc_feature 1..185: note = hyper
  source 1..185: mol_type = genomic DNA

SEQ ID NO: 99518 - DNA, 30 bp, Homo sapiens
  misc_feature 1..30: note = chr8:53756040-53756070
  misc_feature 1..30: note = hypo
  source 1..30: mol_type = genomic DNA
tcccacagtggttaccgatggaggtcttcc

SEQ ID NO: 99519 - DNA, 30 bp, Homo sapiens; identical to SEQ ID NO: 41787
  misc_feature 1..30: note = chr8:53805607-53805637
  misc_feature 1..30: note = hypo
  source 1..30: mol_type = genomic DNA

SEQ ID NO: 99520 - DNA, 20 bp, Homo sapiens
  misc_feature 1..20: note = chr8:53843008-53843028
  misc_feature 1..20: note = hypo
  source 1..20: mol_type = genomic DNA
acatgcgagttttaaaatca

SEQ ID NO: 99521 - DNA, 48 bp, Homo sapiens; identical to SEQ ID NO: 31955
  misc_feature 1..48: note = chr8:53852136-53852184
  misc_feature 1..48: note = hyper
  source 1..48: mol_type = genomic DNA

SEQ ID NO: 99522 - DNA, 880 bp, Homo sapiens
  misc_feature 1..880: note = chr8:53853579-53854459
  misc_feature 1..880: note = hyper
  source 1..880: mol_type = genomic DNA
cgacctagcagatcggaagcgctgcgactgtgcccgcaggttgaccttgccaagccctccaggtgatgcgcggccatgccgggtgaggagaactgaggctgagatcgccacactgagggctccctaaagccgaggtggaggaagaggagggtagaggaggagggcggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 99523 - DNA, 34 bp, Homo sapiens
  misc_feature 1..34: note = chr8:54163316-54163350
  misc_feature 1..34: note = hyper
  source 1..34: mol_type = genomic DNA
gcgctgcgctgtccccgcgctcaccggatgatca

SEQ ID NO: 99524 - DNA, 454 bp, Homo sapiens
  misc_feature 1..454: note = chr8:54163673-54164127
  misc_feature 1..454: note = hyper
  source 1..454: mol_type = genomic DNA
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccc

SEQ ID NO: 99525 - DNA, 212 bp, Homo sapiens
  misc_feature 1..212: note = chr8:54164390-54164602
  misc_feature 1..212: note = hyper
  source 1..212: mol_type = genomic DNA
cgcaggctcgcccggcccactaactgcccgagcggcacaccgcctggtccccggccatgcagccttccccaagacctgagactgagccatttagatttagtaaaaaggaggagcatgcctatttagtgcaagtatgcacctggattttcatattgtgtctagaacttcttatctgcatagttcgcagtcaggaactacgcttattagaatgg

SEQ ID NO: 99526 - DNA, 39 bp, Homo sapiens; identical to SEQ ID NO: 31961
  misc_feature 1..39: note = chr8:54570523-54570562
  misc_feature 1..39: note = hyper
  source 1..39: mol_type = genomic DNA

SEQ ID NO: 99527 - DNA, 214 bp, Homo sapiens
  misc_feature 1..214: note = chr8:54582655-54582869
  misc_feature 1..214: note = hypo
  source 1..214: mol_type = genomic DNA
gacagtatctcagatcgttcctttgttttgtaaagtggaagaaaggctgtccttaaaggggcagggagaatgaagaagagctgtgactctcaaagcaggacccgtgggaagggtgctgtcctgaaggacgcaggtagatgccaagacacctgctggttcctcctccccagggaactatttgctctttcacctgttgctgcgctggctcagtctg

SEQ ID NO: 99528 - DNA, 707 bp, Homo sapiens
  misc_feature 1..707: note = chr8:54789099-54789806
  misc_feature 1..707: note = hyper
  source 1..707: mol_type = genomic DNA
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 99529 - DNA, 785 bp, Homo sapiens; identical to SEQ ID NO: 31964
  misc_feature 1..785: note = chr8:54790022-54790807
  misc_feature 1..785: note = hyper
  source 1..785: mol_type = genomic DNA

SEQ ID NO: 99530 - DNA, 15 bp, Homo sapiens
  misc_feature 1..15: note = chr8:54791767-54791782
  misc_feature 1..15: note = hyper
  source 1..15: mol_type = genomic DNA
ggacaccacagtaac

SEQ ID NO: 99531 - DNA, 49 bp, Homo sapiens; identical to SEQ ID NO: 774
  misc_feature 1..49: note = chr8:54791897-54791946
  misc_feature 1..49: note = hyper
  source 1..49: mol_type = genomic DNA

SEQ ID NO: 99532 - DNA, 487 bp, Homo sapiens; identical to SEQ ID NO: 775
  misc_feature 1..487: note = chr8:54792184-54792671
  misc_feature 1..487: note = hyper
  source 1..487: mol_type = genomic DNA

SEQ ID NO: 99533 - DNA, 2080 bp, Homo sapiens
  misc_feature 1..2080: note = chr8:54792701-54794781
  misc_feature 1..2080: note = hyper
  source 1..2080: mol_type = genomic DNA
cggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 99534 - DNA, 124 bp, Homo sapiens; identical to SEQ ID NO: 9528
  misc_feature 1..124: note = chr8:54794826-54794950
  misc_feature 1..124: note = hyper
  source 1..124: mol_type = genomic DNA

SEQ ID NO: 99535 - DNA, 31 bp, Homo sapiens
  misc_feature 1..31: note = chr8:54795139-54795170
  misc_feature 1..31: note = hyper
  source 1..31: mol_type = genomic DNA
cgtaacttggcaaaagctcgcgccactgccc

SEQ ID NO: 99536 - DNA, 207 bp, Homo sapiens
  misc_feature 1..207: note = chr8:55122423-55122630
  misc_feature 1..207: note = hypo
  source 1..207: mol_type = genomic DNA
aacagtacctggggccgcactgagagtgagatgatggtcctcatccccgcgcagatgggaatctttgtttagattaacagaggactgtacatacaccctcaaaacagattagatattttccctgggaacttgctgtaattcttactccccttgcccctcttttccatgaaagcatgaggttacactgatgaacgctcctcccttcct

SEQ ID NO: 99537 - DNA, 40 bp, Homo sapiens; identical to SEQ ID NO: 41788
  misc_feature 1..40: note = chr8:55191496-55191536
  misc_feature 1..40: note = hypo
  source 1..40: mol_type = genomic DNA

SEQ ID NO: 99538 - DNA, 30 bp, Homo sapiens; identical to SEQ ID NO: 41789
  misc_feature 1..30: note = chr8:55285908-55285938
  misc_feature 1..30: note = hypo
  source 1..30: mol_type = genomic DNA

SEQ ID NO: 99539 - DNA, 274 bp, Homo sapiens
  misc_feature 1..274: note = chr8:55366094-55366368
  misc_feature 1..274: note = hyper
  source 1..274: mol_type = genomic DNA
ccacacacctcaacccggggccacagttggaggtggggagatctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 99540 - DNA, 690 bp, Homo sapiens; identical to SEQ ID NO: 31973
  misc_feature 1..690: note = chr8:55366951-55367641
  misc_feature 1..690: note = hyper
  source 1..690: mol_type = genomic DNA

SEQ ID NO: 99541 - DNA, 223 bp, Homo sapiens; identical to SEQ ID NO: 777
  misc_feature 1..223: note = chr8:55370113-55370336
  misc_feature 1..223: note = hyper
  source 1..223: mol_type = genomic DNA

SEQ ID NO: 99542 - DNA, 86 bp, Homo sapiens; identical to SEQ ID NO: 778
  misc_feature 1..86: note = chr8:55370337-55370423
  misc_feature 1..86: note = hyper
  source 1..86: mol_type = genomic DNA

SEQ ID NO: 99543 - skipped

SEQ ID NO: 99544 - DNA, 147 bp, Homo sapiens; identical to SEQ ID NO: 31977
  misc_feature 1..147: note = chr8:55370567-55370714
  misc_feature 1..147: note = hyper
  source 1..147: mol_type = genomic DNA

SEQ ID NO: 99545 - DNA, 198 bp, Homo sapiens; identical to SEQ ID NO: 31978
  misc_feature 1..198: note = chr8:55370835-55371033
  misc_feature 1..198: note = hyper
  source 1..198: mol_type = genomic DNA

SEQ ID NO: 99546 - DNA, 204 bp, Homo sapiens; identical to SEQ ID NO: 781
  misc_feature 1..204: note = chr8:55371172-55371376
  misc_feature 1..204: note = hyper
  source 1..204: mol_type = genomic DNA

SEQ ID NO: 99547 - DNA, 286 bp, Homo sapiens; identical to SEQ ID NO: 782
  misc_feature 1..286: note = chr8:55371439-55371725
  misc_feature 1..286: note = hyper
  source 1..286: mol_type = genomic DNA

SEQ ID NO: 99548 - DNA, 75 bp, Homo sapiens; identical to SEQ ID NO: 783
  misc_feature 1..75: note = chr8:55371993-55372068
  misc_feature 1..75: note = hyper
  source 1..75: mol_type = genomic DNA

SEQ ID NO: 99549 - DNA, 147 bp, Homo sapiens
  misc_feature 1..147: note = chr8:55372416-55372563
  misc_feature 1..147: note = hyper
  source 1..147: mol_type = genomic DNA
cgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccc

SEQ ID NO: 99550 - DNA, 67 bp, Homo sapiens
  misc_feature 1..67: note = chr8:55379164-55379231
  misc_feature 1..67: note = hyper
  source 1..67: mol_type = genomic DNA
gaccgcgacgtcgcgcgcccgcttcgaggagttttgagctcttagcttggtgccggggcccgcccgg

SEQ ID NO: 99551 - DNA, 162 bp, Homo sapiens; identical to SEQ ID NO: 3261
  misc_feature 1..162: note = chr8:55379295-55379457
  misc_feature 1..162: note = hyper
  source 1..162: mol_type = genomic DNA

SEQ ID NO: 99552 - DNA, 108 bp, Homo sapiens; identical to SEQ ID NO: 3262
  misc_feature 1..108: note = chr8:55380036-55380144
  misc_feature 1..108: note = hyper
  source 1..108: mol_type = genomic DNA

SEQ ID NO: 99553 - DNA, 64 bp, Homo sapiens
  misc_feature 1..64: note = chr8:55380175-55380239
  misc_feature 1..64: note = hyper
  source 1..64: mol_type = genomic DNA
cgtgtttagcgattctcatatttagtgtttccctttagggagacttgaccggcaattgcagact

SEQ ID NO: 99554 - skipped

SEQ ID NO: 99555 - DNA, 55 bp, Homo sapiens
  misc_feature 1..55: note = chr8:55383182-55383237
  misc_feature 1..55: note = hyper
  source 1..55: mol_type = genomic DNA
ggtgccgacttcaacctctctgctcaggcctcttgagttgcgttaccagcttacc

SEQ ID NO: 99556 - DNA, 103 bp, Homo sapiens
  misc_feature 1..103: note = chr8:55394094-55394197
  misc_feature 1..103: note = hypo
  source 1..103: mol_type = genomic DNA
aaaattgatattgccagattactttctagttgcactctaccagtagttcacaacagtgttggcttttccatactcccaccaacatcaacgtactggttaattt

SEQ ID NO: 99557 - DNA, 30 bp, Homo sapiens; identical to SEQ ID NO: 15120
  misc_feature 1..30: note = chr8:55689465-55689495
  misc_feature 1..30: note = hypo
  source 1..30: mol_type = genomic DNA

SEQ ID NO: 99558 - DNA, 133 bp, Homo sapiens
  misc_feature 1..133: note = chr8:55787730-55787863
  misc_feature 1..133: note = hypo
  source 1..133: mol_type = genomic DNA
ctctctggggctggccgaggccggagccggctccctctgctcgctgggaggtgtggagggagaggcgccggcgggagcccgccgggcgctcgcaggcggtggcggttccgggtgggcgcgggctgggcaggcc

SEQ ID NO: 99559 - DNA, 30 bp, Homo sapiens
  misc_feature 1..30: note = chr8:55987089-55987119
  misc_feature 1..30: note = hypo
  source 1..30: mol_type = genomic DNA
tggctgaatttcccccgtgaaatactgggg

SEQ ID NO: 99560 - DNA, 373 bp, Homo sapiens
  misc_feature 1..373: note = chr8:56013520-56013893
  misc_feature 1..373: note = hyper
  source 1..373: mol_type = genomic DNA
ctccttgaatcactccgatcacagatttaatttttcgagtcatttctggagttgtgggaccacacagctagtttgcaatccctatagctttaagagaaggtatttctagttttggagtaaggagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccg

SEQ ID NO: 99561 - DNA, 58 bp, Homo sapiens; identical to SEQ ID NO: 31989
  misc_feature 1..58: note = chr8:56014127-56014185
  misc_feature 1..58: note = hyper
  source 1..58: mol_type = genomic DNA

SEQ ID NO: 99562 - DNA, 368 bp, Homo sapiens; identical to SEQ ID NO: 3264
  misc_feature 1..368: note = chr8:56014376-56014744
  misc_feature 1..368: note = hyper
  source 1..368: mol_type = genomic DNA

SEQ ID NO: 99563 - DNA, 19 bp, Homo sapiens
  misc_feature 1..19: note = chr8:56015034-56015053
  misc_feature 1..19: note = hyper
  source 1..19: mol_type = genomic DNA
ggtgtggaggcatcatggc

SEQ ID NO: 99564 - DNA, 477 bp, Homo sapiens
  misc_feature 1..477: note = chr8:56015185-56015662
  misc_feature 1..477: note = hyper
  source 1..477: mol_type = genomic DNA
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaagg

SEQ ID NO: 99565 - DNA, 50 bp, Homo sapiens; identical to SEQ ID NO: 31994
  misc_feature 1..50: note = chr8:56015749-56015799
  misc_feature 1..50: note = hyper
  source 1..50: mol_type = genomic DNA

SEQ ID NO: 99566 - DNA, 234 bp, Homo sapiens
  misc_feature 1..234: note = chr8:56361841-56362075
  misc_feature 1..234: note = hypo
  source 1..234: mol_type = genomic DNA
actttggccacctcccggcacggtgctcagctgtgacgccgaaataagttagggctggccgggcggtgcggggcagggactagggctgtacacacaagtgctgggggctcggggcctcactactgccgagggccgggccggggctgtaaacatggccagggctgccctgcccacccctagtggtcggtaacgactggaagcagagcagccaggcaaggtcgggaggctcaggcg

SEQ ID NO: 99567 - DNA, 96 bp, Homo sapiens
  misc_feature 1..96: note = chr8:56364237-56364333
  misc_feature 1..96: note = hypo
  source 1..96: mol_type = genomic DNA
agccccgggtacctgcggtagatggcatgcatgcggttgaccagagaaatgcggaaggattcagacttggcccggctcaggcggctgctcaggggg

SEQ ID NO: 99568 - DNA, 174 bp, Homo sapiens
  misc_feature 1..174: note = chr8:56364850-56365024
  misc_feature 1..174: note = hypo
  source 1..174: mol_type = genomic DNA
tttctccttggtcagcgcggccaccgggaaggagcggaacaccaccttctcccccaccagggggtctgtgagcatccccgtgaagatgacccggtacgtagtgaggaagagggcgccctcagctgggagcagtgctggccaccccgcactgcccgccctcgcaccctcctcacg

SEQ ID NO: 99569 - DNA, 30 bp, Homo sapiens
  misc_feature 1..30: note = chr8:56367284-56367314
  misc_feature 1..30: note = hypo
  source 1..30: mol_type = genomic DNA
gttcctgaacacctccgcatggtcaagtcg

SEQ ID NO: 99570 - DNA, 30 bp, Homo sapiens
  misc_feature 1..30: note = chr8:56367761-56367791
  misc_feature 1..30: note = hypo
  source 1..30: mol_type = genomic DNA
ggcctggccctggaccgcacacccgggaca

SEQ ID NO: 99571 - DNA, 95 bp, Homo sapiens; identical to SEQ ID NO: 41794
  misc_feature 1..95: note = chr8:56539998-56540093
  misc_feature 1..95: note = hypo
  source 1..95: mol_type = genomic DNA

SEQ ID NO: 99572 - DNA, 62 bp, Homo sapiens
  misc_feature 1..62: note = chr8:56602218-56602280
  misc_feature 1..62: note = hypo
  source 1..62: mol_type = genomic DNA
agccttgacagggggcgggctccaggtccagccttgtcggagttgaccgagggcttaggcca

SEQ ID NO: 99573 - DNA, 22 bp, Homo sapiens
  misc_feature 1..22: note = chr8:56613576-56613598
  misc_feature 1..22: note = hypo
  source 1..22: mol_type = genomic DNA
gccgcggtggcttcacgcctgt

SEQ ID NO: 99574 - DNA, 39 bp, Homo sapiens
  misc_feature 1..39: note = chr8:566435-566474
  misc_feature 1..39: note = hypo
  source 1..39: mol_type = genomic DNA
gctctcctggctaagcggattcagcgctggccaacaaac

SEQ ID NO: 99575 - DNA, 80 bp, Homo sapiens
  misc_feature 1..80: note = chr8:56688545-56688625
  misc_feature 1..80: note = hypo
  source 1..80: mol_type = genomic DNA
ctaaatcccttggatcgattgactgtagcaggaagaaccgcagacaaaacccctcagacaccaggttaaagaaggaaggg

SEQ ID NO: 99576 - DNA, 41 bp, Homo sapiens
  misc_feature 1..41: note = chr8:56792024-56792065
  misc_feature 1..41: note = hyper
  source 1..41: mol_type = genomic DNA
tggaagggatcagagcgcacctcctccgctcctgggagcac

SEQ ID NO: 99577 - DNA, 30 bp, Homo sapiens; identical to SEQ ID NO: 41796
  misc_feature 1..30: note = chr8:56883198-56883228
  misc_feature 1..30: note = hypo
  source 1..30: mol_type = genomic DNA

SEQ ID NO: 99578 - DNA, 109 bp, Homo sapiens
  misc_feature 1..109: note = chr8:56929738-56929847
  misc_feature 1..109: note = hypo
  source 1..109: mol_type = genomic DNA
aacctggtaaggcagcgtgaggccacgccttggagagaaggtactgtcccaggtgagcgtgagcttctcataccgtgctggtggcagcactccacggtggaggacggcc

SEQ ID NO: 99579 - DNA, 29 bp, Homo sapiens
  misc_feature 1..29: note = chr8:57025591-57025620
  misc_feature 1..29: note = hyper
  source 1..29: mol_type = genomic DNA
atgacgtccccaaggcgctgcccggggag

SEQ ID NO: 99580 - DNA, 547 bp, Homo sapiens; identical to SEQ ID NO: 31997
  misc_feature 1..547: note = chr8:57025775-57026322
  misc_feature 1..547: note = hyper
  source 1..547: mol_type = genomic DNA

SEQ ID NO: 99581 - DNA, 55 bp, Homo sapiens; identical to SEQ ID NO: 3269
  misc_feature 1..55: note = chr8:57026501-57026556
  misc_feature 1..55: note = hyper
  source 1..55: mol_type = genomic DNA

SEQ ID NO: 99582 - DNA, 185 bp, Homo sapiens; identical to SEQ ID NO: 31999
  misc_feature 1..185: note = chr8:57069553-57069738
  misc_feature 1..185: note = hyper
  source 1..185: mol_type = genomic DNA

SEQ ID NO: 99583 - DNA, 163 bp, Homo sapiens; identical to SEQ ID NO: 789
  misc_feature 1..163: note = chr8:57069850-57070013
  misc_feature 1..163: note = hyper
  source 1..163: mol_type = genomic DNA

SEQ ID NO: 99584 - DNA, 143 bp, Homo sapiens; identical to SEQ ID NO: 790
  misc_feature 1..143: note = chr8:57070014-57070157
  misc_feature 1..143: note = hyper
  source 1..143: mol_type = genomic DNA

SEQ ID NO: 99585 - DNA, 30 bp, Homo sapiens
  misc_feature 1..30: note = chr8:57108924-57108954
  misc_feature 1..30: note = hypo
  source 1..30: mol_type = genomic DNA
ctcagaggatagaaccggatatatgagtgt

SEQ ID NO: 99586 - DNA, 359 bp, Homo sapiens
  misc_feature 1..359: note = chr8:57232533-57232892
  misc_feature 1..359: note = hyper
  source 1..359: mol_type = genomic DNA
cccaaagggcggcctcgcccgacccccgccagcgcgacctcctccgggagccagcacccaggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggccggccgtagccccagtgcgcgacgtgggcagcactcccatcttctttttctggacctgcagatttaagaagctggaaattcggtggtggaaactggatgcgtgcgccggatttctcttagg

SEQ ID NO: 99587 - DNA, 193 bp, Homo sapiens
  misc_feature 1..193: note = chr8:57357954-57358147
  misc_feature 1..193: note = hyper
  source 1..193: mol_type = genomic DNA
atgggaagatgactgcgtgtggaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttac

SEQ ID NO: 99588 - DNA, 198 bp, Homo sapiens; identical to SEQ ID NO: 32004
  misc_feature 1..198: note = chr8:57358464-57358662
  misc_feature 1..198: note = hyper
  source 1..198: mol_type = genomic DNA

SEQ ID NO: 99589 - DNA, 286 bp, Homo sapiens; identical to SEQ ID NO: 791
  misc_feature 1..286: note = chr8:57358806-57359092
  misc_feature 1..286: note = hyper
  source 1..286: mol_type = genomic DNA

SEQ ID NO: 99590 - DNA, 408 bp, Homo sapiens; identical to SEQ ID NO: 32006
  misc_feature 1..408: note = chr8:57359259-57359667
  misc_feature 1..408: note = hyper
  source 1..408: mol_type = genomic DNA

SEQ ID NO: 99591 - DNA, 86 bp, Homo sapiens; identical to SEQ ID NO: 793
  misc_feature 1..86: note = chr8:57360540-57360626
  misc_feature 1..86: note = hyper
  source 1..86: mol_type = genomic DNA

SEQ ID NO: 99592 - DNA, 153 bp, Homo sapiens
  misc_feature 1..153: note = chr8:57360769-57360922
  misc_feature 1..153: note = hyper
  source 1..153: mol_type = genomic DNA
cgagcaccgcctgcctcccggccggggcatcacggtagcaaggtcgggaaagcagagccctggagtggggctggagaaccccggacatagccctagggagccagcattaccctctgagcaggaaaacacaatgtttcccgctttaggttcttt

SEQ ID NO: 99593 - DNA, 30 bp, Homo sapiens
  misc_feature 1..30: note = chr8:57427547-57427577
  misc_feature 1..30: note = hypo
  source 1..30: mol_type = genomic DNA
tacagagcacagctccggagatgcccctca

SEQ ID NO: 99594 - DNA, 30 bp, Homo sapiens
  misc_feature 1..30: note = chr8:57565771-57565801
  misc_feature 1..30: note = hypo
  source 1..30: mol_type = genomic DNA
ttttccatacacacccgctaaccatcagac

SEQ ID NO: 99595 - DNA, 39 bp, Homo sapiens; identical to SEQ ID NO: 41798
  misc_feature 1..39: note = chr8:57566358-57566397
  misc_feature 1..39: note = hypo
  source 1..39: mol_type = genomic DNA

SEQ ID NO: 99596 - DNA, 28 bp, Homo sapiens
  misc_feature 1..28: note = chr8:57696848-57696876
  misc_feature 1..28: note = hypo
  source 1..28: mol_type = genomic DNA
ttctttctggccaggcgcggtggctcac

SEQ ID NO: 99597 - DNA, 120 bp, Homo sapiens
  misc_feature 1..120: note = chr8:57984827-57984947
  misc_feature 1..120: note = hypo
  source 1..120: mol_type = genomic DNA
aatgagactctgtctcaaaaacaaatcattaataaataaaataaaataaaatatttaaaaactgttatggcgtgtacaacaaacatgcaggtggacactagctgtaaagagctggtaatg

SEQ ID NO: 99598 - DNA, 30 bp, Homo sapiens; identical to SEQ ID NO: 41799
  misc_feature 1..30: note = chr8:57995953-57995983
  misc_feature 1..30: note = hypo
  source 1..30: mol_type = genomic DNA

SEQ ID NO: 99599 - DNA, 20 bp, Homo sapiens
  misc_feature 1..20: note = chr8:58009302-58009322
  misc_feature 1..20: note = hypo
  source 1..20: mol_type = genomic DNA
caccgcgcccggccgctcct

SEQ ID NO: 99600 - DNA, 281 bp, Homo sapiens
  misc_feature 1..281: note = chr8:58105899-58106180
  misc_feature 1..281: note = hypo
  source 1..281: mol_type = genomic DNA
agtgccaggatccctcgctttgggcgcttgtccaggaggaagaagggggtggtgcagtcaagcgggccctggggcaggcctggcccagcgctccgttcttgggagccctgccagcccacaggcccatctgcggcaggcacgtggtgccgcgagaacttggctcagggacggtttttccgccatgcgcagattctcgcctctcgcgggggcgccagggggcagctggttgaggtgcgcatgcgcactggcacctaacggctcttcttcgagtcttctcagag

SEQ ID NO: 99601 - DNA, 113 bp, Homo sapiens
  misc_feature 1..113: note = chr8:58106596-58106709
  misc_feature 1..113: note = hypo
  source 1..113: mol_type = genomic DNA
gcgggaggaggtgggcgggtggggagaagcacccccttcagagttggggcttggggagtgggggcgaggggaggcatggaaagaatgggtgtgcggagcgggccgttctggtg

SEQ ID NO: 99602 - DNA, 129 bp, Homo sapiens; identical to SEQ ID NO: 41802
  misc_feature 1..129: note = chr8:58116950-58117079
  misc_feature 1..129: note = hypo
  source 1..129: mol_type = genomic DNA

SEQ ID NO: 99603 - DNA, 165 bp, Homo sapiens
  misc_feature 1..165: note = chr8:58127855-58128020
  misc_feature 1..165: note = hypo
  source 1..165: mol_type = genomic DNA
catctgggaggattgcggggtgtgcgggaggatgagctgggaaggattcaaggccttgggaggcaacatgtgaagatgattaaatatgtggcagaagaaacacctgagaagatgggatgcttgccagggggaacaagggacagagtggagcgtttgggagaaggg

SEQ ID NO: 99604 - DNA, 527 bp, Homo sapiens
  misc_feature 1..527: note = chr8:58130301-58130828
  misc_feature 1..527: note = hypo
  source 1..527: mol_type = genomic DNA
ggaagacacatctgacgagatcgaatgttttgcagaagagccatgtgaccagatccctggtttggcagaggagacatgcgagaagacggaacgttttggccgaggagacatctggcagggtggaacggagggaacaggtgtggcagagagaatatctgagaagctcgcaggattcccagaaggagcactgggagtagattgcctgttttcccgaaggaacggcaagttccaaaggtcagaggctcatgtgaactctgtcgggttcaggagcagctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacgttttcccttccag

SEQ ID NO: 99605 - DNA, 30 bp, Homo sapiens
  misc_feature 1..30: note = chr8:58132758-58132788
  misc_feature 1..30: note = hypo
  source 1..30: mol_type = genomic DNA
gtgtggcagaaagaacgtctgagaagctca

SEQ ID NO: 99606 - DNA, 288 bp, Homo sapiens
  misc_feature 1..288: note = chr8:58171442-58171730
  misc_feature 1..288: note = hypo
  source 1..288: mol_type = genomic DNA
agggccagaggaggccgctgagcctaaatcaggcagtccgcccagcagctgcaggaaggaggtaacaggcctctcagccccatccaggcggctgctgcacagtgcccagcgcccactacctagctctgtaagcgcaggccaaggcagagtggaccctagggaggagggagggcagtacgctcggcgacccttgggtgcacttgactgtactcggggacaagcccggccagccactatggtgggctcagctgcagctgccacctgcacatggtgcgctccagccgcagt

SEQ ID NO: 99607 - DNA, 32 bp, Homo sapiens
  misc_feature 1..32: note = chr8:58172070-58172102
  misc_feature 1..32: note = hypo
  source 1..32: mol_type = genomic DNA
ccagcacggggaccccgcggccaggcagccac

SEQ ID NO: 99608 - DNA, 30 bp, Homo sapiens
  misc_feature 1..30: note = chr8:58174512-58174542
  misc_feature 1..30: note = hypo
  source 1..30: mol_type = genomic DNA
gagagaattttaaagcggtataacaaaatt

SEQ ID NO: 99609 - DNA, 30 bp, Homo sapiens
  misc_feature 1..30: note = chr8:58245377-58245407
  misc_feature 1..30: note = hypo
  source 1..30: mol_type = genomic DNA
aataacattatttaccgtatctgggccaga

SEQ ID NO: 99610 - DNA, 27 bp, Homo sapiens
  misc_feature 1..27: note = chr8:58276371-58276398
  misc_feature 1..27: note = hypo
  source 1..27: mol_type = genomic DNA
ggcgtgagccaccgcacctggctcaat

SEQ ID NO: 99611 - DNA, 38 bp, Homo sapiens; identical to SEQ ID NO: 41804
  misc_feature 1..38: note = chr8:58716351-58716389
  misc_feature 1..38: note = hypo
  source 1..38: mol_type = genomic DNA

SEQ ID NO: 99612 - DNA, 163 bp, Homo sapiens
  misc_feature 1..163: note = chr8:58906952-58907115
  misc_feature 1..163: note = hyper
  source 1..163: mol_type = genomic DNA
agaagggtggggacccggaaggtggggtgggggcgggatggaggcggggcggggtgtacgaggggcgtgtacactggctcagggacacgcgctctcggccacagcaactggctccaagttccctccctcactctccggcgaagcctgcctgagccctcccact

SEQ ID NO: 99613 - DNA, 284 bp, Homo sapiens
  misc_feature 1..284: note = chr8:58907135-58907419
  misc_feature 1..284: note = hyper
  source 1..284: mol_type = genomic DNA
cggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggatt

SEQ ID NO: 99614 - DNA, 338 bp, Homo sapiens; identical to SEQ ID NO: 9561
  misc_feature 1..338: note = chr8:58907483-58907821
  misc_feature 1..338: note = hyper
  source 1..338: mol_type = genomic DNA

SEQ ID NO: 99615 - DNA, 119 bp, Homo sapiens; identical to SEQ ID NO: 9562
  misc_feature 1..119: note = chr8:58907822-58907941
  misc_feature 1..119: note = hyper
  source 1..119: mol_type = genomic DNA

SEQ ID NO: 99616 - DNA, 100 bp, Homo sapiens
  misc_feature 1..100: note = chr8:59059033-59059133
  misc_feature 1..100: note = hypo
  source 1..100: mol_type = genomic DNA
agcccccggtgtgcccggctgccaagcgcgcactgggcagccccacgctcaaagtgttcggcaaccacgccaagaccgagagcggcgtgcagagggagaa

SEQ ID NO: 99617 - DNA, 178 bp, Homo sapiens
  misc_feature 1..178: note = chr8:591505-591683
  misc_feature 1..178: note = hypo
  source 1..178: mol_type = genomic DNA
gttaatagcctgtatcgtaatgtatttcctcaaaggtgtctctcattccacatcgaaagaccttttcacacagattattcaaattatagcttaatatttcttgattaattgtactgggaggaggtagtgtgtctgagcgtgatctaatcagtggagaacgcagcggccgtcacgcctg

SEQ ID NO: 99618 - DNA, 36 bp, Homo sapiens
  misc_feature 1..36: note = chr8:592946-592982
  misc_feature 1..36: note = hypo
  source 1..36: mol_type = genomic DNA
tgtgcaggtgggagacgccgccgagtcacttgttgg

SEQ ID NO: 99619 - DNA, 96 bp, Homo sapiens
  misc_feature 1..96: note = chr8:593203-593299
  misc_feature 1..96: note = hypo
  source 1..96: mol_type = genomic DNA
tgcatgcgattcctgcgagttctctggcatgagacgatgacctagtaatggggtcgcagcagggacgggaagctggccaggcgcaggctgtgctcg

SEQ ID NO: 99620 - DNA, 28 bp, Homo sapiens
  misc_feature 1..28: note = chr8:5949415-5949443
  misc_feature 1..28: note = hypo
  source 1..28: mol_type = genomic DNA
gatcggcaaactccgtcttttctatccg

SEQ ID NO: 99621 - DNA, 30 bp, Homo sapiens
  misc_feature 1..30: note = chr8:59747348-59747378
  misc_feature 1..30: note = hypo
  source 1..30: mol_type = genomic DNA
caggcctgcatccaacgtgtgtcctacacc

SEQ ID NO: 99622 - DNA, 43 bp, Homo sapiens
  misc_feature 1..43: note = chr8:59960049-59960092
  misc_feature 1..43: note = hypo
  source 1..43: mol_type = genomic DNA
tgctgggacaggcgtgagccaccgcgcccggctgaattgttct

SEQ ID NO: 99623 - DNA, 594 bp, Homo sapiens
  misc_feature 1..594: note = chr8:60030169-60030763
  misc_feature 1..594: note = hyper
  source 1..594: mol_type = genomic DNA
gggctgagaaggcagcgcactaaatatctctgtatcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgccc

SEQ ID NO: 99624 - DNA, 144 bp, Homo sapiens; identical to SEQ ID NO: 32013
  misc_feature 1..144: note = chr8:60030764-60030908
  misc_feature 1..144: note = hyper
  source 1..144: mol_type = genomic DNA

SEQ ID NO: 99625 - DNA, 645 bp, Homo sapiens
  misc_feature 1..645: note = chr8:60031146-60031791
  misc_feature 1..645: note = hyper
  source 1..645: mol_type = genomic DNA
tattatttttttaaacgccccccggcaaacctaggcagggatccttagccgcgaacagcaggaaggaaagaatccgagcaaatcgtgtcactttccgcacaatcgcggtgtttggcaagcccccggagctactccacaatatttactacccaagcgcacgcaggctgcagcgggctgcgagccgagcgcgcccgggaccggcctccgccaagccggccccgccgcggcccggccaccgccgctcccctcccaggatcaagcagcaagaacacggtggaaacaaaagcagagcgttcaccttgttgcaatagtaggggtccaggcagggagaaggtcccagacagggagcgtcgggcgcagcggcgggctgggctggaggtggataaaatcttacgtccatttcactctcacatcaagcaactccttttctttttccttttttaaaaaaaagtgttcagcaaaacaagcttagacggaacagagtgaggtgtctgggctcaggagtaaaagaaacaccttccttccctcacatccgtttgtggtttgtttaagaagaagaggaaaaaaaaaaaaaagaggggggaaaagcgctcaactctcccccaagccgcggcgcgcacccgtcggcgccgagcgcgcagcctg

SEQ ID NO: 99626 - DNA, 148 bp, Homo sapiens
  misc_feature 1..148: note = chr8:60032140-60032288
  misc_feature 1..148: note = hyper
  source 1..148: mol_type = genomic DNA
ccagaggccggggaccggagaaaggaggagcggagaaggagaaggaggagagcacggcctggctgggacagaagcggtgggaccctgggaggcctccgctgtgcccgtgccgcgctcctcgggaccagcgcgtcgcacacaaaggggc

SEQ ID NO: 99627 - DNA, 269 bp, Homo sapiens; identical to SEQ ID NO: 32016
  misc_feature 1..269: note = chr8:60032490-60032759
  misc_feature 1..269: note = hyper
  source 1..269: mol_type = genomic DNA

SEQ ID NO: 99628 - DNA, 30 bp, Homo sapiens
  misc_feature 1..30: note = chr8:60250268-60250298
  misc_feature 1..30: note = hypo
  source 1..30: mol_type = genomic DNA
tggccatctcgactccgggtgggggatggg

SEQ ID NO: 99629 - DNA, 155 bp, Homo sapiens
  misc_feature 1..155: note = chr8:60265545-60265700
  misc_feature 1..155: note = hypo
  source 1..155: mol_type = genomic DNA
actacaggcgtgagccaccgtgcctggccacaatccatttttttatgcataaatagttcattgactttttgaaggatcagcccattgtcttttagaatattttacctttgatttgtctgacagtttcctcatggttttaacgcaagcttgtccaa

SEQ ID NO: 99630 - DNA, 18 bp, Homo sapiens
  misc_feature 1..18: note = chr8:60270884-60270902
  misc_feature 1..18: note = hypo
  source 1..18: mol_type = genomic DNA
ttcttttttttgagacgg

SEQ ID NO: 99631 - DNA, 30 bp, Homo sapiens
  misc_feature 1..30: note = chr8:60506155-60506185
  misc_feature 1..30: note = hypo
  source 1..30: mol_type = genomic DNA
gatgaaatcttgggccgtcaggttccgtcc

SEQ ID NO: 99632 - DNA, 25 bp, Homo sapiens
  misc_feature 1..25: note = chr8:6063181-6063206
  misc_feature 1..25: note = hypo
  source 1..25: mol_type = genomic DNA
aaaaataagacgatgaacaaggatc

SEQ ID NO: 99633 - DNA, 30 bp, Homo sapiens
  misc_feature 1..30: note = chr8:6072853-6072883
  misc_feature 1..30: note = hypo
  source 1..30: mol_type = genomic DNA
aaaaaaaaaagtaaacgataaaaaagctaa

SEQ ID NO: 99634 - DNA, 121 bp, Homo sapiens
  misc_feature 1..121: note = chr8:6118678-6118799
  misc_feature 1..121: note = hypo
  source 1..121: mol_type = genomic DNA
gggccatatgtcctgcgccgtaaagaaaggtagacctatagtttctctgctgtctctccttgcttccccctgctcctgccagcctgacgttttccccagttagaaccgcacacgtgggatc

SEQ ID NO: 99635 - DNA, 512 bp, Homo sapiens; identical to SEQ ID NO: 32017
  misc_feature 1..512: note = chr8:61193203-61193715
  misc_feature 1..512: note = hyper
  source 1..512: mol_type = genomic DNA

SEQ ID NO: 99636 - DNA, 49 bp, Homo sapiens; identical to SEQ ID NO: 32018
  misc_feature 1..49: note = chr8:61193716-61193765
  misc_feature 1..49: note = hyper
  source 1..49: mol_type = genomic DNA

SEQ ID NO: 99637 - DNA, 42 bp, Homo sapiens
  misc_feature 1..42: note = chr8:61194083-61194125
  misc_feature 1..42: note = hyper
  source 1..42: mol_type = genomic DNA
actagtcccaagtcacggaaacctcggcgcatccccgcccgc

SEQ ID NO: 99638 - DNA, 30 bp, Homo sapiens
  misc_feature 1..30: note = chr8:61196626-61196656
  misc_feature 1..30: note = hypo
  source 1..30: mol_type = genomic DNA
ccaaagtactaaggtcgcttcccagagtcc

SEQ ID NO: 99639 - DNA, 17 bp, Homo sapiens
  misc_feature 1..17: note = chr8:61205300-61205317
  misc_feature 1..17: note = hypo
  source 1..17: mol_type = genomic DNA
gccgacactgtcctaaa

SEQ ID NO: 99640 - DNA, 30 bp, Homo sapiens; identical to SEQ ID NO: 41806
  misc_feature 1..30: note = chr8:61272270-61272300
  misc_feature 1..30: note = hypo
  source 1..30: mol_type = genomic DNA

SEQ ID NO: 99641 - DNA, 82 bp, Homo sapiens
  misc_feature 1..82: note = chr8:61288499-61288581
  misc_feature 1..82: note = hypo
  source 1..82: mol_type = genomic DNA
ctcaatccctcttaccgcttcaaaagatggagctgcactctcttttgggttttttgtttgtttgtttttcgttttttgtttt

SEQ ID NO: 99642 - DNA, 39 bp, Homo sapiens
  misc_feature 1..39: note = chr8:61325744-61325783
  misc_feature 1..39: note = hypo
  source 1..39: mol_type = genomic DNA
tccatattgaccttccgctgcactcgcagagcgttttct

SEQ ID NO: 99643 - DNA, 86 bp, Homo sapiens
  misc_feature 1..86: note = chr8:61573279-61573365
  misc_feature 1..86: note = hyper
  source 1..86: mol_type = genomic DNA
cccggtgtcagttgacgcccttctccaatcgcccaagagaagatggcttcaaaggccacaaacaatctccacggcaggacagagtg

SEQ ID NO: 99644 - DNA, 30 bp, Homo sapiens
  misc_feature 1..30: note = chr8:61627523-61627553
  misc_feature 1..30: note = hypo
  source 1..30: mol_type = genomic DNA
gagggaatattctgccggcagccacaagaa

SEQ ID NO: 99645 - DNA, 30 bp, Homo sapiens; identical to SEQ ID NO: 41807
  misc_feature 1..30: note = chr8:61777517-61777547
  misc_feature 1..30: note = hypo
  source 1..30: mol_type = genomic DNA

SEQ ID NO: 99646 - DNA, 119 bp, Homo sapiens
  misc_feature 1..119: note = chr8:61789866-61789985
  misc_feature 1..119: note = hypo
  source 1..119: mol_type = genomic DNA
ccccagatggctggtcgcaataatgacgacgaggcggatggcggcggggaggctagagcccatttcagaagcctgcagtgaggattccaccagttcacatgcatcgggcactgagccct

SEQ ID NO: 99647 - DNA, 505 bp, Homo sapiens
  misc_feature 1..505: note = chr8:61822378-61822883
  misc_feature 1..505: note = hyper
  source 1..505: mol_type = genomic DNA
ttggcgggctgggggcggcgtgcgccgagctgggcgcgagtggaggggccggcggctttgtgcgcccccgccagtgcccgcccgcagccccgccgcagcgtttaaccttgacttctccctcctcgcttctggcacgggaggaaagcctgtccagatgggcgtcctgagtgtgacgacgtcccctcccgcccccgcgctctcgcgcagatgtcgcacgctgccctgggtcccgccacaccgcccaccaaggccgcgggccctgcgcgcccggggcaggcgggcacatcccgcaccctctccgcccgcccgcccccggcgcccttcgcattcccttcttcggccctggcccctcggaccggagcgcccaggccagctcagggtgttcccgtgggggtctccggaaacaatggtgagcctgtgctctgctggctggggggcgtcgtccccgcagctggcgcgtccctccaggctgagcgcccagcgccccccgcggccctaagttggg

SEQ ID NO: 99648 - DNA, 22 bp, Homo sapiens
  misc_feature 1..22: note = chr8:62186531-62186553
  misc_feature 1..22: note = hypo
  source 1..22: mol_type = genomic DNA
tgtagaccggagctgttcctat

SEQ ID NO: 99649 - DNA, 482 bp, Homo sapiens
  misc_feature 1..482: note = chr8:62200502-62200984
  misc_feature 1..482: note = hyper
  source 1..482: mol_type = genomic DNA
agaaggacagagaatcgggcgcacacgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggtatttgttaccttttttctcccctctgtatttgccgagcctccccgcctttcccccgctctttcgatgccatggctgcggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 99650 - DNA, 30 bp, Homo sapiens
  misc_feature 1..30: note = chr8:62212751-62212781
  misc_feature 1..30: note = hypo
  source 1..30: mol_type = genomic DNA
gatcgatgggttccccggggtgctggaaaa

SEQ ID NO: 99651 - DNA, 108 bp, Homo sapiens
  misc_feature 1..108: note = chr8:62221730-62221838
  misc_feature 1..108: note = hypo
  source 1..108: mol_type = genomic DNA
ggcctattcagtcctcgatgtgagtgggaagaaagaaagtggagagggacttgttggttcagtttgaaagtgaaaggggtgctgaccaattgacgaggcttgttacgc

SEQ ID NO: 99652 - DNA, 49 bp, Homo sapiens
  misc_feature 1..49: note = chr8:63056935-63056984
  misc_feature 1..49: note = hypo
  source 1..49: mol_type = genomic DNA
aggagagacctccggcggcagggctccaacaccacgaacacaaagtcgt

SEQ ID NO: 99653 - DNA, 1811 bp, Homo sapiens
  misc_feature 1..1811: note = chr8:63160266-63162077
  misc_feature 1..1811: note = hyper
  source 1..1811: mol_type = genomic DNA
caggtacaacaaatgcgcccataaaatctgtctttgagccctgatgaaatttcatcctctgcagaacgcctccgctctgttttattaggtgggagagagcaggagagtttccacaggattcagagagagtttgtccgtatcttaactatccgagatcttctttccaaatccttctcaatttatttctgtgaagatatatttatacctattccggaaaccttctccatttctagaaaaagctacgcatcttcttcttcctcgacttctcttttctccctcccggtgaggatttcaaagggtatgtgagaaaagaaccttaagccaggtctccccgcggcgtcctggctagtcccggcgccctgggcgggtgcatcgctccgccgcagcgccccttgccacccaactctgtccaactttccctttcagactccagcaggggcgccctccaggcaaccggctgtggcgggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcctccccggaacccaagctaacccaactcccatcctcgccacctctggggcagctcaactaagccgtgtcccctcccttgcaaacgcgtccgaccaccctcccaacccccagcacaaccctcagcaagaaagcccagctgggtctacccagttacaccggtcaacgagggtctccatcgccgccggccgccctaattcacgctcattcatattcattctcttttctctctgtccctcttcctttctccccaaagactcttaactagacaggccgatcctccccagcggcactccctttcattcttcccttcccaccacacacacacacacacacacacacccggacccagacagcccactccactttccagacgcccacctcctacatactcccctcccctaaacagacattcacccactcgccatctgtagcctccttccaaccccccgccccgcccgcctggctccccctccccaagaaacagacctgcacagtgggacgcagggacccccgccagacgctcgggtcgtgcgcaccgcactgacctcggcccgccccgccgggaaactaacaaaggcgggcgcgagccccgagccctggagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgcaggagggcgcggtctcacccccggtcccatgcgctggggttcgccgcgctcccgccgggcgtcgccacgcggtccaggggccaggagccggcggagtgagggattttcccgccccttgatccgatacctggtttagcaccctccgcgttcgtgctgaagttacacggggacttgcgggctctttcttct

SEQ ID NO: 99654 - DNA, 168 bp, Homo sapiens
  misc_feature 1..168: note = chr8:636372-636540
  misc_feature 1..168: note = hypo
  source 1..168: mol_type = genomic DNA
agtaactatgttttacgaaaataaatggcaataagaacaaatgcattcttttcttttgtttcttcctaggcaagctaaaaaaaaaaaaaaaaacaaaaacaaaaaccatgtagatcccacaggtgagttatttcaaagttcatgcctgacacccggcacccacagtct

SEQ ID NO: 99655 - DNA, 233 bp, Homo sapiens
  misc_feature 1..233: note = chr8:63998335-63998568
  misc_feature 1..233: note = hyper
  source 1..233: mol_type = genomic DNA
tgaggtgcgcactgccgagcgccctgggcacgcacgcttacccgccaggccaggtccagatcgaaatcccgggcgcgcaggaaccgcagcaggaaggagtcggtgagcggcagcggcgcgagcgggacgccagcttcccgggcccggcgccgcagcgccgccaggcccggctgcagcaacggagagtggtccggtagcgcgttgagctgcggccccgccgagggctgggatcg

SEQ ID NO: 99656 - DNA, 24 bp, Homo sapiens
  misc_feature 1..24: note = chr8:64023520-64023544
  misc_feature 1..24: note = hypo
  source 1..24: mol_type = genomic DNA
caccgcgcccggccttaagtgttt

SEQ ID NO: 99657 - DNA, 30 bp, Homo sapiens
  misc_feature 1..30: note = chr8:64039936-64039966
  misc_feature 1..30: note = hypo
  source 1..30: mol_type = genomic DNA
tgtcatctgtcccttcggtcactgagatat

SEQ ID NO: 99658 - DNA, 191 bp, Homo sapiens
  misc_feature 1..191: note = chr8:64224292-64224483
  misc_feature 1..191: note = hypo
  source 1..191: mol_type = genomic DNA
tcagagcctaaacaacgaaagctggtaacttaacatctcagaaggtgcaaatggaaataccctctgcgggtagttacgcagtaacacacagattaatggagagtgggagtgtctagtgaactgcagagcacacactcagtctaaataggtaggtgttacttgtattctgccgatctcgttggtaataaatg

SEQ ID NO: 99659 - DNA, 210 bp, Homo sapiens
  misc_feature 1..210: note = chr8:6434302-6434512
  misc_feature 1..210: note = hypo
  source 1..210: mol_type = genomic DNA
aggtgatccgtccgcaggtgagccacccgcctcggcctcctaaagtgctgggagaggcacaggcgtcagccacagtgcctggcctactgtcttctctaaaatggcatctgtgcattcatctcagccgcccctgctcagataaaagcaatggcgcctcctttgaaatctgagagacgcagggccctgcccattctgcggaattccttctcc

SEQ ID NO: 99660 - DNA, 167 bp, Homo sapiens
  misc_feature 1..167: note = chr8:644635-644802
  misc_feature 1..167: note = hypo
  source 1..167: mol_type = genomic DNA
cagacaggagcaccacgaggggcctcacggcttgctcgtctgtgaatcacggtgaccatgtaacccataataccttctggttctaactttttatattcttttgggtaatgtatggtttactgtgaggacacttacgccttgcacaagttgaacgttacatgtcttga

SEQ ID NO: 99661 - DNA, 22 bp, Homo sapiens
  misc_feature 1..22: note = chr8:64511304-64511326
  misc_feature 1..22: note = hypo
  source 1..22: mol_type = genomic DNA
aatagaacgaagaaaggaggac

SEQ ID NO: 99662 - DNA, 30 bp, Homo sapiens
  misc_feature 1..30: note = chr8:64557179-64557209
  misc_feature 1..30: note = hypo
  source 1..30: mol_type = genomic DNA
ctcctggttcttcgacgctgacatttttaa

SEQ ID NO: 99663 - DNA, 47 bp, Homo sapiens
  misc_feature 1..47: note = chr8:64617631-64617678
  misc_feature 1..47: note = hypo
  source 1..47: mol_type = genomic DNA
tgtcagtctgttctccggggcgcgggtgggggcgggaggaagattag

SEQ ID NO: 99664 - DNA, 41 bp, Homo sapiens
  misc_feature 1..41: note = chr8:647337-647378
  misc_feature 1..41: note = hypo
  source 1..41: mol_type = genomic DNA
gagaagccggtgcaacgccgaccccacgagcaactgaatcg

SEQ ID NO: 99665 - DNA, 30 bp, Homo sapiens
  misc_feature 1..30: note = chr8:6526266-6526296
  misc_feature 1..30: note = hypo
  source 1..30: mol_type = genomic DNA
cccctgggccaccaacggatatgttaggaa

SEQ ID NO: 99666 - DNA, 463 bp, Homo sapiens
  misc_feature 1..463: note = chr8:65281329-65281792
  misc_feature 1..463: note = hyper
  source 1..463: mol_type = genomic DNA
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttgcatttagggaaacaccgacctccactttttcccccgacattttccctcctggcatttaaagctgttcgttttcggggaaacttctgtgagtttcgcgcttgttcgaccaacaccagtgttaggaggaggcgagaccggtggaaaaaggagagccccagagatttcccgtgtgtgtg

SEQ ID NO: 99667 - DNA, 153 bp, Homo sapiens
  misc_feature 1..153: note = chr8:65281852-65282005
  misc_feature 1..153: note = hyper
  source 1..153: mol_type = genomic DNA
ctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtc

SEQ ID NO: 99668 - DNA, 109 bp, Homo sapiens; identical to SEQ ID NO: 3277
  misc_feature 1..109: note = chr8:65282332-65282441
  misc_feature 1..109: note = hyper
  source 1..109: mol_type = genomic DNA

SEQ ID NO: 99669 - DNA, 332 bp, Homo sapiens
  misc_feature 1..332: note = chr8:65283762-65284094
  misc_feature 1..332: note = hyper
  source 1..332: mol_type = genomic DNA
tagcattgccagagtcgggggagaggggaggatgctgggtaaagtgcccacccggggtggtctaaagtcgtcaccccacagagcagattctgctgctaaccagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccgctaataaaacacc

SEQ ID NO: 99670 - skipped

SEQ ID NO: 99671 - DNA, 765 bp, Homo sapiens; identical to SEQ ID NO: 32029
  misc_feature 1..765: note = chr8:65286370-65287135
  misc_feature 1..765: note = hyper
  source 1..765: mol_type = genomic DNA

SEQ ID NO: 99672 - DNA, 1302 bp, Homo sapiens
  misc_feature 1..1302: note = chr8:65289049-65290351
  misc_feature 1..1302: note = hyper
  source 1..1302: mol_type = genomic DNA
tttagttttagacaacgtattcaaagtacttgagaagaatatgcaatgacattttttccgtgtcctaatcaggaccatggtgaggtccccgtggttcaccgagtggtggtccagggctctggttgggacgctgagttaggttggcaaagcgtcattgttttgaaaggcacattcgtccggaatggcattcgtgataagattaaacataaacctaaaccttggcctcgggggaaggcaggctgcggggttgagaagaggagatgcagattagctctgcttttgctgcttgcgcacataattaagaggcggtccctcagctggagcgtgggctgtgtccggcctaaggtgcttattttcctgttacttggccaaccgagtgtgagtgaacaggagcccgagagcttaaatgtgggatctagataaggtgtcgactgggttgtgggcgtttgtctccatgttagggagaggcaactgagaacggtgactttggcttgttttgagagagcctgggttttgacagcaggacggcgaagggagcgcttggagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctctggacgcggcagtatccgcagcgcatgcaccctcct

SEQ ID NO: 99673 - DNA, 27 bp, Homo sapiens
  misc_feature 1..27: note = chr8:65290655-65290682
  misc_feature 1..27: note = hyper
  source 1..27: mol_type = genomic DNA
tctctctcctttcctcggactctggag

SEQ ID NO: 99674 - DNA, 546 bp, Homo sapiens
  misc_feature 1..546: note = chr8:65290897-65291443
  misc_feature 1..546: note = hyper
  source 1..546: mol_type = genomic DNA
cgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaagatgacccagcccgcccttggactctcttttcccaaaatctcccaaccaaacccgcggtaacgttatcaaaggacacagagcccaggcatatctgtgtgtttatcttacaggcacacacgcatggttttctcttttatatgctagatttcatccctgacagcagaaaatgattggcaatggttatgacggagaacatgcaatagcgtggtccttaaaaacctgccattccttacaagtgccttagaaaggattcagggcgaaccaactgggttaattgcattcagtaaaataacacgattacaaaattagatctgtaccagaggggtaattaacttggatccacgccgtcatttgaaaact

SEQ ID NO: 99675 - DNA, 268 bp, Homo sapiens
  misc_feature 1..268: note = chr8:65291758-65292026
  misc_feature 1..268: note = hyper
  source 1..268: mol_type = genomic DNA
catacaattaaggcacgcggtgaatgccaagagcggagcctacggctgcacttgaaggacaccaaagcatctcagggtcagaaaggggaaaaagcaattgcagggaatttagggggtagtaaaaggaacccatctcttgccgcataaatgccccccacccccacccaggactgattctggaagcaacctagtgttcgaaagggaaaggctcctacttttccattacagccgcggaaatccgcaggcaaatctccgaggagaattttag

SEQ ID NO: 99676 - DNA, 305 bp, Homo sapiens
  misc_feature 1..305: note = chr8:65292571-65292876
  misc_feature 1..305: note = hyper
  source 1..305: mol_type = genomic DNA
ctgcaggggttgggaacaaaggagaggagctaagaggatgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 99677 - DNA, 33 bp, Homo sapiens
  misc_feature 1..33: note = chr8:65293161-65293194
  misc_feature 1..33: note = hyper
  source 1..33: mol_type = genomic DNA
gcagcttgccaccttcggccaggccttgcagcc

SEQ ID NO: 99678 - DNA, 111 bp, Homo sapiens
  misc_feature 1..111: note = chr8:65293265-65293376
  misc_feature 1..111: note = hyper
  source 1..111: mol_type = genomic DNA
cgcatcccagccggcgggaggcactggagggccaggaggcctgaaacccgcactgcggaaaaaccgacctcagccacatcctcatagctcacgcgacggaaagaggcaggg

SEQ ID NO: 99679 - DNA, 17 bp, Homo sapiens
  misc_feature 1..17: note = chr8:65385219-65385236
  misc_feature 1..17: note = hypo
  source 1..17: mol_type = genomic DNA
tccgtctcaaaaaaaaa

SEQ ID NO: 99680 - DNA, 30 bp, Homo sapiens; identical to SEQ ID NO: 41694
  misc_feature 1..30: note = chr8:6542607-6542637
  misc_feature 1..30: note = hypo
  source 1..30: mol_type = genomic DNA

SEQ ID NO: 99681 - DNA, 152 bp, Homo sapiens; identical to SEQ ID NO: 32039
  misc_feature 1..152: note = chr8:65488217-65488369
  misc_feature 1..152: note = hyper
  source 1..152: mol_type = genomic DNA

SEQ ID NO: 99682 - DNA, 361 bp, Homo sapiens
  misc_feature 1..361: note = chr8:65488704-65489065
  misc_feature 1..361: note = hyper
  source 1..361: mol_type = genomic DNA
taatctctctgcctccgagtagatcccgcgctcccaaatccggcgggggcgcagtatggtgaaccccacacctagctccctcagctgcgtgggtttcaagctgacccaggcgccaccaggcagccccgagtgggcgagtcaagtgcaacttcaaggtcaatgtgcctctgactggggcctggagagctgccaagaatgctgggcttggagcgctggggtcgcgccccgctactgcgccttggaccccgcagtggagggcgctgagaccgcacccccctccccgggcagttttcaggagagggtccagctggggtctccgcggtggggtccagaaacgatattccgggttggattcttcctc

SEQ ID NO: 99683 - DNA, 63 bp, Homo sapiens; identical to SEQ ID NO: 32042
  misc_feature 1..63: note = chr8:65489066-65489129
  misc_feature 1..63: note = hyper
  source 1..63: mol_type = genomic DNA

SEQ ID NO: 99684 - DNA, 115 bp, Homo sapiens
  misc_feature 1..115: note = chr8:65489468-65489583
  misc_feature 1..115: note = hyper
  source 1..115: mol_type = genomic DNA
gcactaatttcaatgcggtgctgtctgctgaatattttaaactcctttcaaagcagtaggtgtattccctcccgcagtaacaaaacgatattcatctttacacaaggtgctctgg

SEQ ID NO: 99685 - DNA, 317 bp, Homo sapiens
  misc_feature 1..317: note = chr8:65489865-65490182
  misc_feature 1..317: note = hyper
  source 1..317: mol_type = genomic DNA
agttttcattctaagcggtcatctgtgagtcagaagatttcgccgtggcctgatttcccaccctttctgcccgcgcaagccgaaagcgctcatgttggcttttcctttgccacttttccaacttgccagttccatcaggagcccggatccttgcccagcttcttggcggagccaagttcgagcgcacagatttcccgagctccagcggccagggggcactgtgtgagcggctgacgtcacccctccgcccggccgaaaccaggcggcgggatcccacacagttgaggagagggagccgaggccgtgacttagggctg

SEQ ID NO: 99686 - DNA, 30 bp, Homo sapiens; identical to SEQ ID NO: 32043
  misc_feature 1..30: note = chr8:65490463-65490493
  misc_feature 1..30: note = hyper
  source 1..30: mol_type = genomic DNA

SEQ ID NO: 99687 - DNA, 30 bp, Homo sapiens
  misc_feature 1..30: note = chr8:65492377-65492407
  misc_feature 1..30: note = hyper
  source 1..30: mol_type = genomic DNA
agaccagtcatcctacgaacaggggtggag

SEQ ID NO: 99688 - DNA, 912 bp, Homo sapiens
  misc_feature 1..912: note = chr8:65492667-65493579
  misc_feature 1..912: note = hyper
  source 1..912: mol_type = genomic DNA
ccttgcaaacatatgcgctaagctgtgtatacagatggcaggcagaataatggagcaggcgccttttataaagctctagctgctgcctgtcttcagacctgggaaatgaaactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 99689 - DNA, 149 bp, Homo sapiens; identical to SEQ ID NO: 3283
  misc_feature 1..149: note = chr8:65493806-65493955
  misc_feature 1..149: note = hyper
  source 1..149: mol_type = genomic DNA

SEQ ID NO: 99690 - DNA, 25 bp, Homo sapiens
  misc_feature 1..25: note = chr8:65494076-65494101
  misc_feature 1..25: note = hyper
  source 1..25: mol_type = genomic DNA
cggcttaacatcaatgcccgagagc

SEQ ID NO: 99691 - DNA, 209 bp, Homo sapiens
  misc_feature 1..209: note = chr8:65494102-65494311
  misc_feature 1..209: note = hyper
  source 1..209: mol_type = genomic DNA
ccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgc

SEQ ID NO: 99692 - DNA, 85 bp, Homo sapiens
  misc_feature 1..85: note = chr8:65498465-65498550
  misc_feature 1..85: note = hyper
  source 1..85: mol_type = genomic DNA
gaagggttagctttgcgtgtacgactgcaggaccagcaaatgatcatcttcgatagagctctctagttacccgtgcttctccctc

SEQ ID NO: 99693 - DNA, 204 bp, Homo sapiens
  misc_feature 1..204: note = chr8:65498610-65498814
  misc_feature 1..204: note = hyper
  source 1..204: mol_type = genomic DNA
gcgcacccgcacgcagtctgcaatgccctcaccagtccccgcagctgggcaacccctccaagaccctgtgttacgcttaaattcctctccctcctatcgtacccaccatccatccttacagcagggaggccgagactcacagaattcccttctccaccaactcgcactcttggtctagcacgcggaaaccgaacctttctacgc

SEQ ID NO: 99694 - DNA, 45 bp, Homo sapiens
  misc_feature 1..45: note = chr8:65499022-65499067
  misc_feature 1..45: note = hyper
  source 1..45: mol_type = genomic DNA
gttcacttcccggctcgcagcacatcgtggcggccctgccgggag

SEQ ID NO: 99695 - DNA, 357 bp, Homo sapiens
  misc_feature 1..357: note = chr8:65499733-65500090
  misc_feature 1..357: note = hyper
  source 1..357: mol_type = genomic DNA
aaacacaccaaatgacgtccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttcaaccgccaagctccttgggacaaaaagagaacttcaggggctctgcctcaaactgtccttcgagggtggctcgaggatcgggttgtcccctgtatggcagcaggcatgtgggttcacacgcagctgccaggcttgtaagaggcaccccgcagccgcaccaaacccgaa

SEQ ID NO: 99696 - DNA, 50 bp, Homo sapiens
  misc_feature 1..50: note = chr8:65519445-65519495
  misc_feature 1..50: note = hypo
  source 1..50: mol_type = genomic DNA
ccaccagccccagtacgaatgcaggcagagctatacgttgagaagaatga

SEQ ID NO: 99697 - DNA, 30 bp, Homo sapiens
  misc_feature 1..30: note = chr8:65615338-65615368
  misc_feature 1..30: note = hypo
  source 1..30: mol_type = genomic DNA
gtacggcaataatatcgggcatgcagaacc

SEQ ID NO: 99698 - DNA, 134 bp, Homo sapiens
  misc_feature 1..134: note = chr8:65710950-65711084
  misc_feature 1..134: note = hyper
  source 1..134: mol_type = genomic DNA
cctcgccatctgggtcgcgcgcggcccgcggggcccagggcgcatgcgtggcctggcggccgaggcgcttacctggtgcgccggacaagcaagcagagggccaggagcagcagggccgcggcgagggccaggcc

SEQ ID NO: 99699 - DNA, 148 bp, Homo sapiens
  misc_feature 1..148: note = chr8:65711221-65711369
  misc_feature 1..148: note = hyper
  source 1..148: mol_type = genomic DNA
cggcttctctcggcggcgccccctagtccagggccggagaggctggcctgcccgcagcgcagacaggaatgtcaccgtggtctcccaggctgaatgacaaaagttcgtggactgccccctccccgcctatcctccacccacgcgtacc

SEQ ID NO: 99700 - DNA, 13 bp, Homo sapiens
  misc_feature 1..13: note = chr8:65711370-65711383
  misc_feature 1..13: note = hyper
  source 1..13: mol_type = genomic DNA
ccccgttccccca

SEQ ID NO: 99701 - DNA, 30 bp, Homo sapiens
  misc_feature 1..30: note = chr8:65738006-65738036
  misc_feature 1..30: note = hypo
  source 1..30: mol_type = genomic DNA
acagttatgctttaacgttttttcttctgt

SEQ ID NO: 99702 - DNA, 90 bp, Homo sapiens; identical to SEQ ID NO: 15127
  misc_feature 1..90: note = chr8:65749819-65749909
  misc_feature 1..90: note = hypo
  source 1..90: mol_type = genomic DNA

SEQ ID NO: 99703 - DNA, 33 bp, Homo sapiens; identical to SEQ ID NO: 41815
  misc_feature 1..33: note = chr8:66055590-66055623
  misc_feature 1..33: note = hypo
  source 1..33: mol_type = genomic DNA

SEQ ID NO: 99704 - DNA, 24 bp, Homo sapiens
  misc_feature 1..24: note = chr8:66216965-66216989
  misc_feature 1..24: note = hypo
  source 1..24: mol_type = genomic DNA
gcgagactccgtctcaaaaacata

SEQ ID NO: 99705 - DNA, 30 bp, Homo sapiens
  misc_feature 1..30: note = chr8:6637553-6637583
  misc_feature 1..30: note = hypo
  source 1..30: mol_type = genomic DNA
agacttcaccactatcgaagatatccctgt

SEQ ID NO: 99706 - DNA, 29 bp, Homo sapiens
  misc_feature 1..29: note = chr8:66500568-66500597
  misc_feature 1..29: note = hypo
  source 1..29: mol_type = genomic DNA
caacaggaaacctcacgctattttctttt

SEQ ID NO: 99707 - DNA, 23 bp, Homo sapiens
  misc_feature 1..23: note = chr8:66545046-66545069
  misc_feature 1..23: note = hypo
  source 1..23: mol_type = genomic DNA
cgatactccgtctcaaaaaaaaa

SEQ ID NO: 99708 - DNA, 32 bp, Homo sapiens
  misc_feature 1..32: note = chr8:66548717-66548749
  misc_feature 1..32: note = hypo
  source 1..32: mol_type = genomic DNA
atgtctaaacttggccgggcgtggtggctcaa

SEQ ID NO: 99709 - DNA, 92 bp, Homo sapiens
  misc_feature 1..92: note = chr8:66560181-66560273
  misc_feature 1..92: note = hypo
  source 1..92: mol_type = genomic DNA
taaaatgcctactgacgtactatgcctatttttccattgggcttttgatcatttgtttgtttgtttgtttgtttgtttgttttgagatggag

SEQ ID NO: 99710 - DNA, 79 bp, Homo sapiens
  misc_feature 1..79: note = chr8:6663499-6663578
  misc_feature 1..79: note = hypo
  source 1..79: mol_type = genomic DNA
agctgccgcagcagacggaggatcagtgctctgaggggaaatgccattgtgaagctgtgggtgacggccacctcctgag

SEQ ID NO: 99711 - DNA, 411 bp, Homo sapiens
  misc_feature 1..411: note = chr8:6692051-6692462
  misc_feature 1..411: note = hyper
  source 1..411: mol_type = genomic DNA
ccttccagtccggggcgcggagccagggcgcttgcgcgtcctccgtgtgcgtcctgctcggcgcgcctcggaagcagcgggacctgcggggacgcccgcgaactcagggaaaagtcccaaggcggcgttcccagggtaccccctcttccaccccagggactctgcccgggaaaaagcttccgcagggagcccggcggaagtgggcggagacgctcctcccggcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagccctgtcccc

SEQ ID NO: 99712 - DNA, 484 bp, Homo sapiens
  misc_feature 1..484: note = chr8:6692686-6693170
  misc_feature 1..484: note = hyper
  source 1..484: mol_type = genomic DNA
aagtcaagcaccagtcgggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggccagcag

SEQ ID NO: 99713 - DNA, 380 bp, Homo sapiens
  misc_feature 1..380: note = chr8:67024905-67025285
  misc_feature 1..380: note = hyper
  source 1..380: mol_type = genomic DNA
atgtcttagtagatgcggtggaaccagctctgtctacagaaccccgggcttcagtggcgtcttcctaacccggcttgcctgccgggggcgttccgagaccctcggggccttcccttcaccccgcgggagttggaccggtggcgctggtaaggcctcccgggctcaaagtgcaacggacactgcagaaatccaaactgctggcattcgcggtttggggacgccagaggaggtaatgatttctggtttgttaacctcaagtgacaataatgccgagccaggcaggagctggacctacaatcttctgatgcgtggtcagacacgttatcccttgcgccactggcctaccacgctactccttcagtcgccgttggattactgtg

SEQ ID NO: 99714 - DNA, 23 bp, Homo sapiens
  misc_feature 1..23: note = chr8:67028548-67028571
  misc_feature 1..23: note = hypo
  source 1..23: mol_type = genomic DNA
agactagaaacaggtcggcatgg

SEQ ID NO: 99715 - DNA, 615 bp, Homo sapiens
  misc_feature 1..615: note = chr8:67089421-67090036
  misc_feature 1..615: note = hyper
  source 1..615: mol_type = genomic DNA
gcctccggcgaggagcgaggaggcgggcgaaaggggagcggccgggctcttgttgaggttccccaggcggaggaagtactcctctcccatgcggagcaggaccggccgagcctgcggctgctggggctgctcggactgcggcggcggctggaagaaatccaagggctgagggtgctgcggcgcctgccgagctcccgggaccggcccgcggctcaggagcgccctgcatggcgggcagggcaggagagccaccagcaggactcccgcggacacaagcagcggcagccgcatgttaggggcactcgctgcggcacagaggtgggcggagggcggaatgagagaggggaagagagaaagaaagagttggttagagttcgctcagctgggaggtgcacacggggtcttcctacgggactgccttagacgtgctgggctttggcctcagtgattcggatgggcgctgtccgcggtgctgaagcgcctggggagcggggaaagggggcgcctgcagggctccgcacctaagctcatgcgctcaccggccaggagtgacccttctttctagactctgaaaggacggtccctgcgtcctcttcctaacgatcctcaaaacta

SEQ ID NO: 99716 - DNA, 201 bp, Homo sapiens
  misc_feature 1..201: note = chr8:67117726-67117927
  misc_feature 1..201: note = hypo
  source 1..201: mol_type = genomic DNA
aaaggaagcttccaacggcagatggttcacctggagaaggttcactactctagccgtgacaaattctctcttcacattgggcacgctgtatcaattatcttgtcaactgttatattgtctatcgtgtcatcaatgggtatttccttcttttggctgtagatttgtgggggataagatgaagacttccgtgcattaagaacc

SEQ ID NO: 99717 - DNA, 156 bp, Homo sapiens; identical to SEQ ID NO: 32053
  misc_feature 1..156: note = chr8:67344509-67344665
  misc_feature 1..156: note = hyper
  source 1..156: mol_type = genomic DNA

SEQ ID NO: 99718 - DNA, 36 bp, Homo sapiens
  misc_feature 1..36: note = chr8:67344666-67344702
  misc_feature 1..36: note = hyper
  source 1..36: mol_type = genomic DNA
aggggcgggaggcgggcagcctccgtgattggccgg

SEQ ID NO: 99719 - DNA, 61 bp, Homo sapiens
  misc_feature 1..61: note = chr8:67344809-67344870
  misc_feature 1..61: note = hyper
  source 1..61: mol_type = genomic DNA
cgtgagtgcggggccggcgggcgggcaggggaccgcagggtgcccacgcagccccctgggt

SEQ ID NO: 99720 - DNA, 30 bp, Homo sapiens
  misc_feature 1..30: note = chr8:67345235-67345265
  misc_feature 1..30: note = hyper
  source 1..30: mol_type = genomic DNA
aatgggatgaggggacgaggctaaaaccgg

SEQ ID NO: 99721 - DNA, 30 bp, Homo sapiens
  misc_feature 1..30: note = chr8:67371236-67371266
  misc_feature 1..30: note = hypo
  source 1..30: mol_type = genomic DNA
tctcccagccagccccgtatctggttctat

SEQ ID NO: 99722 - DNA, 24 bp, Homo sapiens
  misc_feature 1..24: note = chr8:67580710-67580734
  misc_feature 1..24: note = hypo
  source 1..24: mol_type = genomic DNA
gggcgcggtggctcacgcctgtag

SEQ ID NO: 99723 - DNA, 23 bp, Homo sapiens
  misc_feature 1..23: note = chr8:67580974-67580997
  misc_feature 1..23: note = hypo
  source 1..23: mol_type = genomic DNA
caagactccgtctcaaaaaaaaa

SEQ ID NO: 99724 - DNA, 30 bp, Homo sapiens
  misc_feature 1..30: note = chr8:67638459-67638489
  misc_feature 1..30: note = hypo
  source 1..30: mol_type = genomic DNA
aaatactcataataacgctgtgggatgggt

SEQ ID NO: 99725 - DNA, 21 bp, Homo sapiens
  misc_feature 1..21: note = chr8:6774704-6774725
  misc_feature 1..21: note = hypo
  source 1..21: mol_type = genomic DNA
ttcattttggctgggcgcggt

SEQ ID NO: 99726 - DNA, 95 bp, Homo sapiens; identical to SEQ ID NO: 795
  misc_feature 1..95: note = chr8:67873327-67873422
  misc_feature 1..95: note = hyper
  source 1..95: mol_type = genomic DNA

SEQ ID NO: 99727 - skipped

SEQ ID NO: 99728 - DNA, 251 bp, Homo sapiens; identical to SEQ ID NO: 797
  misc_feature 1..251: note = chr8:67873800-67874051
  misc_feature 1..251: note = hyper
  source 1..251: mol_type = genomic DNA

SEQ ID NO: 99729 - DNA, 509 bp, Homo sapiens; identical to SEQ ID NO: 798
  misc_feature 1..509: note = chr8:67874164-67874673
  misc_feature 1..509: note = hyper
  source 1..509: mol_type = genomic DNA

SEQ ID NO: 99730 - DNA, 103 bp, Homo sapiens; identical to SEQ ID NO: 799
  misc_feature 1..103: note = chr8:67874755-67874858
  misc_feature 1..103: note = hyper
  source 1..103: mol_type = genomic DNA

SEQ ID NO: 99731 - DNA, 402 bp, Homo sapiens; identical to SEQ ID NO: 800
  misc_feature 1..402: note = chr8:67874859-67875261
  misc_feature 1..402: note = hyper
  source 1..402: mol_type = genomic DNA

SEQ ID NO: 99732 - DNA, 179 bp, Homo sapiens; identical to SEQ ID NO: 801
  misc_feature 1..179: note = chr8:67875262-67875441
  misc_feature 1..179: note = hyper
  source 1..179: mol_type = genomic DNA

SEQ ID NO: 99733 - DNA, 255 bp, Homo sapiens; identical to SEQ ID NO: 32062
  misc_feature 1..255: note = chr8:67875442-67875697
  misc_feature 1..255: note = hyper
  source 1..255: mol_type = genomic DNA

SEQ ID NO: 99734 - DNA, 386 bp, Homo sapiens
  misc_feature 1..386: note = chr8:67940624-67941010
  misc_feature 1..386: note = hyper
  source 1..386: mol_type = genomic DNA
ttttaacaaatgtcccggaaagtcttactggcaggcaagtttgagaaacatggttctagggtttcctcggtccccacgcttattccccgcgggcagctcaccgctcgcgggacagtccggtagctaactccagtttggtcggtttcatcggcgccgggtccctacgcagaccagcggcggttgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 99735 - DNA, 30 bp, Homo sapiens
  misc_feature 1..30: note = chr8:68107540-68107570
  misc_feature 1..30: note = hypo
  source 1..30: mol_type = genomic DNA
actacaagagacctgcgcttatgtctcctg

SEQ ID NO: 99736 - DNA, 105 bp, Homo sapiens
  misc_feature 1..105: note = chr8:68347722-68347827
  misc_feature 1..105: note = hypo
  source 1..105: mol_type = genomic DNA
gtgatggggaggagacggcaggtgcggggaggctccggccttccttggtgccccgccctttgtttgcactattggacttaggagtgccgagggtggggagatgga

SEQ ID NO: 99737 - DNA, 171 bp, Homo sapiens; identical to SEQ ID NO: 31737
  misc_feature 1..171: note = chr8:686714-686885
  misc_feature 1..171: note = hyper
  source 1..171: mol_type = genomic DNA

SEQ ID NO: 99738 - DNA, 56 bp, Homo sapiens; identical to SEQ ID NO: 3192
  misc_feature 1..56: note = chr8:687162-687218
  misc_feature 1..56: note = hyper
  source 1..56: mol_type = genomic DNA

SEQ ID NO: 99739 - DNA, 129 bp, Homo sapiens; identical to SEQ ID NO: 3193
  misc_feature 1..129: note = chr8:687513-687642
  misc_feature 1..129: note = hyper
  source 1..129: mol_type = genomic DNA

SEQ ID NO: 99740 - DNA, 29 bp, Homo sapiens
  misc_feature 1..29: note = chr8:68780039-68780068
  misc_feature 1..29: note = hypo
  source 1..29: mol_type = genomic DNA
gtattcataaggatacgattttttttttt

SEQ ID NO: 99741 - DNA, 139 bp, Homo sapiens; identical to SEQ ID NO: 3194
  misc_feature 1..139: note = chr8:687837-687976
  misc_feature 1..139: note = hyper
  source 1..139: mol_type = genomic DNA

SEQ ID NO: 99742 - DNA, 242 bp, Homo sapiens
  misc_feature 1..242: note = chr8:688498-688740
  misc_feature 1..242: note = hyper
  source 1..242: mol_type = genomic DNA
cgaggcgctacccagcgcagggttttgtaactaagcctcccccggcagcggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcag

SEQ ID NO: 99743 - DNA, 76 bp, Homo sapiens
  misc_feature 1..76: note = chr8:68864043-68864119
  misc_feature 1..76: note = hyper
  source 1..76: mol_type = genomic DNA
cttaggagtaaccctcgagctgcgccttggagtgtgtgtccctgggattgggaacctcctgtgagttccatatcaa

SEQ ID NO: 99744 - DNA, 16 bp, Homo sapiens
  misc_feature 1..16: note = chr8:68864179-68864195
  misc_feature 1..16: note = hyper
  source 1..16: mol_type = genomic DNA
gcgtgtgtgtgattag

SEQ ID NO: 99745 - DNA, 351 bp, Homo sapiens
  misc_feature 1..351: note = chr8:68864545-68864896
  misc_feature 1..351: note = hyper
  source 1..351: mol_type = genomic DNA
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggc

SEQ ID NO: 99746 - DNA, 126 bp, Homo sapiens
  misc_feature 1..126: note = chr8:68865314-68865440
  misc_feature 1..126: note = hyper
  source 1..126: mol_type = genomic DNA
gtacagagagagcagcggggtgatgatctctagcagctgttggatattaaagccacatgtggcgctcaccctgtcctagtcttacaattccctcccccccgccccccgccccggcttaaatctgtc

SEQ ID NO: 99747 - DNA, 111 bp, Homo sapiens
  misc_feature 1..111: note = chr8:689295-689406
  misc_feature 1..111: note = hyper
  source 1..111: mol_type = genomic DNA
ggtcccagagcctggcggagcccgacaatccgccctgtcaggaggaatctcatcaacagcccgtgaattaattgtccttgcagttgggaaataacccggtacctcggcgta

SEQ ID NO: 99748 - DNA, 208 bp, Homo sapiens
  misc_feature 1..208: note = chr8:69242803-69243011
  misc_feature 1..208: note = hyper
  source 1..208: mol_type = genomic DNA
aaggggcggtggggacgatcccctttcgaactgcatttgtagctgccaaggagtagccaacaagcaccagatttatgtgcactttgaaagaagcaccttcaccattggctttttaagcggcgctgtcgctagggagcggctggtagggcgagcagcctcggggagcagcccgggctgtttgttccgtcaccggggaaaggaggtacac

SEQ ID NO: 99749 - DNA, 202 bp, Homo sapiens; identical to SEQ ID NO: 3297
  misc_feature 1..202: note = chr8:69243284-69243486
  misc_feature 1..202: note = hyper
  source 1..202: mol_type = genomic DNA

SEQ ID NO: 99750 - DNA, 416 bp, Homo sapiens
  misc_feature 1..416: note = chr8:69243487-69243903
  misc_feature 1..416: note = hyper
  source 1..416: mol_type = genomic DNA
cggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcctcagcctggcaggggaagttttggccctctgactgtcctgcacctctcagctacatgttcaggacccgggcaggctgaggcaggcga

SEQ ID NO: 99751 - skipped

SEQ ID NO: 99752 - DNA, 479 bp, Homo sapiens
  misc_feature 1..479: note = chr8:69244031-69244510
  misc_feature 1..479: note = hyper
  source 1..479: mol_type = genomic DNA
ttttttttttttttttaatgagggcggtaatagaacccgaaaaggtggaggaggtgcttagcagttaatacaattaactggaagacagctgaactggtgaggagtaggcttcagtcggtgcgggcgtgatgaatgaaattggcaaactgagagactgccatttggtcactggacgaaaggagagtcctttgcactgcagaccccacatgtgttagcaggagaaagggacggagaaaggttctgaaaagcacacacgtatttgtggaagaagactatagctctgagctggttttgtttttttttctctctctcgccattaaagaatttaagacaaaaatacagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgc

SEQ ID NO: 99753 - DNA, 268 bp, Homo sapiens
  misc_feature 1..268: note = chr8:69244511-69244779
  misc_feature 1..268: note = hyper
  source 1..268: mol_type = genomic DNA
gagggactcccttggtcccatccagttcagggggcactgaccggcggcgagagttcgcgggagggtcgaggtgctcccgccttgcccccgccttgcccccgccttgcccccgccccccacgtctcccagaagcagttgtagctgttcttaacagcttggtttggggtgagggcttggtatggggaggaggttacgtgtcagtgtctgagagaggcagaatcgcggcaagtggaaggggctgcactggagatcgcggaaaacctagcaa

SEQ ID NO: 99754 - DNA, 87 bp, Homo sapiens
  misc_feature 1..87: note = chr8:6932550-6932637
  misc_feature 1..87: note = hypo
  source 1..87: mol_type = genomic DNA
gttgtacaccacctgcgatatttggagtcatatgattctttgcccacctggatattaggaaaaacatcacggcgcgggggtcgtgga

SEQ ID NO: 99755 - DNA, 151 bp, Homo sapiens
  misc_feature 1..151: note = chr8:6940557-6940708
  misc_feature 1..151: note = hypo
  source 1..151: mol_type = genomic DNA
tgagggggaggctcacggagcgtcggtggaaggcgcacagaatggtaaagctttactaaggcctctcggaaggggaggcagcgggactccccgcggggcccgacctcctggaccgcactgatctgaacagggcgcacttcgacccggaagt

SEQ ID NO: 99756 - DNA, 30 bp, Homo sapiens; identical to SEQ ID NO: 41650
  misc_feature 1..30: note = chr8:700159-700189
  misc_feature 1..30: note = hypo
  source 1..30: mol_type = genomic DNA

SEQ ID NO: 99757 - DNA, 414 bp, Homo sapiens
  misc_feature 1..414: note = chr8:70404780-70405194
  misc_feature 1..414: note = hyper
  source 1..414: mol_type = genomic DNA
gggtgctcagggagccggaaccacatgcctggaaaccctgagcccctgcccgccgccgtccaagccggccggctgcagcgcagtttgtttgccgaggtttgcatgcacatattcagttgcccttttttttcccccagtcctttcagccgtgtcccgaaattcacccttagtgtaacttctgcctctgctcctcctcttcttggaactgccttttgtttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggcc

SEQ ID NO: 99758 - DNA, 143 bp, Homo sapiens
  misc_feature 1..143: note = chr8:70412954-70413097
  misc_feature 1..143: note = hypo
  source 1..143: mol_type = genomic DNA
agaagcacagtgaagcgagtgatctagaggcctaatgggtgaggtgggccacattgcagagggtggcataaaactagcggcggcggagtttcactgctgtttggagtggaaagaggggtgatgagagtcgtgtgggaggaaag

SEQ ID NO: 99759 - DNA, 30 bp, Homo sapiens
  misc_feature 1..30: note = chr8:70571296-70571326
  misc_feature 1..30: note = hypo
  source 1..30: mol_type = genomic DNA
aggctgcagcccattcgcaggcacccgaaa

SEQ ID NO: 99760 - DNA, 521 bp, Homo sapiens
  misc_feature 1..521: note = chr8:70744803-70745324
  misc_feature 1..521: note = hyper
  source 1..521: mol_type = genomic DNA
agacctgagggtctccggctcgcacctctcttggacagcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgccgccgccgctgggcccgcggccaggagcgagtgcaccctgcgccgggggtgggggggcacttagcgctgctgtccgtac

SEQ ID NO: 99761 - DNA, 57 bp, Homo sapiens
  misc_feature 1..57: note = chr8:70785966-70786023
  misc_feature 1..57: note = hypo
  source 1..57: mol_type = genomic DNA
aacgctaacctcctccgctaccaggagaaaaattagattagacgcaatttaaacact

SEQ ID NO: 99762 - DNA, 23 bp, Homo sapiens
  misc_feature 1..23: note = chr8:70842992-70843015
  misc_feature 1..23: note = hypo
  source 1..23: mol_type = genomic DNA
aatactactcttggccgggcgca

SEQ ID NO: 99763 - DNA, 80 bp, Homo sapiens
  misc_feature 1..80: note = chr8:70847246-70847326
  misc_feature 1..80: note = hypo
  source 1..80: mol_type = genomic DNA
agagtccaactacaccgaggccagcatgctggtggtaggaagccaggctacatggaaaagccacaggtaggggcttcaga

SEQ ID NO: 99764 - DNA, 184 bp, Homo sapiens
  misc_feature 1..184: note = chr8:70945287-70945471
  misc_feature 1..184: note = hyper
  source 1..184: mol_type = genomic DNA
ggtcccactcatctgcgccaggtggaggggaaggggaggaggtctaaaggtgtggagtaagggagggagaggagaaaggaggaagggagagactgggcacttcaagggtcagaggaggaccacctgtggtcacagccatcgtcacgaccccctgccgcgcccacgcacgcgtggatggggccag

SEQ ID NO: 99765 - DNA, 229 bp, Homo sapiens; identical to SEQ ID NO: 32075
  misc_feature 1..229: note = chr8:70946686-70946915
  misc_feature 1..229: note = hyper
  source 1..229: mol_type = genomic DNA

SEQ ID NO: 99766 - DNA, 568 bp, Homo sapiens; identical to SEQ ID NO: 3300
  misc_feature 1..568: note = chr8:70947090-70947658
  misc_feature 1..568: note = hyper
  source 1..568: mol_type = genomic DNA

SEQ ID NO: 99767 - DNA, 166 bp, Homo sapiens; identical to SEQ ID NO: 32077
  misc_feature 1..166: note = chr8:70981714-70981880
  misc_feature 1..166: note = hyper
  source 1..166: mol_type = genomic DNA

SEQ ID NO: 99768 - DNA, 23 bp, Homo sapiens
  misc_feature 1..23: note = chr8:70982262-70982285
  misc_feature 1..23: note = hyper
  source 1..23: mol_type = genomic DNA
cgctcccacaattaagacaaaac

SEQ ID NO: 99769 - DNA, 281 bp, Homo sapiens; identical to SEQ ID NO: 804
  misc_feature 1..281: note = chr8:70982286-70982567
  misc_feature 1..281: note = hyper
  source 1..281: mol_type = genomic DNA

SEQ ID NO: 99770 - DNA, 1020 bp, Homo sapiens; identical to SEQ ID NO: 32080
  misc_feature 1..1020: note = chr8:70982850-70983870
  misc_feature 1..1020: note = hyper
  source 1..1020: mol_type = genomic DNA

SEQ ID NO: 99771 - DNA, 277 bp, Homo sapiens; identical to SEQ ID NO: 807
  misc_feature 1..277: note = chr8:70984016-70984293
  misc_feature 1..277: note = hyper
  source 1..277: mol_type = genomic DNA

SEQ ID NO: 99772 - DNA, 319 bp, Homo sapiens; identical to SEQ ID NO: 808
  misc_feature 1..319: note = chr8:70984343-70984662
  misc_feature 1..319: note = hyper
  source 1..319: mol_type = genomic DNA

SEQ ID NO: 99773 - DNA, 250 bp, Homo sapiens; identical to SEQ ID NO: 809
  misc_feature 1..250: note = chr8:70984744-70984994
  misc_feature 1..250: note = hyper
  source 1..250: mol_type = genomic DNA

SEQ ID NO: 99774 - DNA, 240 bp, Homo sapiens
  misc_feature 1..240: note = chr8:71017239-71017479
  misc_feature 1..240: note = hypo
  source 1..240: mol_type = genomic DNA
cttaatcacgcatccagaggtgctggctggctcctgagccgggagacatctgtgggaaacttcgcttgcttcttgacgttactcactgcttgccattcagctttccaggggctacaaaatgagtcaccacccttttatcagctttcaacttacattttgttgctgttgtttcatctcctattatccttgtccttgtgggtttatgcctttataaaaaggcatttgggccaggcgcggtgg

SEQ ID NO: 99775 - DNA, 45 bp, Homo sapiens
  misc_feature 1..45: note = chr8:71115137-71115182
  misc_feature 1..45: note = hypo
  source 1..45: mol_type = genomic DNA
gttgcaagggctgggcgcggtagcttatgcctataatcccaggac

SEQ ID NO: 99776 - DNA, 30 bp, Homo sapiens
  misc_feature 1..30: note = chr8:71240462-71240492
  misc_feature 1..30: note = hypo
  source 1..30: mol_type = genomic DNA
gattatgtaaaccatcgaatgaatacaatt

SEQ ID NO: 99777 - DNA, 213 bp, Homo sapiens; identical to SEQ ID NO: 41821
  misc_feature 1..213: note = chr8:71368455-71368668
  misc_feature 1..213: note = hypo
  source 1..213: mol_type = genomic DNA

SEQ ID NO: 99778 - DNA, 37 bp, Homo sapiens
  misc_feature 1..37: note = chr8:71448087-71448124
  misc_feature 1..37: note = hypo
  source 1..37: mol_type = genomic DNA
gcgcgggtggggcatcgctggccggaggtcccggttt

SEQ ID NO: 99779 - DNA, 30 bp, Homo sapiens
  misc_feature 1..30: note = chr8:71522730-71522760
  misc_feature 1..30: note = hypo
  source 1..30: mol_type = genomic DNA
tacacatgacctcttcgaaagcttcactga

SEQ ID NO: 99780 - DNA, 30 bp, Homo sapiens
  misc_feature 1..30: note = chr8:71582179-71582209
  misc_feature 1..30: note = hypo
  source 1..30: mol_type = genomic DNA
cgtgagctaccacgccgggccagcctgttc

SEQ ID NO: 99781 - DNA, 402 bp, Homo sapiens
  misc_feature 1..402: note = chr8:72273868-72274270
  misc_feature 1..402: note = hyper
  source 1..402: mol_type = genomic DNA
agcttgtacttacagcgcttacatctgctgcatccaccagtttaatgtgttccttcgaattttctgggttagcaaacctccattcctgacatagttttgctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaagaaacccgccacagtggacggcaacaggaaggcttaaagtcggaagtggcactggagagtttctacctcgccccaaactcggagccatcagctcccaccgttctgtttggtaacagctttgcgcccagcgctcctt

SEQ ID NO: 99782 - DNA, 103 bp, Homo sapiens; identical to SEQ ID NO: 32085
  misc_feature 1..103: note = chr8:72460433-72460536
  misc_feature 1..103: note = hyper
  source 1..103: mol_type = genomic DNA

SEQ ID NO: 99783 - DNA, 30 bp, Homo sapiens
  misc_feature 1..30: note = chr8:72466268-72466298
  misc_feature 1..30: note = hyper
  source 1..30: mol_type = genomic DNA
ctgtgctgttggaagcggattgccagtgag

SEQ ID NO: 99784 - DNA, 1020 bp, Homo sapiens
  misc_feature 1..1020: note = chr8:72468554-72469574
  misc_feature 1..1020: note = hyper
  source 1..1020: mol_type = genomic DNA
ggcctgcgggtggagcgggcgcctaagctgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctgcggagagggtgcagggatgctgctgccctgacgaggggcctcccggggactagcgaaacgtttcgcctcgccggtgccgggggagagcgcatggtgacaccagggcagagtagccatggcggtcctctccctctttctggcactccactgtcagcgtcggctagaagcaaacgcccaggaagcactaaccgatgcacacaaggtttcgatggacagggacaggaaaatcggctctgcagcgcgggggagcgcaggctggaggccgggccactgaggtggccccggctgagcgactggcgtcggtttctcctcctagcgctaggcgggagtgggaccccgggccacagcaagagtcgccgggtgaggacgggcccggcccgtggcgcctagctgtaaagggccctaatgctgcgcgtttgtcgcaaagggaggcct

SEQ ID NO: 99785 - DNA, 499 bp, Homo sapiens
  misc_feature 1..499: note = chr8:72470336-72470835
  misc_feature 1..499: note = hyper
  source 1..499: mol_type = genomic DNA
ccttactatcaaaaacggccgcgggcagaaaattacgataagtaaagcatagtctcttctcgcctttatggacatccccgcattttttggcggtcttagcctcggccaagtgcaagccgtccgtttcaaggcaggggtggagcctttaaagggtcgcttgggccagcgttagcattcctccccctgccgcccgccgggaacatccaatctaagtggtaaaaatgctagtgtgcagtggagctcagcttgaagacaagaccccccacctccagccgtaagacccaaaccaattcttgcccttagcggaggcctcctagaatttctggggccgccactgctctgggggaatcgtgggacacagtccggggaaagaacaaagctaggcgccaggaagggccgaccagcccggacgggtcagccgggtcctagccgtctcgggttctttccaagaaatcaggaaggtgactgtgcaggaggcaaaggacgcccagttaccgtt

SEQ ID NO: 99786 - DNA, 79 bp, Homo sapiens
  misc_feature 1..79: note = chr8:72471116-72471195
  misc_feature 1..79: note = hyper
  source 1..79: mol_type = genomic DNA
gccattgaatgaatgcgggaccgtttgcgttaataccggcaacgttctttctccggtgacactacgcagctgtcgtttt

SEQ ID NO: 99787 - DNA, 51 bp, Homo sapiens
  misc_feature 1..51: note = chr8:72754310-72754361
  misc_feature 1..51: note = hyper
  source 1..51: mol_type = genomic DNA
cagcggccttcctcccgcccgttagaagggcgctgtgctggagtacgaacc

SEQ ID NO: 99788 - DNA, 750 bp, Homo sapiens
  misc_feature 1..750: note = chr8:72754490-72755240
  misc_feature 1..750: note = hyper
  source 1..750: mol_type = genomic DNA
cgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgag

SEQ ID NO: 99789 - DNA, 515 bp, Homo sapiens
  misc_feature 1..515: note = chr8:72755300-72755815
  misc_feature 1..515: note = hyper
  source 1..515: mol_type = genomic DNA
acacacacacacacacagtcatccactccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 99790 - DNA, 157 bp, Homo sapiens; identical to SEQ ID NO: 812
  misc_feature 1..157: note = chr8:72756655-72756812
  misc_feature 1..157: note = hyper
  source 1..157: mol_type = genomic DNA

SEQ ID NO: 99791 - DNA, 136 bp, Homo sapiens
  misc_feature 1..136: note = chr8:72756813-72756949
  misc_feature 1..136: note = hyper
  source 1..136: mol_type = genomic DNA
ggggaaggggacgtctctgcagagccgagatttgggctctgaagcccgacggcccttcaacatgtctgcgcaggataagtgagctttcggggagtgaaggggcacatcttgttcctaccgacggtgcttctacccc

SEQ ID NO: 99792 - DNA, 30 bp, Homo sapiens
  misc_feature 1..30: note = chr8:72782820-72782850
  misc_feature 1..30: note = hypo
  source 1..30: mol_type = genomic DNA
tgtggattgctggatcgtatgatagttctg

SEQ ID NO: 99793 - DNA, 30 bp, Homo sapiens
  misc_feature 1..30: note = chr8:72855159-72855189
  misc_feature 1..30: note = hypo
  source 1..30: mol_type = genomic DNA
cttccttcccctggccgcaataagttttca

SEQ ID NO: 99794 - DNA, 60 bp, Homo sapiens
  misc_feature 1..60: note = chr8:72917369-72917429
  misc_feature 1..60: note = hyper
  source 1..60: mol_type = genomic DNA
tcaaggcttgcaggtcgtctccaggagtcagagaggtccggactccggggattcctgctc

SEQ ID NO: 99795 - DNA, 30 bp, Homo sapiens
  misc_feature 1..30: note = chr8:72917679-72917709
  misc_feature 1..30: note = hyper
  source 1..30: mol_type = genomic DNA
tcagtgtaggactggcgacactcctttctt

SEQ ID NO: 99796 - DNA, 374 bp, Homo sapiens
  misc_feature 1..374: note = chr8:72987542-72987916
  misc_feature 1..374: note = hyper
  source 1..374: mol_type = genomic DNA
ttccttgaaatcctccgtgtcgtccggcacatcctcatagacaacgccctggggctccttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggc

SEQ ID NO: 99797 - DNA, 119 bp, Homo sapiens; identical to SEQ ID NO: 3314
  misc_feature 1..119: note = chr8:72987917-72988036
  misc_feature 1..119: note = hyper
  source 1..119: mol_type = genomic DNA

SEQ ID NO: 99798 - DNA, 164 bp, Homo sapiens; identical to SEQ ID NO: 32097
  misc_feature 1..164: note = chr8:73163497-73163661
  misc_feature 1..164: note = hyper
  source 1..164: mol_type = genomic DNA

SEQ ID NO: 99799 - DNA, 385 bp, Homo sapiens
  misc_feature 1..385: note = chr8:73163859-73164244
  misc_feature 1..385: note = hyper
  source 1..385: mol_type = genomic DNA
cgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgcaggaagcaagcggggcgtgaagaggaggtagaaacacagacctccctagcaaagagggaggcggcgcagcgtctgccgaggactcgccccttcaggaacaaagtgactcccccgtcccgctgtcctgcagctgcagcagcgcactcccagagtcaagcgtgtcaggtcggtgtggatgcagcgaatttgttgtaatctacacattaagagcccccttgcctcgccctgccccctcc

SEQ ID NO: 99800 - DNA, 46 bp, Homo sapiens; identical to SEQ ID NO: 9640
  misc_feature 1..46: note = chr8:73448786-73448832
  misc_feature 1..46: note = hyper
  source 1..46: mol_type = genomic DNA

SEQ ID NO: 99801 - DNA, 30 bp, Homo sapiens; identical to SEQ ID NO: 32100
  misc_feature 1..30: note = chr8:73449084-73449114
  misc_feature 1..30: note = hyper
  source 1..30: mol_type = genomic DNA

SEQ ID NO: 99802 - DNA, 55 bp, Homo sapiens
  misc_feature 1..55: note = chr8:73449377-73449432
  misc_feature 1..55: note = hyper
  source 1..55: mol_type = genomic DNA
aggaggaagagaaggcggcggccgctccagcccgcgggtgcgcggagcgcgggag

SEQ ID NO: 99803 - DNA, 316 bp, Homo sapiens
  misc_feature 1..316: note = chr8:73449639-73449955
  misc_feature 1..316: note = hyper
  source 1..316: mol_type = genomic DNA
ctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 99804 - DNA, 136 bp, Homo sapiens; identical to SEQ ID NO: 32103
  misc_feature 1..136: note = chr8:73450026-73450162
  misc_feature 1..136: note = hyper
  source 1..136: mol_type = genomic DNA

SEQ ID NO: 99805 - DNA, 119 bp, Homo sapiens
  misc_feature 1..119: note = chr8:73450471-73450590
  misc_feature 1..119: note = hyper
  source 1..119: mol_type = genomic DNA
tctctgatgtatgaacgatcctcagaacacagagacatgcgtgcattttattcttcaagcggtgcgcggtctccgttctgtagcacgattcctgagagggagaacgggtctctaaggaa

SEQ ID NO: 99806 - DNA, 218 bp, Homo sapiens
  misc_feature 1..218: note = chr8:73802558-73802776
  misc_feature 1..218: note = hypo
  source 1..218: mol_type = genomic DNA
agggtgtggcagaggcggagattgaactctgctgctttgcagacacaatacaagtaagtctcagccccgaacaaaacaacattagccccttgttcctcagtaatagaggcttatactatgccgtcttagtaagactatggcacatcagctgcagctgccttcagacagtgctcttcagacctgtgaggctcaggtcccttccccggtcccatcacact

SEQ ID NO: 99807 - DNA, 18 bp, Homo sapiens
  misc_feature 1..18: note = chr8:73966731-73966749
  misc_feature 1..18: note = hypo
  source 1..18: mol_type = genomic DNA
aagcgttgagtcaccgcg

SEQ ID NO: 99808 - DNA, 113 bp, Homo sapiens
  misc_feature 1..113: note = chr8:74005057-74005170
  misc_feature 1..113: note = hyper
  source 1..113: mol_type = genomic DNA
ccggcgccccactctcggcctgaccacccacctgggcacgccctgtcgtagtcgaagcagcagtccccggtgaagcgacaggcttggtcgcagaaacacgtcccgtagaccct

SEQ ID NO: 99809 - DNA, 30 bp, Homo sapiens
  misc_feature 1..30: note = chr8:74005509-74005539
  misc_feature 1..30: note = hyper
  source 1..30: mol_type = genomic DNA
cccaggtggggagggcgctgcagttcccgg

SEQ ID NO: 99810 - DNA, 34 bp, Homo sapiens
  misc_feature 1..34: note = chr8:74086196-74086230
  misc_feature 1..34: note = hypo
  source 1..34: mol_type = genomic DNA
agtggcattgctggccgggcgcggtggctcccgc

SEQ ID NO: 99811 - DNA, 46 bp, Homo sapiens
  misc_feature 1..46: note = chr8:74332799-74332845
  misc_feature 1..46: note = hypo
  source 1..46: mol_type = genomic DNA
agtggctacaacacacggatgggggtgggcgcgattcccacaacag

SEQ ID NO: 99812 - DNA, 54 bp, Homo sapiens
  misc_feature 1..54: note = chr8:74674435-74674489
  misc_feature 1..54: note = hypo
  source 1..54: mol_type = genomic DNA
ctactcgttgtccaccgaaattcattctcctgacttccacgacaattgagttgt

SEQ ID NO: 99813 - DNA, 101 bp, Homo sapiens; identical to SEQ ID NO: 41825
  misc_feature 1..101: note = chr8:74759410-74759511
  misc_feature 1..101: note = hypo
  source 1..101: mol_type = genomic DNA

SEQ ID NO: 99814 - DNA, 44 bp, Homo sapiens; identical to SEQ ID NO: 41826
  misc_feature 1..44: note = chr8:74759819-74759863
  misc_feature 1..44: note = hypo
  source 1..44: mol_type = genomic DNA

SEQ ID NO: 99815 - DNA, 30 bp, Homo sapiens
  misc_feature 1..30: note = chr8:74848031-74848061
  misc_feature 1..30: note = hypo
  source 1..30: mol_type = genomic DNA
atttaaccccataaacgtttactgaatgct

SEQ ID NO: 99816 - DNA, 157 bp, Homo sapiens
  misc_feature 1..157: note = chr8:74962845-74963002
  misc_feature 1..157: note = hypo
  source 1..157: mol_type = genomic DNA
tttaacatttcttaacgttgttttcatattgttgctaattaaatgaaattatagcactattaccatcaccaaaacataattaccaccaccaatcctgttagcaatgctcttttaaacgttatctaagactcagctgggcacgggggctcatgcctgt

SEQ ID NO: 99817 - DNA, 30 bp, Homo sapiens
  misc_feature 1..30: note = chr8:751817-751847
  misc_feature 1..30: note = hypo
  source 1..30: mol_type = genomic DNA
ctcactgcccttgctcgccacccaggtggc

SEQ ID NO: 99818 - DNA, 37 bp, Homo sapiens
  misc_feature 1..37: note = chr8:75232634-75232671
  misc_feature 1..37: note = hyper
  source 1..37: mol_type = genomic DNA
ctggaggaccagaagcgaaatacgactccacgtgaaa

SEQ ID NO: 99819 - DNA, 160 bp, Homo sapiens
  misc_feature 1..160: note = chr8:75232938-75233098
  misc_feature 1..160: note = hyper
  source 1..160: mol_type = genomic DNA
gtcagatccagccctcgcgccccagtccggtcccagcgccctctctgggaaaggcgggcgcgggcgcgggggtgggaggcgcccccaggtgttttggcgggtttccggacacgtgcgcccggcgtcctccccgcttccccgcagccggggcagagcccac

SEQ ID NO: 99820 - DNA, 57 bp, Homo sapiens
  misc_feature 1..57: note = chr8:75233984-75234041
  misc_feature 1..57: note = hyper
  source 1..57: mol_type = genomic DNA
cgcgcagtgggatgccggtgggagggcgagtgtacccggggacgcacgagaatccct

SEQ ID NO: 99821 - DNA, 34 bp, Homo sapiens
  misc_feature 1..34: note = chr8:75733579-75733613
  misc_feature 1..34: note = hypo
  source 1..34: mol_type = genomic DNA
gattacaggagtgagccaccgtgcccagcccatt

SEQ ID NO: 99822 - DNA, 282 bp, Homo sapiens
  misc_feature 1..282: note = chr8:75896554-75896836
  misc_feature 1..282: note = hyper
  source 1..282: mol_type = genomic DNA
cacgcccacaaaggccgagcgccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtcccc

SEQ ID NO: 99823 - DNA, 460 bp, Homo sapiens; identical to SEQ ID NO: 32107
  misc_feature 1..460: note = chr8:75896837-75897297
  misc_feature 1..460: note = hyper
  source 1..460: mol_type = genomic DNA

SEQ ID NO: 99824 - DNA, 96 bp, Homo sapiens
  misc_feature 1..96: note = chr8:75897298-75897394
  misc_feature 1..96: note = hyper
  source 1..96: mol_type = genomic DNA
gaaagcagcgacgatagaaattagcgggagctctagttcttgtaagtgactttgttggtttcacctactttctctgtcgcgcgctttccatttgag

SEQ ID NO: 99825 - DNA, 87 bp, Homo sapiens
  misc_feature 1..87: note = chr8:76008456-76008543
  misc_feature 1..87: note = hypo
  source 1..87: mol_type = genomic DNA
aggtgttgggaaagacgaataattaaatatgcatttttagggacacacccgtgacgatattcttattttactatttttttaactttt

SEQ ID NO: 99826 - DNA, 253 bp, Homo sapiens
  misc_feature 1..253: note = chr8:76316303-76316556
  misc_feature 1..253: note = hyper
  source 1..253: mol_type = genomic DNA
gtcccagttgcagtccgctattgctccaggcccagcgggggcggacctcgttggaggctacggtgcaggtcggagaagatgaaatggcctagcatcccccttcccaggggctcgagtcggcagctttagagctccgacaatctgtgccctcgctttgggctgcgccagggagcaaaaaacctctgcttttttgaaagaggccggggcaacaaggtagagagccgcggccagaagcagccccgggccataaacc

SEQ ID NO: 99827 - DNA, 381 bp, Homo sapiens
  misc_feature 1..381: note = chr8:76316614-76316995
  misc_feature 1..381: note = hyper
  source 1..381: mol_type = genomic DNA
cgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaatctagaaaagaatgggaggagaactgcatgagcttttaattttcttccctttttccccccttcctgcgtgtaaactggggtaagggtgggcggtaatccccactg

SEQ ID NO: 99828 - DNA, 64 bp, Homo sapiens
  misc_feature 1..64: note = chr8:76319856-76319920
  misc_feature 1..64: note = hyper
  source 1..64: mol_type = genomic DNA
gtttgtttagtaaatcgataggactgtgagagtcaggccgctgccctgtcgccattgagcaaag

SEQ ID NO: 99829 - DNA, 56 bp, Homo sapiens
  misc_feature 1..56: note = chr8:76320236-76320292
  misc_feature 1..56: note = hyper
  source 1..56: mol_type = genomic DNA
cgcagcgcaccgccccggcggctgccgggcaggaggagcctcggttcccctcgggc

SEQ ID NO: 99830 - DNA, 30 bp, Homo sapiens
  misc_feature 1..30: note = chr8:76836378-76836408
  misc_feature 1..30: note = hypo
  source 1..30: mol_type = genomic DNA
cagccaccatcattgcggctccggttggcc

SEQ ID NO: 99831 - DNA, 23 bp, Homo sapiens
  misc_feature 1..23: note = chr8:76861290-76861313
  misc_feature 1..23: note = hypo
  source 1..23: mol_type = genomic DNA
ccagacgcggtggttcgcaccta

SEQ ID NO: 99832 - DNA, 1618 bp, Homo sapiens
  misc_feature 1..1618: note = chr8:77585073-77586691
  misc_feature 1..1618: note = hyper
  source 1..1618: mol_type = genomic DNA
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaaagcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtgatcactcgaagtcagaagatacaagtgagggctttgagacccgctcaggaataactcatgagcaatcagcacgcgctgagaggaaacgtcttccagaattcgttattattcacattagacattactggagtgggtggtgggactgagagtaaaaaggtgttaaaagggacctaaatggttgatacatttccccccacaccctactgttcatttgggcaacgaaataatttcacagatgcaaaggcgctgtacggtgaactttatatcgtggaaactaacttaactccgagaagagaaagtgcaattagacggcaaccgagtataagaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaattagtaggtaggtgaaggttatgcaaagaagaaaagggaaagtaaagctgttaaaagaatagaataaaacccctgggagttcaactcgaaatccccctttactccccaatccaaagggagtaggaggaggagaaaaaaaagtgcattctggtgtgatgagaactctctggaatgtctggaggagaggatagaagtgcgagggtaagaagacccgggtgctaaataaatggcaggagagagaaatgggggaggggcaaggtaggaaagaaatagtccgcgattcacccaagggactgggagattcagagagattccaggagaaggaaaggaacataagttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaacaaataaacataatacccgttacagcaacacttcctcttgccgccacagctagaatgccataagctctaatggctgcatttctccggacagcagttttcacatctccaaataaatcgttttccttcactt

SEQ ID NO: 99833 - DNA, 30 bp, Homo sapiens
  misc_feature 1..30: note = chr8:77586986-77587016
  misc_feature 1..30: note = hyper
  source 1..30: mol_type = genomic DNA
cccccttcaaacacccgtttctgctgaggt

SEQ ID NO: 99834 - DNA, 606 bp, Homo sapiens
  misc_feature 1..606: note = chr8:77590098-77590704
  misc_feature 1..606: note = hyper
  source 1..606: mol_type = genomic DNA
tctagggaaagttctcggagcggcagggaaacctctactcctttcactttgaaataaaaagtggcccaacgttccgtgagggcggcggcgggttcgcgcagagtttagggacagtggaatgggggtggggcagggagtgggagtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctggaggaaactcttgactctgcgctagaacctctctgccccttccctcagcccattaacccccgaccctcacctccagcctctcttcttagggaaaaggtgaaagaaaacgagaaagagatggtaaacaacaacaacaacaacaacaacaacacacacacgttaggagaattct

SEQ ID NO: 99835 - DNA, 59 bp, Homo sapiens
  misc_feature 1..59: note = chr8:77593174-77593233
  misc_feature 1..59: note = hyper
  source 1..59: mol_type = genomic DNA
gtttgtgtgtaagagcgcgtgtgtgtctaatgaagtttgggagtcgcgcgcaggggcgc

SEQ ID NO: 99836 - DNA, 1361 bp, Homo sapiens
  misc_feature 1..1361: note = chr8:77593234-77594595
  misc_feature 1..1361: note = hyper
  source 1..1361: mol_type = genomic DNA
tagggtgcgagacccggaggtccccatcccctgtcctctccgcggtcgccgcatccggggctccagccgcagcgctgggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtaagttttttctttaacttttattgagtagtttctgttaaatttaggtcgagtatcgattatctttccagcctgatcttgcacaatctttgatatttcgctccctctctctccctctccgcctctcttcctctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 99837 - DNA, 79 bp, Homo sapiens; identical to SEQ ID NO: 32117
  misc_feature 1..79: note = chr8:77594596-77594675
  misc_feature 1..79: note = hyper
  source 1..79: mol_type = genomic DNA

SEQ ID NO: 99838 - DNA, 737 bp, Homo sapiens
  misc_feature 1..737: note = chr8:77594757-77595494
  misc_feature 1..737: note = hyper
  source 1..737: mol_type = genomic DNA
cgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgtgtgtgtgtgtgtattgagtggctgtgttcggctgtgagaaccgattcattcttcggcccccctaaaagggttccatgcctacaaatgaacttcacctccttcgtttctccaagcatcaagtgcgccttctggctgggagcagctaagggaaaagggactggaatgcgccgggtctctccttccttctacttctatccacccccaacccccttctcgctcctcttttctatcagaaaaaaataataaaatctctcatggaattgtataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 99839 - DNA, 30 bp, Homo sapiens
  misc_feature 1..30: note = chr8:77595977-77596007
  misc_feature 1..30: note = hyper
  source 1..30: mol_type = genomic DNA
cttgatccctataaacgtggagtggttaaa

SEQ ID NO: 99840 - DNA, 415 bp, Homo sapiens
  misc_feature 1..415: note = chr8:78532894-78533309
  misc_feature 1..415: note = hypo
  source 1..415: mol_type = genomic DNA
gatacaggattctttcggtgccacttcaccagctgaaaatcgccagtgggctcgttccacccactcggcggcaggctgcgctcagctcacactactggcctggatcctatgcccattgcagctctgccctcagcctgcagctggtccagccatgccgcaactggcttcctccttgggtgccgacatctagacgagggggatgcgatggcgtccgaaaacatggagaagccagcaaacgcagagccccaaggagtgttacagcttttgcttggagagtccagaggtctgagcccccaggaagtgttacagttcttgtttgttcctgccacccttagctcagcaaacgggggcctgtggtgtccagcggttttttcactcctgttgctccccagcagaaacgcgtgttacagctctt

SEQ ID NO: 99841 - DNA, 30 bp, Homo sapiens
  misc_feature 1..30: note = chr8:787176-787206
  misc_feature 1..30: note = hypo
  source 1..30: mol_type = genomic DNA
gatgcgctcaggcctcgggatctcgcgggc

SEQ ID NO: 99842 - DNA, 93 bp, Homo sapiens
  misc_feature 1..93: note = chr8:790385-790478
  misc_feature 1..93: note = hypo
  source 1..93: mol_type = genomic DNA
tctggattctgcgagcgcgtccacatggtgcacgcctgcacttttccccacactctggattctgggagcgcgtctacacggtacatgcctgca

SEQ ID NO: 99843 - DNA, 759 bp, Homo sapiens
  misc_feature 1..759: note = chr8:79428289-79429048
  misc_feature 1..759: note = hyper
  source 1..759: mol_type = genomic DNA
aacagtccatgcagccggggtgacgggggagcgctcggaggaaggacgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccatttcagtgccagattcgcgtagacagtgaagaggactcaaaatttaaaataatttgagttactcttttgctttctgtgccttttaccttcgcttgagtattttg

SEQ ID NO: 99844 - DNA, 30 bp, Homo sapiens
  misc_feature 1..30: note = chr8:79674707-79674737
  misc_feature 1..30: note = hyper
  source 1..30: mol_type = genomic DNA
ctcctcagggcagtccgcccgcccgtcggg

SEQ ID NO: 99845 - DNA, 30 bp, Homo sapiens
  misc_feature 1..30: note = chr8:79844975-79845005
  misc_feature 1..30: note = hypo
  source 1..30: mol_type = genomic DNA
ccataccaaacatggcggctcttctccctg

SEQ ID NO: 99846 - DNA, 30 bp, Homo sapiens
  misc_feature 1..30: note = chr8:80086720-80086750
  misc_feature 1..30: note = hypo
  source 1..30: mol_type = genomic DNA
ttgtcttgctacccacgttgggaataaaca

SEQ ID NO: 99847 - DNA, 162 bp, Homo sapiens; identical to SEQ ID NO: 41828
  misc_feature 1..162: note = chr8:80483857-80484019
  misc_feature 1..162: note = hypo
  source 1..162: mol_type = genomic DNA

SEQ ID NO: 99848 - DNA, 578 bp, Homo sapiens; identical to SEQ ID NO: 32121
  misc_feature 1..578: note = chr8:80523889-80524467
  misc_feature 1..578: note = hyper
  source 1..578: mol_type = genomic DNA

SEQ ID NO: 99849 - DNA, 85 bp, Homo sapiens
  misc_feature 1..85: note = chr8:80524468-80524553
  misc_feature 1..85: note = hyper
  source 1..85: mol_type = genomic DNA
ccctccccacgctggcctcattgttctgcttttaagagagatgggaaaagtgggttaacatttttcttttcggaagcaaattaca

SEQ ID NO: 99850 - DNA, 928 bp, Homo sapiens; identical to SEQ ID NO: 32123
  misc_feature 1..928: note = chr8:80524845-80525773
  misc_feature 1..928: note = hyper
  source 1..928: mol_type = genomic DNA

SEQ ID NO: 99851 - DNA, 38 bp, Homo sapiens
  misc_feature 1..38: note = chr8:80677743-80677781
  misc_feature 1..38: note = hyper
  source 1..38: mol_type = genomic DNA
ctggggcagcaacagcgggtgcgcgatgtgcgggtgat

SEQ ID NO: 99852 - DNA, 30 bp, Homo sapiens
  misc_feature 1..30: note = chr8:80695916-80695946
  misc_feature 1..30: note = hyper
  source 1..30: mol_type = genomic DNA
ccggctcttggccctcgctgtcctgcccgc

SEQ ID NO: 99853 - DNA, 30 bp, Homo sapiens
  misc_feature 1..30: note = chr8:80696233-80696263
  misc_feature 1..30: note = hyper
  source 1..30: mol_type = genomic DNA
gagattccctcaacacgctttccccctatt

SEQ ID NO: 99854 - DNA, 352 bp, Homo sapiens
  misc_feature 1..352: note = chr8:80803548-80803900
  misc_feature 1..352: note = hyper
  source 1..352: mol_type = genomic DNA
gacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccacccccagc

SEQ ID NO: 99855 - DNA, 30 bp, Homo sapiens
  misc_feature 1..30: note = chr8:80804344-80804374
  misc_feature 1..30: note = hypo
  source 1..30: mol_type = genomic DNA
catcagagggtcttgcggtttcctggtttg

SEQ ID NO: 99856 - DNA, 96 bp, Homo sapiens
  misc_feature 1..96: note = chr8:81051849-81051945
  misc_feature 1..96: note = hypo
  source 1..96: mol_type = genomic DNA
acaagtagcaataaacggggggtgggggtgagggcggggaaggggttgcatttggatagcgcctcccaatgcacttgaacactatagctaacaata

SEQ ID NO: 99857 - DNA, 35 bp, Homo sapiens
  misc_feature 1..35: note = chr8:81052005-81052040
  misc_feature 1..35: note = hypo
  source 1..35: mol_type = genomic DNA
aatcaaataaaatacaacggcgtttttcaatcctc

SEQ ID NO: 99858 - DNA, 30 bp, Homo sapiens
  misc_feature 1..30: note = chr8:81084313-81084343
  misc_feature 1..30: note = hypo
  source 1..30: mol_type = genomic DNA
cttttccatagaatgcggattttttaggtg

SEQ ID NO: 99859 - DNA, 20 bp, Homo sapiens
  misc_feature 1..20: note = chr8:81085073-81085093
  misc_feature 1..20: note = hypo
  source 1..20: mol_type = genomic DNA
aaaacaggcctggcacggtg

SEQ ID NO: 99860 - DNA, 38 bp, Homo sapiens
  misc_feature 1..38: note = chr8:81213318-81213356
  misc_feature 1..38: note = hypo
  source 1..38: mol_type = genomic DNA
cttactccatgatgacgcacggccgcaacaaccgcaag

SEQ ID NO: 99861 - DNA, 38 bp, Homo sapiens
  misc_feature 1..38: note = chr8:81309040-81309078
  misc_feature 1..38: note = hypo
  source 1..38: mol_type = genomic DNA
attgctaatgtaggccgggcgcggtggctcacgcctgt

SEQ ID NO: 99862 - DNA, 101 bp, Homo sapiens; identical to SEQ ID NO: 32125
  misc_feature 1..101: note = chr8:81400332-81400433
  misc_feature 1..101: note = hyper
  source 1..101: mol_type = genomic DNA

SEQ ID NO: 99863 - DNA, 398 bp, Homo sapiens
  misc_feature 1..398: note = chr8:81478129-81478527
  misc_feature 1..398: note = hyper
  source 1..398: mol_type = genomic DNA
gttgaccttggcctgcgtgggtgttctcgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaaataccagggcacccatgtttctgccctgggaaactctcacgtcagccggccccccaattctgctaaaggagaaaacaaaatttccctcccatggacgcagctgggcactttgagaactggtcgggcagaaggctgatcgcgcagagcctggtgcaaacgggaagcaattccc

SEQ ID NO: 99864 - DNA, 70 bp, Homo sapiens
  misc_feature 1..70: note = chr8:81786854-81786924
  misc_feature 1..70: note = hyper
  source 1..70: mol_type = genomic DNA
gggcaaacgcttaaccgcagcccattcttccctccggagggaggggagtagacttcgctggaagtaaggt

SEQ ID NO: 99865 - DNA, 1074 bp, Homo sapiens
  misc_feature 1..1074: note = chr8:82192624-82193698
  misc_feature 1..1074: note = hyper
  source 1..1074: mol_type = genomic DNA
ctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcccttttttccccctttactcatccttccccttcctgccaccattctgtctctcccatttaccccatcgtggcagcacccactcccctttccctccctgtcgcatcttttgttccctgtggcgcgcaggtcaccctccgttttcttcatggggacgcggtgctggcgcgcagtttcccgcagaaatcctgtggaggggtctgagtggcgctacagcttcagcttgcattcctctgtcagccccgtctcccccaggtcctctgctcgcccttaccagttgagccgaaccctttggattggtaccccatggaacaccagggcccccgagaagcgtggcgctggcggtgccgacctgctgctggcactgccgggccggggcgccgcagtgggcgggtggcctgtggg

SEQ ID NO: 99866 - DNA, 193 bp, Homo sapiens
  misc_feature 1..193: note = chr8:82543083-82543276
  misc_feature 1..193: note = hyper
  source 1..193: mol_type = genomic DNA
ggcagctccagataacgtggcaggcaagagtcacccagatgcggccttcgccccaggggctgaccgcacaccgcagaccgccctcgcccccaccccagcagagagaagcgccgaacccggagagggtggcgaggggggcggggaaaacaggagcctcacctcgagtcggcgagcggggcggggaaaacagggg

SEQ ID NO: 99867 - DNA, 219 bp, Homo sapiens
  misc_feature 1..219: note = chr8:82556628-82556847
  misc_feature 1..219: note = hypo
  source 1..219: mol_type = genomic DNA
gtcttttctgtatgacgagttttgaaagataaatttgccaattgattccttgcagttcttccttcgtgtcacctgattgttttctccatagtcaaattgtgctcttaattgataaccaacatcttaggtcaagatatcagttcctggtgggtttaaatgctttcagtcacttttattttttattttttatttttttatgatggagtctctgttgcccag

SEQ ID NO: 99868 - DNA, 30 bp, Homo sapiens
  misc_feature 1..30: note = chr8:82687586-82687616
  misc_feature 1..30: note = hypo
  source 1..30: mol_type = genomic DNA
tttttatttgccttccggggtacatgtgag

SEQ ID NO: 99869 - DNA, 90 bp, Homo sapiens
  misc_feature 1..90: note = chr8:82903043-82903133
  misc_feature 1..90: note = hypo
  source 1..90: mol_type = genomic DNA
cgctcctccctcagccaggcttgcagcctcaccgttggatctcagactagcagtgagcaaggctcactgggcgtgcgacccacgggcatg

SEQ ID NO: 99870 - DNA, 52 bp, Homo sapiens
  misc_feature 1..52: note = chr8:83104515-83104567
  misc_feature 1..52: note = hypo
  source 1..52: mol_type = genomic DNA
tgaggctggacactgcggagaagggggtggcaccagtcggggaggctcgggc

SEQ ID NO: 99871 - DNA, 91 bp, Homo sapiens
  misc_feature 1..91: note = chr8:83281998-83282089
  misc_feature 1..91: note = hypo
  source 1..91: mol_type = genomic DNA
tgcgatattgggaatgttatcatccactttccccgtgcatattgcgaacagtattacaggggctgtacagcccctgcgataggaagtaata

SEQ ID NO: 99872 - DNA, 38 bp, Homo sapiens
  misc_feature 1..38: note = chr8:84342394-84342432
  misc_feature 1..38: note = hypo
  source 1..38: mol_type = genomic DNA
gtaaccttgggaggccgaggcgggcggatcacgaggtc

SEQ ID NO: 99873 - DNA, 325 bp, Homo sapiens
  misc_feature 1..325: note = chr8:85094516-85094841
  misc_feature 1..325: note = hyper
  source 1..325: mol_type = genomic DNA
ggctcccgcggggtgcgccaccgcctcactgctggtacacgtctccccctctcgaccgccaagtgcttgctccctccaggcgagcactcacacaatggactcacttgtttcccatgcccctctcctttgacttccagcctcagcgaacaacttgagcaagagtcaaacaggagtctctgccatggagcatagacccttggagctttccagaccagctcagaagcacgggcgcacacacagacaaaacaatgccttgtccacgaatgaataaaggacacccatgcccccacccaccgctccgcaacccgcagaaagaaacccggga

SEQ ID NO: 99874 - DNA, 239 bp, Homo sapiens
  misc_feature 1..239: note = chr8:85095259-85095498
  misc_feature 1..239: note = hyper
  source 1..239: mol_type = genomic DNA
cacctcctctcaaggcgctggatcagcacccctgagctgcccccacagcacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctc

SEQ ID NO: 99875 - DNA, 212 bp, Homo sapiens
  misc_feature 1..212: note = chr8:85095499-85095711
  misc_feature 1..212: note = hyper
  source 1..212: mol_type = genomic DNA
tctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctga

SEQ ID NO: 99876 - DNA, 133 bp, Homo sapiens
  misc_feature 1..133: note = chr8:85095983-85096116
  misc_feature 1..133: note = hyper
  source 1..133: mol_type = genomic DNA
tttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatgg

SEQ ID NO: 99877 - DNA, 199 bp, Homo sapiens
  misc_feature 1..199: note = chr8:85096522-85096721
  misc_feature 1..199: note = hyper
  source 1..199: mol_type = genomic DNA
tcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaaga

SEQ ID NO: 99878 - DNA, 151 bp, Homo sapiens; identical to SEQ ID NO: 32134
  misc_feature 1..151: note = chr8:85096852-85097003
  misc_feature 1..151: note = hyper
  source 1..151: mol_type = genomic DNA

SEQ ID NO: 99879 - DNA, 158 bp, Homo sapiens; identical to SEQ ID NO: 32135
  misc_feature 1..158: note = chr8:85097062-85097220
  misc_feature 1..158: note = hyper
  source 1..158: mol_type = genomic DNA

SEQ ID NO: 99880 - DNA, 145 bp, Homo sapiens
  misc_feature 1..145: note = chr8:852161-852306
  misc_feature 1..145: note = hypo
  source 1..145: mol_type = genomic DNA
gcacagatccaagcccggccgctcccctcctcgggcgcccagccacgttcatttattcctctcgggctctgatcattcctactggataggagtcctcgctgagcccccatggtatctggcacagagcggacgtgtgttctgggac

SEQ ID NO: 99881 - DNA, 134 bp, Homo sapiens
  misc_feature 1..134: note = chr8:853984-854118
  misc_feature 1..134: note = hypo
  source 1..134: mol_type = genomic DNA
gcctgggcctctggacgcaggggacacacgcggtccaggccctgagtggacagagaggacgctggtggggtgtcgggaaccctagctggggccgagtttcttcagctgaaaatcagtcacgtgtctgacatcca

SEQ ID NO: 99882 - DNA, 105 bp, Homo sapiens
  misc_feature 1..105: note = chr8:854712-854817
  misc_feature 1..105: note = hypo
  source 1..105: mol_type = genomic DNA
acacctcggggtgaccgctgagtatattttgtggccccagcacccgtggcaggcagaactcacgcctcctgatctttctcagctgctaaacgctgctgtagaaca

SEQ ID NO: 99883 - DNA, 236 bp, Homo sapiens
  misc_feature 1..236: note = chr8:8560796-8561032
  misc_feature 1..236: note = hypo
  source 1..236: mol_type = genomic DNA
gagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatata

SEQ ID NO: 99884 - DNA, 19 bp, Homo sapiens
  misc_feature 1..19: note = chr8:85844268-85844287
  misc_feature 1..19: note = hypo
  source 1..19: mol_type = genomic DNA
tttgagacaaagtctcgct

SEQ ID NO: 99885 - DNA, 30 bp, Homo sapiens
  misc_feature 1..30: note = chr8:86034879-86034909
  misc_feature 1..30: note = hypo
  source 1..30: mol_type = genomic DNA
acatcactattggatcgctattttaaagtt

SEQ ID NO: 99886 - DNA, 103 bp, Homo sapiens
  misc_feature 1..103: note = chr8:86301028-86301131
  misc_feature 1..103: note = hypo
  source 1..103: mol_type = genomic DNA
aaaaaaacaacaaaaaaaaaaaaaaaagaaaagatatccattaattttgggtaagatgactcaatcataaagatgtcatttctctctacggtagtttataact

SEQ ID NO: 99887 - DNA, 30 bp, Homo sapiens
  misc_feature 1..30: note = chr8:86350528-86350558
  misc_feature 1..30: note = hyper
  source 1..30: mol_type = genomic DNA
gggcaggcaaacaaacgagttctttccagc

SEQ ID NO: 99888 - DNA, 114 bp, Homo sapiens; identical to SEQ ID NO: 41831
  misc_feature 1..114: note = chr8:86370822-86370936
  misc_feature 1..114: note = hypo
  source 1..114: mol_type = genomic DNA

SEQ ID NO: 99889 - DNA, 199 bp, Homo sapiens
  misc_feature 1..199: note = chr8:86389517-86389716
  misc_feature 1..199: note = hypo
  source 1..199: mol_type = genomic DNA
tgacaggtctgtttacgggtggagcatttagtcaaggcagaagaccttggcctccagagtgagagagaactgagatttaatccttctcctgctacttcttgctatggaaatagtgcctttgatggtgcctagcaaataaacagcgttcagtaaatctttgttgttattaactataaacttagttcgtttagtctctaaa

SEQ ID NO: 99890 - DNA, 360 bp, Homo sapiens
  misc_feature 1..360: note = chr8:8639440-8639800
  misc_feature 1..360: note = hypo
  source 1..360: mol_type = genomic DNA
gggccagcacgctgtcacctctcagcgggatgcagccgtagggccagccacacctctcccacgtgggacgcacctcttgtgacacttcttttggaaattctagttgcctcctgctttcctctgttctgttggcaaaagtggctttgaattctgcacaccccacggttctacctgccttgtcaggagtcttgcagtgaggccctcctggtctgaagcgatcccttcttccctgtattgcgctgtcttcagggcagggctcctcttgttacagtaggtagtcaggcacacataagcagggcagaagaacgccccccagcaaccatcaggtgagatggtcaggtggttgttacactgtctctc

SEQ ID NO: 99891 - DNA, 120 bp, Homo sapiens
  misc_feature 1..120: note = chr8:8639860-8639980
  misc_feature 1..120: note = hypo
  source 1..120: mol_type = genomic DNA
ctgaagctggtgatcagcagctttcggataagagctcaggatttgggtgcgtgggctgaagcatgcgcattaagaggcaaaaggacggcgcttgactggtataggaccttctaggaacat

SEQ ID NO: 99892 - DNA, 29 bp, Homo sapiens
  misc_feature 1..29: note = chr8:86405563-86405592
  misc_feature 1..29: note = hypo
  source 1..29: mol_type = genomic DNA
tgcacgggggatgggcgcggtgcctcaag

SEQ ID NO: 99893 - DNA, 36 bp, Homo sapiens; identical to SEQ ID NO: 41834
  misc_feature 1..36: note = chr8:86406813-86406849
  misc_feature 1..36: note = hypo
  source 1..36: mol_type = genomic DNA

SEQ ID NO: 99894 - DNA, 26 bp, Homo sapiens
  misc_feature 1..26: note = chr8:86417676-86417702
  misc_feature 1..26: note = hypo
  source 1..26: mol_type = genomic DNA
agaatcacaagcgtgagccactgtgc

SEQ ID NO: 99895 - DNA, 30 bp, Homo sapiens
  misc_feature 1..30: note = chr8:86428565-86428595
  misc_feature 1..30: note = hypo
  source 1..30: mol_type = genomic DNA
agccactgcacctggcgattataagttcct

SEQ ID NO: 99896 - DNA, 30 bp, Homo sapiens
  misc_feature 1..30: note = chr8:86432229-86432259
  misc_feature 1..30: note = hypo
  source 1..30: mol_type = genomic DNA
tgaagaataaatagacggtgtgattagttt

SEQ ID NO: 99897 - DNA, 123 bp, Homo sapiens
  misc_feature 1..123: note = chr8:86436621-86436744
  misc_feature 1..123: note = hypo
  source 1..123: mol_type = genomic DNA
gcatccaacctgactcggcccgcgtggcagcctgtggtctgggtgggcgtcgcccctcgtcacgccctgtggggagctgtgattgggtcacgcctgtcagggcagccccgccccatgggtaag

SEQ ID NO: 99898 - DNA, 42 bp, Homo sapiens
  misc_feature 1..42: note = chr8:86437022-86437064
  misc_feature 1..42: note = hypo
  source 1..42: mol_type = genomic DNA
ttgttactgttcaagcgagtttggaaacgttgtcagagaccc

SEQ ID NO: 99899 - DNA, 128 bp, Homo sapiens
  misc_feature 1..128: note = chr8:86468333-86468461
  misc_feature 1..128: note = hypo
  source 1..128: mol_type = genomic DNA
aaatcttcccactgtcgagacttatctgccagtggatgttgaagcagagcaccactgcctttccttaatcccaaagcttattaccggaggctaccgtactcagcaattaaaaccgaacaaaaatgtgc

SEQ ID NO: 99900 - DNA, 76 bp, Homo sapiens
  misc_feature 1..76: note = chr8:86495755-86495831
  misc_feature 1..76: note = hypo
  source 1..76: mol_type = genomic DNA
taacttcttttcagtcgatgagatagattctactattggcccatttaactaatgagaaaaccgagacacaggggtt

SEQ ID NO: 99901 - DNA, 120 bp, Homo sapiens
  misc_feature 1..120: note = chr8:86544680-86544800
  misc_feature 1..120: note = hypo
  source 1..120: mol_type = genomic DNA
aaaaaaaaaaaaaaacaacaaaaaaaactcccacgggcacctccatgttaattagcaatagaagttagaaaaattcacaagaatttatggccgggtgcggtgactcacgcctataatcct

SEQ ID NO: 99902 - DNA, 63 bp, Homo sapiens
  misc_feature 1..63: note = chr8:86556050-86556113
  misc_feature 1..63: note = hypo
  source 1..63: mol_type = genomic DNA
acttgagacactcttcggtgaacagttggagatagcctcggcggaggacggtggggacttggc

SEQ ID NO: 99903 - DNA, 30 bp, Homo sapiens
  misc_feature 1..30: note = chr8:865633-865663
  misc_feature 1..30: note = hypo
  source 1..30: mol_type = genomic DNA
aattcccgaatcacacggctggtcatgcgt

SEQ ID NO: 99904 - DNA, 75 bp, Homo sapiens
  misc_feature 1..75: note = chr8:8666327-8666402
  misc_feature 1..75: note = hypo
  source 1..75: mol_type = genomic DNA
ttggaaagcatcccccgcaaataagggttggaggaatgactctatagcaagggtgcccaacgccagggccatgga

SEQ ID NO: 99905 - DNA, 74 bp, Homo sapiens
  misc_feature 1..74: note = chr8:86849567-86849641
  misc_feature 1..74: note = hypo
  source 1..74: mol_type = genomic DNA
ctttaagatttagctcgtgtttgattcaagattaagttttacagtgtttgtcacaccagcgtatagaaaaatca

SEQ ID NO: 99906 - DNA, 19 bp, Homo sapiens
  misc_feature 1..19: note = chr8:86926063-86926082
  misc_feature 1..19: note = hypo
  source 1..19: mol_type = genomic DNA
accacgcctggctaatttt

SEQ ID NO: 99907 - DNA, 30 bp, Homo sapiens
  misc_feature 1..30: note = chr8:86953049-86953079
  misc_feature 1..30: note = hypo
  source 1..30: mol_type = genomic DNA
tcagcctcctctttccgcaatatcacctga

SEQ ID NO: 99908 - DNA, 221 bp, Homo sapiens
  misc_feature 1..221: note = chr8:86976079-86976300
  misc_feature 1..221: note = hypo
  source 1..221: mol_type = genomic DNA
cactgagcaaggcagcgggcacgtgattcaagaacatgctgtttctaaccaaacaacaagcctcattttttaataccttcagtaaccagagagatgagttgtcttcgattcattttcccttcttatgcttaatggcatctgcagacattatattttcctttttattgactgcttatttttgcagtaaaagaacttgcggcagcattcgtttgacttaagta

SEQ ID NO: 99909 - DNA, 189 bp, Homo sapiens
  misc_feature 1..189: note = chr8:87081763-87081952
  misc_feature 1..189: note = hyper
  source 1..189: mol_type = genomic DNA
cgacgccggcttggttttgaccttcgtgcttggcccaagccagcgctggtggccccgggaccaccttcctgctggcgccgcaccccatacccgcaacacgcccgccgctcgcgggacctggggactcgggaagcagccagccccgttcctccgccctttatcaaagagcagctgcgaggggcgggaccc

SEQ ID NO: 99910 - DNA, 197 bp, Homo sapiens
  misc_feature 1..197: note = chr8:87083708-87083905
  misc_feature 1..197: note = hypo
  source 1..197: mol_type = genomic DNA
tgtttgcataaggatcgcacagcaaataggaagcatctgctataaaacctaaacctgggcagcagtgaaggcgccagacacttccacgaggcaggcagtccctctgcctgtccaccttctcccagcagtgagggccttcatagtaggctgcagaaacctcttctgtcctgtctgcagctggccgcacagcagagaaa

SEQ ID NO: 99911 - DNA, 30 bp, Homo sapiens
  misc_feature 1..30: note = chr8:8709733-8709763
  misc_feature 1..30: note = hypo
  source 1..30: mol_type = genomic DNA
tcacatttgggaagccgaggcgggcagatc

SEQ ID NO: 99912 - DNA, 738 bp, Homo sapiens
  misc_feature 1..738: note = chr8:8748350-8749088
  misc_feature 1..738: note = hypo
  source 1..738: mol_type = genomic DNA
agacattgaggatgtcgatgaggcgggtgaggttgtggaagacgtgctccttgagagccggactgtcctcaaagtagagtagcttgccgctctcatgcaggtaggagagggcactctgcagtcggtcctcggtcagacccgcctgcaggcccaagcgcgccgagtcccaccagcttagccacagtcgctgggcctgaggtggctggaaatgcagttcctccagcacctgccaggatcgaggcagtactctgtgtaagttggggaagatctctcggtgctcagcaactgacagcaacttgtcccgaaggcgtcgtaagtggcgcgggtccctgcagctaacaggcaacacgggggagaggatctgcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacatttctcctccagctcacgctctccgcacaggtctgcgtgggtgcccacgatgcacaccaccgcgtggggcactctcgccccgacccgatgcaagaaggagcccacggtggtaggaaagtggcgaggctcataggtggccaagttgaccaccagcacgtatagggcccctg

SEQ ID NO: 99913 - DNA, 32 bp, Homo sapiens
  misc_feature 1..32: note = chr8:88037278-88037310
  misc_feature 1..32: note = hypo
  source 1..32: mol_type = genomic DNA
gtgaagccagctgggcgtctgggtagggtggg

SEQ ID NO: 99914 - DNA, 498 bp, Homo sapiens; identical to SEQ ID NO: 41839
  misc_feature 1..498: note = chr8:88885698-88886196
  misc_feature 1..498: note = hypo
  source 1..498: mol_type = genomic DNA

SEQ ID NO: 99915 - DNA, 30 bp, Homo sapiens; identical to SEQ ID NO: 41699
  misc_feature 1..30: note = chr8:8898369-8898399
  misc_feature 1..30: note = hypo
  source 1..30: mol_type = genomic DNA

SEQ ID NO: 99916 - DNA, 30 bp, Homo sapiens; identical to SEQ ID NO: 41700
  misc_feature 1..30: note = chr8:8898687-8898717
  misc_feature 1..30: note = hypo
  source 1..30: mol_type = genomic DNA

SEQ ID NO: 99917 - DNA, 46 bp, Homo sapiens
  misc_feature 1..46: note = chr8:889984-890030
  misc_feature 1..46: note = hypo
  source 1..46: mol_type = genomic DNA
gcccatgagagaatccgggaatagaaggagccgggatctccgtctt

SEQ ID NO: 99918 - DNA, 941 bp, Homo sapiens; identical to SEQ ID NO: 32137
  misc_feature 1..941: note = chr8:89339042-89339983
  misc_feature 1..941: note = hyper
  source 1..941: mol_type = genomic DNA

SEQ ID NO: 99919 - DNA, 10 bp, Homo sapiens
  misc_feature 1..10: note = chr8:89340043-89340053
  misc_feature 1..10: note = hyper
  source 1..10: mol_type = genomic DNA
cacacacgcg

SEQ ID NO: 99920 - DNA, 156 bp, Homo sapiens; identical to SEQ ID NO: 32139
  misc_feature 1..156: note = chr8:89340081-89340237
  misc_feature 1..156: note = hyper
  source 1..156: mol_type = genomic DNA

SEQ ID NO: 99921 - DNA, 711 bp, Homo sapiens; identical to SEQ ID NO: 32140
  misc_feature 1..711: note = chr8:89340273-89340984
  misc_feature 1..711: note = hyper
  source 1..711: mol_type = genomic DNA

SEQ ID NO: 99922 - DNA, 79 bp, Homo sapiens
  misc_feature 1..79: note = chr8:89687899-89687978
  misc_feature 1..79: note = hypo
  source 1..79: mol_type = genomic DNA
agaggtccataatgacgcatttgtatcccttggaatttaggaagttctagtgccaccagataagcccacgtgtctaatc

SEQ ID NO: 99923 - DNA, 32 bp, Homo sapiens
  misc_feature 1..32: note = chr8:898037-898069
  misc_feature 1..32: note = hypo
  source 1..32: mol_type = genomic DNA
gcgtcatgaccccaccgcgtgtgcgccatggc

SEQ ID NO: 99924 - DNA, 17 bp, Homo sapiens
  misc_feature 1..17: note = chr8:89830498-89830515
  misc_feature 1..17: note = hypo
  source 1..17: mol_type = genomic DNA
gccggaaaacatatgtc

SEQ ID NO: 99925 - DNA, 99 bp, Homo sapiens
  misc_feature 1..99: note = chr8:90768479-90768578
  misc_feature 1..99: note = hypo
  source 1..99: mol_type = genomic DNA
gtctcttcacactgacgcgcgttaacagaatgaatggatagaaaagtcttctgagtactttttaagaaaaaagcttattggccgggcgcggtggctcac

SEQ ID NO: 99926 - DNA, 39 bp, Homo sapiens
  misc_feature 1..39: note = chr8:90768818-90768857
  misc_feature 1..39: note = hypo
  source 1..39: mol_type = genomic DNA
gggtgacagagcacgactccctctcgaaaagaaaaaaaa

SEQ ID NO: 99927 - DNA, 137 bp, Homo sapiens; identical to SEQ ID NO: 1578
  misc_feature 1..137: note = chr8:90913516-90913653
  misc_feature 1..137: note = hypo
  source 1..137: mol_type = genomic DNA

SEQ ID NO: 99928 - DNA, 32 bp, Homo sapiens; identical to SEQ ID NO: 9668
  misc_feature 1..32: note = chr8:91094254-91094286
  misc_feature 1..32: note = hyper
  source 1..32: mol_type = genomic DNA

SEQ ID NO: 99929 - DNA, 450 bp, Homo sapiens
  misc_feature 1..450: note = chr8:91094634-91095084
  misc_feature 1..450: note = hyper
  source 1..450: mol_type = genomic DNA
aaggttttgggattacggtggaaacaatataaactttcaggttgacagtttggcggccagtcggggagataagaagataagattaggcagaagggggaagaagtaaagaatagaaaggagggataatgggatcaggaggctcagaaaagggcaaagaatgggaaggggcatggaaacgggtcttgaaacagttaaaaagagaagataatcaccgtcagcgtcgaaatggagccagatctcgaaaaactgtgaggctgtgatgagggatgactgcaggtgggattctgccattgtacagcggggtgtgtgtctgggtgtgtgaatatgcgtgtgtctgtgtccgcgcgagggggagtgagcaaaagctcagcgtgtgcgcgagtcagggctgcggagggagacctgggcgcgggcgctgccgggcgctgtcctcggtgctgctcagctcag

SEQ ID NO: 99930 - DNA, 64 bp, Homo sapiens
  misc_feature 1..64: note = chr8:91095141-91095205
  misc_feature 1..64: note = hyper
  source 1..64: mol_type = genomic DNA
cggccccaagccgggccacgcctcctccagcctcccattcctcactccccgcctcttgctctca

SEQ ID NO: 99931 - DNA, 26 bp, Homo sapiens
  misc_feature 1..26: note = chr8:91118371-91118397
  misc_feature 1..26: note = hypo
  source 1..26: mol_type = genomic DNA
cttattattgccaggcgcgttggctc

SEQ ID NO: 99932 - DNA, 102 bp, Homo sapiens
  misc_feature 1..102: note = chr8:91130026-91130128
  misc_feature 1..102: note = hypo
  source 1..102: mol_type = genomic DNA
agagcgagactctgcctcaaaaaaaaaaaatcctttttgggtgaatcctttgataacagcttcaattatctttattccaaataatagcgggaattcaaattt

SEQ ID NO: 99933 - DNA, 22 bp, Homo sapiens
  misc_feature 1..22: note = chr8:91163928-91163950
  misc_feature 1..22: note = hypo
  source 1..22: mol_type = genomic DNA
gtaatccctgcacttcggcagg

SEQ ID NO: 99934 - DNA, 187 bp, Homo sapiens
  misc_feature 1..187: note = chr8:91179163-91179350
  misc_feature 1..187: note = hypo
  source 1..187: mol_type = genomic DNA
tggtatctgccacagcgttagagctgaggacatgcttcttttgggagctcacgaccaatgaccaagctcagtggagcacacagtctgaccattctgcccagctcaggactcctctacaggtaactttgtgctgatgttccattgtgctgtcccaggctgttgagagctgcaccgcagtttcctacta

SEQ ID NO: 99935 - DNA, 30 bp, Homo sapiens
  misc_feature 1..30: note = chr8:913030-913060
  misc_feature 1..30: note = hypo
  source 1..30: mol_type = genomic DNA
tgtgcccctctcatccgggactgtgtgggc

SEQ ID NO: 99936 - DNA, 25 bp, Homo sapiens
  misc_feature 1..25: note = chr8:91359129-91359154
  misc_feature 1..25: note = hypo
  source 1..25: mol_type = genomic DNA
tgagccaccacgcctggccttcctt

SEQ ID NO: 99937 - DNA, 36 bp, Homo sapiens
  misc_feature 1..36: note = chr8:91375278-91375314
  misc_feature 1..36: note = hypo
  source 1..36: mol_type = genomic DNA
ataggcgtgagctaccgcgcccgacctgttgttgct

SEQ ID NO: 99938 - DNA, 30 bp, Homo sapiens
  misc_feature 1..30: note = chr8:914330-914360
  misc_feature 1..30: note = hypo
  source 1..30: mol_type = genomic DNA
gtggcgctgtactgtcgtggactctgctgc

SEQ ID NO: 99939 - DNA, 27 bp, Homo sapiens
  misc_feature 1..27: note = chr8:91434639-91434666
  misc_feature 1..27: note = hypo
  source 1..27: mol_type = genomic DNA
atggatcaggccgggcgcagtggctca

SEQ ID NO: 99940 - DNA, 29 bp, Homo sapiens
  misc_feature 1..29: note = chr8:914936-914965
  misc_feature 1..29: note = hypo
  source 1..29: mol_type = genomic DNA
tcgccaccgcacacacggctcctgagccc

SEQ ID NO: 99941 - DNA, 30 bp, Homo sapiens
  misc_feature 1..30: note = chr8:91657391-91657421
  misc_feature 1..30: note = hyper
  source 1..30: mol_type = genomic DNA
ccaccactttcaggccgcttcctccctcca

SEQ ID NO: 99942 - DNA, 44 bp, Homo sapiens
  misc_feature 1..44: note = chr8:91803676-91803720
  misc_feature 1..44: note = hyper
  source 1..44: mol_type = genomic DNA
gctgctcaggacaaacgccctgccattcgtcccttctctctgtc

SEQ ID NO: 99943 - DNA, 189 bp, Homo sapiens; identical to SEQ ID NO: 32144
  misc_feature 1..189: note = chr8:91804064-91804253
  misc_feature 1..189: note = hyper
  source 1..189: mol_type = genomic DNA

SEQ ID NO: 99944 - DNA, 195 bp, Homo sapiens; identical to SEQ ID NO: 41846
  misc_feature 1..195: note = chr8:91865364-91865559
  misc_feature 1..195: note = hypo
  source 1..195: mol_type = genomic DNA

SEQ ID NO: 99945 - DNA, 38 bp, Homo sapiens
  misc_feature 1..38: note = chr8:91887415-91887453
  misc_feature 1..38: note = hypo
  source 1..38: mol_type = genomic DNA
atagatagttgaggccgggcgcggtggctcacgcctgt

SEQ ID NO: 99946 - DNA, 524 bp, Homo sapiens
  misc_feature 1..524: note = chr8:91996985-91997509
  misc_feature 1..524: note = hyper
  source 1..524: mol_type = genomic DNA
ttgaaagcctcccaccgcctggcaccaggtgctggggcagagccaaggggagctgtgtacttagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 99947 - DNA, 479 bp, Homo sapiens; identical to SEQ ID NO: 815
  misc_feature 1..479: note = chr8:91997527-91998006
  misc_feature 1..479: note = hyper
  source 1..479: mol_type = genomic DNA

SEQ ID NO: 99948 - DNA, 99 bp, Homo sapiens; identical to SEQ ID NO: 5080
  misc_feature 1..99: note = chr8:92083523-92083622
  misc_feature 1..99: note = hypo
  source 1..99: mol_type = genomic DNA

SEQ ID NO: 99949 - DNA, 30 bp, Homo sapiens
  misc_feature 1..30: note = chr8:92982980-92983010
  misc_feature 1..30: note = hypo
  source 1..30: mol_type = genomic DNA
ctgttgtgatcatgtcgtgggctttccgct

SEQ ID NO: 99950 - DNA, 204 bp, Homo sapiens
  misc_feature 1..204: note = chr8:93113946-93114150
  misc_feature 1..204: note = hyper
  source 1..204: mol_type = genomic DNA
tttccaagggttgaccgcccttacaaaaaataaaaaatagcacgtttcaaaaaatggatctgagcgccttgtgctgacctagccgtatttgctcaaagcaccccagtcagcgccaggtcccccccgggaaagaggtctgggtgcgccaaccaacccggtcctttcaggttcgcaaagagggcggtgagcggcgggccctggagc

SEQ ID NO: 99951 - DNA, 91 bp, Homo sapiens
  misc_feature 1..91: note = chr8:93114151-93114242
  misc_feature 1..91: note = hyper
  source 1..91: mol_type = genomic DNA
cgtctccactggcccgggggcttcaccagaggggtttctggaaaacgaaaggaattatccggacgtggctccaagtctggaccccttcggg

SEQ ID NO: 99952 - DNA, 834 bp, Homo sapiens
  misc_feature 1..834: note = chr8:93114306-93115140
  misc_feature 1..834: note = hyper
  source 1..834: mol_type = genomic DNA
cgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccacctgccaaatgcactgtgggcacctcgatcggttgttttgtcgggggagaaacccactcgtcatcttcctgctcgcataccgtgactatggagagggaagaaaaattatttttaaaagacactgtggggaatataatagtaaaaactgcatcctcggctgacccgcgaagttcagtgtcatcgcagaccggagtcacccgcgatgttcctctttgccctggtgcgtagtcctaccctaattgagcgacaagtacagcctggagcctcgcggtcgaataatccaaacgaagatgacggtcatcggaacagtaattaataacagtcaggggcccgaccccgccgcccgcccgccggccaagccctaccgcggacacttacactgcacagggccggagagtcccaccatccgccacaggctccgagctgcaaataaa

SEQ ID NO: 99953 - DNA, 535 bp, Homo sapiens
  misc_feature 1..535: note = chr8:93115382-93115917
  misc_feature 1..535: note = hyper
  source 1..535: mol_type = genomic DNA
ctgctcccctcctcccgcctccctccctccctccgcttttctgttgttgctgctgtggcagacaaatgtgatgtggggcgcagggaattgccactgtcacaggcggcgtctgcgtctccctcgcccgccctcgctcactctcgaggaaggcgacgcatttatctgcagggcggccgggcgtccgccggggagcaggagcgccgcgcgctgtgcgccgagagcgcccgcatcaggccggctccggcgcacgctcgcgccaggggcgccgcggccggtcgggagggaggcggctgcgcggccgctaccaggtgcaggggggaggacccgcggcggggcgtgggggaggtggaggtgggagacatctgtgttgtgcgggggtcacggaggtcaagtatatgttaacaatgggcaggcccggcacgctagggcgcgcgggctggcgggcggcctccctcccggcctcgccctctcccatgcaggctggacgtggggttggctccctaatgatgccttcccgggccgccagctctcaggc

SEQ ID NO: 99954 - DNA, 30 bp, Homo sapiens; identical to SEQ ID NO: 41848
  misc_feature 1..30: note = chr8:93449207-93449237
  misc_feature 1..30: note = hypo
  source 1..30: mol_type = genomic DNA

SEQ ID NO: 99955 - DNA, 30 bp, Homo sapiens
  misc_feature 1..30: note = chr8:93509730-93509760
  misc_feature 1..30: note = hypo
  source 1..30: mol_type = genomic DNA
caggaggaattaactcgttgagcatattct

SEQ ID NO: 99956 - DNA, 226 bp, Homo sapiens; identical to SEQ ID NO: 41849
  misc_feature 1..226: note = chr8:93848232-93848458
  misc_feature 1..226: note = hypo
  source 1..226: mol_type = genomic DNA

SEQ ID NO: 99957 - DNA, 69 bp, Homo sapiens
  misc_feature 1..69: note = chr8:93978166-93978235
  misc_feature 1..69: note = hyper
  source 1..69: mol_type = genomic DNA
ttcattcccggaccccgagcttcccgggcagggtctccccaatcccctcgcactcgccggacacacacc

SEQ ID NO: 99958 - DNA, 30 bp, Homo sapiens
  misc_feature 1..30: note = chr8:94237541-94237571
  misc_feature 1..30: note = hypo
  source 1..30: mol_type = genomic DNA
gttttccccagtttgcgattaaacttaatg

SEQ ID NO: 99959 - DNA, 120 bp, Homo sapiens
  misc_feature 1..120: note = chr8:94684333-94684453
  misc_feature 1..120: note = hypo
  source 1..120: mol_type = genomic DNA
tatcacagtgtgtaaacactgcacataattacaaatatcagcgatatgttgtcaatatcacagcgcgtaaacactgtgcgtaattacaaatatcagagtgatatattgtcaatatcacag

SEQ ID NO: 99960 - DNA, 463 bp, Homo sapiens
  misc_feature 1..463: note = chr8:94712418-94712881
  misc_feature 1..463: note = hyper
  source 1..463: mol_type = genomic DNA
gggcctctggtttcacgtctccctcctggtccccggcggaccggcgtcttttctcccctgctcggagtagcctagcagcgctggaggctggctgtctggtaagcgcggctgttagagaggatggaggcgccgtagccccgcggtgcttctcacagccttcgccggcagggacgcgcgggacaaccgcgcaggcggctctgcaggggtgggcgcgccatcacccctctcggtccctgcctgcttggcgctttccgagccccagccgcgctcaggctgcctcgggcattgaccgcgggggcgcgcgccccgtttccatagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatg

SEQ ID NO: 99961 - DNA, 300 bp, Homo sapiens; identical to SEQ ID NO: 32151
  misc_feature 1..300: note = chr8:94713129-94713429
  misc_feature 1..300: note = hyper
  source 1..300: mol_type = genomic DNA

SEQ ID NO: 99962 - DNA, 174 bp, Homo sapiens; identical to SEQ ID NO: 41850
  misc_feature 1..174: note = chr8:95211968-95212142
  misc_feature 1..174: note = hypo
  source 1..174: mol_type = genomic DNA

SEQ ID NO: 99963 - DNA, 194 bp, Homo sapiens
  misc_feature 1..194: note = chr8:95212445-95212639
  misc_feature 1..194: note = hypo
  source 1..194: mol_type = genomic DNA
tggggtaccctgggtcgcaatggtgctgatgggaagccatccttcatcactgaaattgcccgaaaccaccaagccagacacctaggtttcctcaaaaacactacttggaaaagaattgaaatagatttccagaggattctgtggcattttatctgaactacctgtaataattggccaaccgtctgcgtggaatt

SEQ ID NO: 99964 - DNA, 320 bp, Homo sapiens
  misc_feature 1..320: note = chr8:95246683-95247003
  misc_feature 1..320: note = hyper
  source 1..320: mol_type = genomic DNA
aagccagtgtgcagccgcctgtgggtgaggagcttttatgacaatgaatcccgtgttttatgggagggcagtgtggagacagcgcgggccgagtccctgggttccggggcaagactgtgggcgtctcccgcggtgactcagagatgctgccctgcctcacaccatctcgcaccatctctgtggaggccgtgaccttcattcactgccgtctgtcactggggggtgacctcgcagttgtcagagccccctctcctggggctcaggactgggatcacccccgcaacccggcgcttccagcttcatctcggggcgctctgttt

SEQ ID NO: 99965 - DNA, 77 bp, Homo sapiens; identical to SEQ ID NO: 15137
  misc_feature 1..77: note = chr8:95416054-95416131
  misc_feature 1..77: note = hypo
  source 1..77: mol_type = genomic DNA

SEQ ID NO: 99966 - DNA, 30 bp, Homo sapiens; identical to SEQ ID NO: 41852
  misc_feature 1..30: note = chr8:95622883-95622913
  misc_feature 1..30: note = hypo
  source 1..30: mol_type = genomic DNA

SEQ ID NO: 99967 - DNA, 78 bp, Homo sapiens
  misc_feature 1..78: note = chr8:956346-956424
  misc_feature 1..78: note = hypo
  source 1..78: mol_type = genomic DNA
ctgcgtctcaagtctcgcgaggtggtcctttatcacgtcggggacaccatgtgtctgaagtctcgggatgtggtcctt

SEQ ID NO: 99968 - DNA, 26 bp, Homo sapiens
  misc_feature 1..26: note = chr8:95650766-95650792
  misc_feature 1..26: note = hypo
  source 1..26: mol_type = genomic DNA
gccaccgcgcccggcccagaaagatt

SEQ ID NO: 99969 - DNA, 183 bp, Homo sapiens
  misc_feature 1..183: note = chr8:95651327-95651510
  misc_feature 1..183: note = hyper
  source 1..183: mol_type = genomic DNA
gcaccgagagccccacggggaggtggttagggggaaccggctcctccaggcggcctcgcccactgcaatgcaatctgggtggtttttccaggtccctccctgcctcgttccgcgcccagtccctgcccccgcgacgcccgagggcctggacgggtagctcggagttaccggggctggggagga

SEQ ID NO: 99970 - DNA, 119 bp, Homo sapiens
  misc_feature 1..119: note = chr8:95651726-95651845
  misc_feature 1..119: note = hyper
  source 1..119: mol_type = genomic DNA
tctcctaccaggaaacgagacggcgcgggcctcgggctcctctcccccctcccgggagctgaacccccactgggaaagccaggtctccagcttcccttgacacgcgtcttgaaaggtta

SEQ ID NO: 99971 - DNA, 172 bp, Homo sapiens
  misc_feature 1..172: note = chr8:95652419-95652591
  misc_feature 1..172: note = hyper
  source 1..172: mol_type = genomic DNA
gcctgagtttccttgcggggtcccccagctgctttgcgcgcgataactgcgtcctggggagtgactaggtggttgggcgtccagcccctggcgtccggctctgccgcgcgcggggttcctctccggaaggtgggcagcgcggcgggtttgggacgagcgtgcacccgggctc

SEQ ID NO: 99972 - DNA, 49 bp, Homo sapiens
  misc_feature 1..49: note = chr8:95652814-95652863
  misc_feature 1..49: note = hyper
  source 1..49: mol_type = genomic DNA
gccttttcgcttgaccgttcagaaccttcggcttcgttccctgcagccg

SEQ ID NO: 99973 - DNA, 109 bp, Homo sapiens
  misc_feature 1..109: note = chr8:95653342-95653451
  misc_feature 1..109: note = hyper
  source 1..109: mol_type = genomic DNA
ccttcctgccctgggcgtggagcaccgaccaggtgtgggcttgggtggttggttaccgccttttgcactagcagtagcaaggaaggggggtgggcgctctttctttttc

SEQ ID NO: 99974 - DNA, 321 bp, Homo sapiens
  misc_feature 1..321: note = chr8:95654016-95654337
  misc_feature 1..321: note = hyper
  source 1..321: mol_type = genomic DNA
ggcggggggcaggaacgcaccggaaccgatggcgagtcgagagctttgattctgcgtccggaccccaagagaggcgcgggccgccccagcaggggagcgagggaggagggtgcagaaagaggctccgaaattgggggaaactgacccgtgcttctctaccttcggaggtgggacagttgcacgaagtgctagttagaccggatcagttggaactgacggaggactgcaaagaagaaactaaaatagacgtcgaaagcctgtcctcggcgtcgcagctggaccaagccctccgacaggtgacaaccccgggtcacgccaccc

SEQ ID NO: 99975 - DNA, 33 bp, Homo sapiens
  misc_feature 1..33: note = chr8:957089-957122
  misc_feature 1..33: note = hypo
  source 1..33: mol_type = genomic DNA
ttatcatgtcggggacgccgtgtgtctgaagtc

SEQ ID NO: 99976 - DNA, 27 bp, Homo sapiens
  misc_feature 1..27: note = chr8:95816428-95816455
  misc_feature 1..27: note = hypo
  source 1..27: mol_type = genomic DNA
tcaaaaaattaaatgcgggccgggcgc

SEQ ID NO: 99977 - DNA, 21 bp, Homo sapiens
  misc_feature 1..21: note = chr8:95837385-95837406
  misc_feature 1..21: note = hypo
  source 1..21: mol_type = genomic DNA
aaattacgtgctgggcgccgt

SEQ ID NO: 99978 - DNA, 21 bp, Homo sapiens
  misc_feature 1..21: note = chr8:95837646-95837667
  misc_feature 1..21: note = hypo
  source 1..21: mol_type = genomic DNA
aagactcggaaaaaaaaaaaa

SEQ ID NO: 99979 - DNA, 30 bp, Homo sapiens
  misc_feature 1..30: note = chr8:95960767-95960797
  misc_feature 1..30: note = hyper
  source 1..30: mol_type = genomic DNA
ccggtggccgggtcacggagcaggttcccc

SEQ ID NO: 99980 - DNA, 28 bp, Homo sapiens
  misc_feature 1..28: note = chr8:96083320-96083348
  misc_feature 1..28: note = hypo
  source 1..28: mol_type = genomic DNA
aaagcataaggcaaccggccgggcgcgg

SEQ ID NO: 99981 - DNA, 30 bp, Homo sapiens
  misc_feature 1..30: note = chr8:96125751-96125781
  misc_feature 1..30: note = hypo
  source 1..30: mol_type = genomic DNA
gaggtgagaacttggcgggatttcttaagc

SEQ ID NO: 99982 - DNA, 172 bp, Homo sapiens; identical to SEQ ID NO: 41856
  misc_feature 1..172: note = chr8:96208663-96208835
  misc_feature 1..172: note = hypo
  source 1..172: mol_type = genomic DNA

SEQ ID NO: 99983 - DNA, 141 bp, Homo sapiens
  misc_feature 1..141: note = chr8:96219910-96220051
  misc_feature 1..141: note = hypo
  source 1..141: mol_type = genomic DNA
tatagaattccaggagtcagaaattgagtcatccatccaggaatctttattatgcacctgctttgtgtcacacctgctgggaatacagttataattagaccagaatcagctttgggcctcaaagaacgagtggaaagggct

SEQ ID NO: 99984 - DNA, 137 bp, Homo sapiens
  misc_feature 1..137: note = chr8:962438-962575
  misc_feature 1..137: note = hypo
  source 1..137: mol_type = genomic DNA
gtgtggctgcctctgcgggaacttccagcggcagtgtggacaccgtctgaccagccccccacttcagcggcagtgtggacaacgtccgaccagcccccccacttcagcggcagtgtagacaccgtccaaccagcccc

SEQ ID NO: 99985 - DNA, 30 bp, Homo sapiens
  misc_feature 1..30: note = chr8:96314006-96314036
  misc_feature 1..30: note = hypo
  source 1..30: mol_type = genomic DNA
cgggttggtgacttacggattccctatctc

SEQ ID NO: 99986 - DNA, 30 bp, Homo sapiens
  misc_feature 1..30: note = chr8:9638573-9638603
  misc_feature 1..30: note = hypo
  source 1..30: mol_type = genomic DNA
tttatatactttgcacgaccaaatatggtc

SEQ ID NO: 99987 - DNA, 77 bp, Homo sapiens
  misc_feature 1..77: note = chr8:96837358-96837435
  misc_feature 1..77: note = hypo
  source 1..77: mol_type = genomic DNA
actattaccccatgttatatagtaaatttgaagaaaatgaggcttggaaaggcaatgtgactcgaacaaagactgag

SEQ ID NO: 99988 - DNA, 100 bp, Homo sapiens
  misc_feature 1..100: note = chr8:96849941-96850041
  misc_feature 1..100: note = hypo
  source 1..100: mol_type = genomic DNA
tatttggcaagtttttgtagatctaactaagataggaatgtgcagccaaatggaaaaacttattttcaaaagacttggggatgagcgcaacctgaagata

SEQ ID NO: 99989 - DNA, 165 bp, Homo sapiens
  misc_feature 1..165: note = chr8:9686554-9686719
  misc_feature 1..165: note = hypo
  source 1..165: mol_type = genomic DNA
atacaccttcgtctacggatctagccaattgctgctgcctatttaggttttgcctgaatcttgatcaagaatatctgataacctttcctgctttgttttatttgaaaacattgtaaactcaaaagggctttttaagtcacctctggcctccgccctccgagcggc

SEQ ID NO: 99990 - DNA, 98 bp, Homo sapiens
  misc_feature 1..98: note = chr8:97039387-97039485
  misc_feature 1..98: note = hypo
  source 1..98: mol_type = genomic DNA
aaatatttcaatcatcgaagagtcaattgatgtgaccaacttcattgttattgtattttaagaaacaaggctaggcacggtggctcacgcctgttatc

SEQ ID NO: 99991 - DNA, 23 bp, Homo sapiens
  misc_feature 1..23: note = chr8:97095168-97095191
  misc_feature 1..23: note = hypo
  source 1..23: mol_type = genomic DNA
gctgggcgtggagggcgtggtgg

SEQ ID NO: 99992 - DNA, 38 bp, Homo sapiens
  misc_feature 1..38: note = chr8:97145516-97145554
  misc_feature 1..38: note = hyper
  source 1..38: mol_type = genomic DNA
tgaaaaggaaggagacggcagttcgggtcattagaagg

SEQ ID NO: 99993 - DNA, 246 bp, Homo sapiens
  misc_feature 1..246: note = chr8:97156964-97157210
  misc_feature 1..246: note = hyper
  source 1..246: mol_type = genomic DNA
ggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 99994 - DNA, 232 bp, Homo sapiens; identical to SEQ ID NO: 817
  misc_feature 1..232: note = chr8:97157666-97157898
  misc_feature 1..232: note = hyper
  source 1..232: mol_type = genomic DNA

SEQ ID NO: 99995 - DNA, 134 bp, Homo sapiens; identical to SEQ ID NO: 32156
  misc_feature 1..134: note = chr8:97158021-97158155
  misc_feature 1..134: note = hyper
  source 1..134: mol_type = genomic DNA

SEQ ID NO: 99996 - DNA, 511 bp, Homo sapiens
  misc_feature 1..511: note = chr8:97165624-97166135
  misc_feature 1..511: note = hyper
  source 1..511: mol_type = genomic DNA
agatgaaacccaaaccgaagctctcgtactgttcccgcgctgagccctccctccccatctcactgaggcgcgcacgcggcctgcccttcccctggggccgggacctggggggttggctaggggcggccttccctgcactgtcgaccggtaagtcacccgggagcccaggggagcaaccaggtcctccacgaaggctaggggagcggaaagggaggaatcctcaaactgccatcggagctggaatatgatcgggctgcatggcttcagttttgagatcaaaagtagaaggaagggtgttcattttatgtgacttccgctccctgaccagttctgagcttgcaggtgggggcgagggttcaaactggcttgtagtcgcggggaggatattggactcagcacccaggggtcctgcgcaggagaaaccgctgtgctgtgctctttaaggtgctgggccgtgtgcagtctgggaggaagggagagccgcaatctctgtctgcggtgttcatttagg

SEQ ID NO: 99997 - DNA, 91 bp, Homo sapiens
  misc_feature 1..91: note = chr8:97166425-97166516
  misc_feature 1..91: note = hyper
  source 1..91: mol_type = genomic DNA
ccctggcctctttcacgcccactctcgggtccctaaaccatgccccgcccccaggcgccggggccactagcgccgccgcgcgcgcttccct

SEQ ID NO: 99998 - DNA, 30 bp, Homo sapiens
  misc_feature 1..30: note = chr8:97166873-97166903
  misc_feature 1..30: note = hyper
  source 1..30: mol_type = genomic DNA
tacccgaggggttatcgaactaatggcttt

SEQ ID NO: 99999 - DNA, 45 bp, Homo sapiens; identical to SEQ ID NO: 32159
  misc_feature 1..45: note = chr8:97167178-97167223
  misc_feature 1..45: note = hyper
  source 1..45: mol_type = genomic DNA

SEQ ID NO: 100000 - DNA, 212 bp, Homo sapiens; identical to SEQ ID NO: 32160
  misc_feature 1..212: note = chr8:97169708-97169920
  misc_feature 1..212: note = hyper
  source 1..212: mol_type = genomic DNA

SEQ ID NO: 100001 - DNA, 35 bp, Homo sapiens; identical to SEQ ID NO: 32161
  misc_feature 1..35: note = chr8:97169921-97169956
  misc_feature 1..35: note = hyper
  source 1..35: mol_type = genomic DNA

SEQ ID NO: 100002 - DNA, 285 bp, Homo sapiens; identical to SEQ ID NO: 32162
  misc_feature 1..285: note = chr8:97170053-97170338
  misc_feature 1..285: note = hyper
  source 1..285: mol_type = genomic DNA

SEQ ID NO: 100003 - DNA, 888 bp, Homo sapiens
  misc_feature 1..888: note = chr8:97170377-97171265
  misc_feature 1..888: note = hyper
  source 1..888: mol_type = genomic DNA
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccggggaagagctcggggctgggggcgggggggccgttagcctgctctaaaaagcttaagagatgtg

SEQ ID NO: 100004 - DNA, 642 bp, Homo sapiens
  misc_feature 1..642: note = chr8:97171317-97171959
  misc_feature 1..642: note = hyper
  source 1..642: mol_type = genomic DNA
cgctgcaaggtttccgggcaaccccacttaactgggagcaggtcaaagtcatggagctaagtctagggaggatggaggagtggatatctgcctaaatcgcttttatcccgtcattttcttccttccttctctttactcttcctttcctttttctcccttcctttcctgtctccttccacattattgtctctctcctttaggagcttagtttccgatgcctgtggatccttccctgatttctgggaccagaggtggtgcgaggttttcttgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 100005 - DNA, 722 bp, Homo sapiens; identical to SEQ ID NO: 824
  misc_feature 1..722: note = chr8:97172018-97172740
  misc_feature 1..722: note = hyper
  source 1..722: mol_type = genomic DNA

SEQ ID NO: 100006 - DNA, 140 bp, Homo sapiens; identical to SEQ ID NO: 32166
  misc_feature 1..140: note = chr8:97172821-97172961
  misc_feature 1..140: note = hyper
  source 1..140: mol_type = genomic DNA

SEQ ID NO: 100007 - DNA, 564 bp, Homo sapiens; identical to SEQ ID NO: 32167
  misc_feature 1..564: note = chr8:97172962-97173526
  misc_feature 1..564: note = hyper
  source 1..564: mol_type = genomic DNA

SEQ ID NO: 100008 - DNA, 337 bp, Homo sapiens
  misc_feature 1..337: note = chr8:97173527-97173864
  misc_feature 1..337: note = hyper
  source 1..337: mol_type = genomic DNA
gtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctct

SEQ ID NO: 100009 - DNA, 30 bp, Homo sapiens
  misc_feature 1..30: note = chr8:972233-972263
  misc_feature 1..30: note = hypo
  source 1..30: mol_type = genomic DNA
ggtagacactccagccgccacccatcctcc

SEQ ID NO: 100010 - DNA, 46 bp, Homo sapiens
  misc_feature 1..46: note = chr8:9722850-9722896
  misc_feature 1..46: note = hypo
  source 1..46: mol_type = genomic DNA
cataatagccccaaacggcaaataacccaaacgctcaacaacagaa

SEQ ID NO: 100011 - DNA, 145 bp, Homo sapiens; identical to SEQ ID NO: 41655
  misc_feature 1..145: note = chr8:972705-972850
  misc_feature 1..145: note = hypo
  source 1..145: mol_type = genomic DNA

SEQ ID NO: 100012 - DNA, 29 bp, Homo sapiens
  misc_feature 1..29: note = chr8:97272421-97272450
  misc_feature 1..29: note = hypo
  source 1..29: mol_type = genomic DNA
ctcggcccattctgcgatgattttagaaa

SEQ ID NO: 100013 - DNA, 497 bp, Homo sapiens
  misc_feature 1..497: note = chr8:97339742-97340239
  misc_feature 1..497: note = hypo
  source 1..497: mol_type = genomic DNA
actcaggagtagaggcgaacattattcaataagagagcttcaagttacaccatgccttctgccccactcagaaaagcaaagcccctaattactcccctggcctggtaagagagcgcacacggagcttgagattaatgcagaagcaaagatcccgggtgctggttaataagcttttccaggagcgtggttgtctgctcggccgtcattaatttgaatgctcattaccataatgtagaagccaagctggggtcctgcgccctccttgccgccagccccgtggtcctggacagcctggctctcatcccacgtagtttcttctcgcccccccgccctttctttaaacgaagtgtgcaattgctattttaaatctgagccttgacattttcagtgggtacgtgcctagatttccacaggtgtgattgcaaacctgtaaattaccggcttccgtttgctgggacaagtgtaaaatgggcctctttgtacgcaggtgaagtaga

SEQ ID NO: 100014 - DNA, 118 bp, Homo sapiens
  misc_feature 1..118: note = chr8:97505645-97505763
  misc_feature 1..118: note = hyper
  source 1..118: mol_type = genomic DNA
aaagagaaaagacaacggggaagaaaagagcatagaggagagaggaaaagtggggagagaaaggaagaaaaggactgagaaaacgcaggagccctggcttgccggtgagcagagccgg

SEQ ID NO: 100015 - DNA, 248 bp, Homo sapiens
  misc_feature 1..248: note = chr8:97505801-97506049
  misc_feature 1..248: note = hyper
  source 1..248: mol_type = genomic DNA
cggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccc

SEQ ID NO: 100016 - DNA, 231 bp, Homo sapiens; identical to SEQ ID NO: 3340
  misc_feature 1..231: note = chr8:97506177-97506408
  misc_feature 1..231: note = hyper
  source 1..231: mol_type = genomic DNA

SEQ ID NO: 100017 - DNA, 1281 bp, Homo sapiens
  misc_feature 1..1281: note = chr8:97506447-97507728
  misc_feature 1..1281: note = hyper
  source 1..1281: mol_type = genomic DNA
cgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaagcttgagcaccccagatttcgtctgcagcctcag

SEQ ID NO: 100018 - DNA, 30 bp, Homo sapiens
  misc_feature 1..30: note = chr8:9751525-9751555
  misc_feature 1..30: note = hypo
  source 1..30: mol_type = genomic DNA
aaaaaaaaaaataagcgaggctaccaacct

SEQ ID NO: 100019 - DNA, 30 bp, Homo sapiens
  misc_feature 1..30: note = chr8:975257-975287
  misc_feature 1..30: note = hypo
  source 1..30: mol_type = genomic DNA
tctttcacactcccccgacctggatccccg

SEQ ID NO: 100020 - DNA, 312 bp, Homo sapiens
  misc_feature 1..312: note = chr8:9755972-9756284
  misc_feature 1..312: note = hyper
  source 1..312: mol_type = genomic DNA
cgctccctggccgggtcactgggggtatccgggagaggaggctggatgtatgggcggggcgtcctaatggggaatccaggaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 100021 - DNA, 29 bp, Homo sapiens
  misc_feature 1..29: note = chr8:9756486-9756515
  misc_feature 1..29: note = hyper
  source 1..29: mol_type = genomic DNA
cgctagagtgaaatcgatgtgcatggaaa

SEQ ID NO: 100022 - DNA, 420 bp, Homo sapiens
  misc_feature 1..420: note = chr8:9760735-9761155
  misc_feature 1..420: note = hyper
  source 1..420: mol_type = genomic DNA
cacctccccaccccacgggctccggtgcgggacaggcagccggagggagctccagacccctcccctcgcgcccgcggccgctgcgcggaggtctgcggagggcgcctggctcggtcggtcgctccttccttggcgggccctcgccgacccacggtgctcagccagccccattcttggcattcaccgcgtgccttaattgtatggacatttaaatcaaggtccgctgtgaacacggagagagaggcctttctcctgaggaaggaaaggaggaaggaaggaaggaaaggtgaaagaaaggaagaggggtgggtagaagatggaataagaaaaccaggaaaaagaaataaaaagcggcgcgtgtgcgtgcgcactgacagcggggagagggatgggggtggggaacgccggaggaagggacca

SEQ ID NO: 100023 - DNA, 324 bp, Homo sapiens
  misc_feature 1..324: note = chr8:9761415-9761739
  misc_feature 1..324: note = hyper
  source 1..324: mol_type = genomic DNA
cccacctcgccccagcgcagcaacccacccacccatgtcgccctctgcttcgcccaggaaactgaaggggactaggaggaggaagaagagagcgaaggacaaggagagcagcggggactcggcagcggcagccggggcagggcgcgcggccgccgcctctttacctccatcgctgagtgggggcgcagccgggccgggcgtgccgcaggggcgagttgccgcggtccggggctgggacctggggattcagccttccggaactcgcctgctgcagtcctctcgctcaggtcccaagtggtggaggggggaaaggaagagagacga

SEQ ID NO: 100024 - DNA, 504 bp, Homo sapiens
  misc_feature 1..504: note = chr8:9761799-9762303
  misc_feature 1..504: note = hyper
  source 1..504: mol_type = genomic DNA
accataagagcgaggcccatctggcccctcatcagctttgtcaagtcttgcatacgctaaaatgctaatgacctagatagctcatgcaaaatgcagcagggagggcgggagcgagggaggtgggagggaggaagagagaggagtgcaggggggagggagggaggagaggcggagggagggagagagggagagagcacccctacactctccccaccccacccccaactgtcagcgggctttaccaggtaaagggtggacgtagatttaaaaggtcactcgtgtataatgcggctggatccccgggtcaaaaaaagggggcgagacagaggatgagagtccctaaagccaaaaggacaataagacatcattttaagcccccacccccatgccctcctccacctctccacactgtttacacacaaatcctgtcgccgcctcatgcatgtgcacggacatgtcaatttctcatcaatttctcagcgctcctatcgacagacacccgaa

SEQ ID NO: 100025 - DNA, 104 bp, Homo sapiens; identical to SEQ ID NO: 3195
  misc_feature 1..104: note = chr8:9762586-9762690
  misc_feature 1..104: note = hyper
  source 1..104: mol_type = genomic DNA

SEQ ID NO: 100026 - DNA, 126 bp, Homo sapiens; identical to SEQ ID NO: 41656
  misc_feature 1..126: note = chr8:976259-976385
  misc_feature 1..126: note = hypo
  source 1..126: mol_type = genomic DNA

SEQ ID NO: 100027 - DNA, 1011 bp, Homo sapiens
  misc_feature 1..1011: note = chr8:9762751-9763762
  misc_feature 1..1011: note = hyper
  source 1..1011: mol_type = genomic DNA
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgtcgagcgcggattgcaggggatgaggaagaagggggaggggaggggagggtggaggagggagggggaggggtagaggggaaggcagagagggacagagagaattgggagccttttaatttttccttaccaagccctaatctcgtgcgccgtcctctttggctgaggtcgagctcctttttaaaaattattactcctttaaaggattattcaggtaaaggaagccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 100028 - DNA, 263 bp, Homo sapiens; identical to SEQ ID NO: 3198
  misc_feature 1..263: note = chr8:9763787-9764050
  misc_feature 1..263: note = hyper
  source 1..263: mol_type = genomic DNA

SEQ ID NO: 100029 - DNA, 891 bp, Homo sapiens
  misc_feature 1..891: note = chr8:9764195-9765086
  misc_feature 1..891: note = hyper
  source 1..891: mol_type = genomic DNA
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctt

SEQ ID NO: 100030 - DNA, 321 bp, Homo sapiens
  misc_feature 1..321: note = chr8:97657790-97658111
  misc_feature 1..321: note = hyper
  source 1..321: mol_type = genomic DNA
ctggctggggagcggcgggttgggagcctgtggctgccccttcggtgacagtggagtcaccgagcctagaaatggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgct

SEQ ID NO: 100031 - DNA, 180 bp, Homo sapiens
  misc_feature 1..180: note = chr8:977877-978057
  misc_feature 1..180: note = hypo
  source 1..180: mol_type = genomic DNA
tccaggtggggtgccaggcgcccgttattctccaggtggggtgctcggtgcctgttattctccaggtgcggtgccaggcgctcgttattctctaggtggggtgtcaggcgcccattattctccaggagcagtgccaggtgccggttactctccaggtagggtgctcggtgcccattattc

SEQ ID NO: 100032 - DNA, 32 bp, Homo sapiens
  misc_feature 1..32: note = chr8:97819738-97819770
  misc_feature 1..32: note = hypo
  source 1..32: mol_type = genomic DNA
gcttgagccaccgcgcccggctgaaaactact

SEQ ID NO: 100033 - DNA, 163 bp, Homo sapiens
  misc_feature 1..163: note = chr8:97982654-97982817
  misc_feature 1..163: note = hypo
  source 1..163: mol_type = genomic DNA
aagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacgga

SEQ ID NO: 100034 - DNA, 43 bp, Homo sapiens
  misc_feature 1..43: note = chr8:97983057-97983100
  misc_feature 1..43: note = hypo
  source 1..43: mol_type = genomic DNA
tgggattacaggcgtgagccaccgcgcccggccactcttaagt

SEQ ID NO: 100035 - DNA, 50 bp, Homo sapiens; identical to SEQ ID NO: 828
  misc_feature 1..50: note = chr8:98289818-98289868
  misc_feature 1..50: note = hyper
  source 1..50: mol_type = genomic DNA

SEQ ID NO: 100036 - DNA, 464 bp, Homo sapiens
  misc_feature 1..464: note = chr8:98289922-98290386
  misc_feature 1..464: note = hyper
  source 1..464: mol_type = genomic DNA
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgctctcagggtc

SEQ ID NO: 100037 - DNA, 30 bp, Homo sapiens
  misc_feature 1..30: note = chr8:98307773-98307803
  misc_feature 1..30: note = hypo
  source 1..30: mol_type = genomic DNA
ccaggaatgtttcaccgatggctggcactt

SEQ ID NO: 100038 - DNA, 34 bp, Homo sapiens
  misc_feature 1..34: note = chr8:98404798-98404832
  misc_feature 1..34: note = hypo
  source 1..34: mol_type = genomic DNA
aggtgtgatccaccacgcccggccacctctaacc

SEQ ID NO: 100039 - DNA, 30 bp, Homo sapiens
  misc_feature 1..30: note = chr8:987146-987176
  misc_feature 1..30: note = hypo
  source 1..30: mol_type = genomic DNA
ttcagtccttcctgccgcctgcacccaggg

SEQ ID NO: 100040 - DNA, 30 bp, Homo sapiens; identical to SEQ ID NO: 15140
  misc_feature 1..30: note = chr8:98738336-98738366
  misc_feature 1..30: note = hypo
  source 1..30: mol_type = genomic DNA

SEQ ID NO: 100041 - DNA, 39 bp, Homo sapiens
  misc_feature 1..39: note = chr8:98748495-98748534
  misc_feature 1..39: note = hypo
  source 1..39: mol_type = genomic DNA
agactgggcgacagagcgagactccgtctcaaaagagga

SEQ ID NO: 100042 - DNA, 28 bp, Homo sapiens
  misc_feature 1..28: note = chr8:98787775-98787803
  misc_feature 1..28: note = hyper
  source 1..28: mol_type = genomic DNA
aagggaagaaaatcgcaaggaactagac

SEQ ID NO: 100043 - DNA, 152 bp, Homo sapiens
  misc_feature 1..152: note = chr8:98788285-98788437
  misc_feature 1..152: note = hyper
  source 1..152: mol_type = genomic DNA
ttgtgctgccatgtccgcaccggcaccatcctgctcggcgtctggtatctggtgagcgcggcgcgcccggcccgggaccctgcgttgcttccgcgcccctagctgggcttctggcccggcctcgcggtggggtgaggcgtgcgctcatccgc

SEQ ID NO: 100044 - DNA, 213 bp, Homo sapiens
  misc_feature 1..213: note = chr8:98788792-98789005
  misc_feature 1..213: note = hyper
  source 1..213: mol_type = genomic DNA
ggatttgtcaatgctcgttctccctggccgcgtctccgctagggtggcctgcgctttcacgccgtcgcacgttcggatcccgagttgaagtggttgggagttcttggcatcctcttgtgaatgggtcccccccccgatgttttaaagcccttactccaggaagggatgtgagtgtgatttactgcgtttccatctgcccggggaagccatttt

SEQ ID NO: 100045 - DNA, 30 bp, Homo sapiens
  misc_feature 1..30: note = chr8:98881022-98881052
  misc_feature 1..30: note = hyper
  source 1..30: mol_type = genomic DNA
aagctgcctgtgttccgtgcctgcggctcc

SEQ ID NO: 100046 - DNA, 67 bp, Homo sapiens
  misc_feature 1..67: note = chr8:98881817-98881884
  misc_feature 1..67: note = hyper
  source 1..67: mol_type = genomic DNA
gggacgcccagaccccggccaccgcgacccagggaaagggagacctgttgagcgggtatgcagggtg

SEQ ID NO: 100047 - DNA, 94 bp, Homo sapiens; identical to SEQ ID NO: 9694
  misc_feature 1..94: note = chr8:99076589-99076683
  misc_feature 1..94: note = hyper
  source 1..94: mol_type = genomic DNA

SEQ ID NO: 100048 - DNA, 535 bp, Homo sapiens
  misc_feature 1..535: note = chr8:99076759-99077294
  misc_feature 1..535: note = hyper
  source 1..535: mol_type = genomic DNA
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactccccaggaggtccaaagggtgtgtcccgtggccaccccgcctggcaggagccgggccttgtcccggaggatgcgagcagaacccgggacaaagcgcgatttccttccaaatctggagcggcgctgctgtgaccgcgggtgcggcggccctggtgcgctccgcggcgctcgctgcgagacgcgcggggcccgaggccgggcgctggattcaccctgtccgctgatgggatctcggggagttggtgttgaggccctaaggcggttagcctcggcattgccttaaa

SEQ ID NO: 100049 - DNA, 78 bp, Homo sapiens
  misc_feature 1..78: note = chr8:99130933-99131011
  misc_feature 1..78: note = hypo
  source 1..78: mol_type = genomic DNA
gtaaccattatgcccggcctcattttttttctttcccttgtcctgtttcctattgtgctgtaccgcataatttagtat

SEQ ID NO: 100050 - DNA, 1564 bp, Homo sapiens
  misc_feature 1..1564: note = chr8:99438813-99440377
  misc_feature 1..1564: note = hyper
  source 1..1564: mol_type = genomic DNA
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaagcgcagagaagcagcggcggcggcggctgcgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtaagcgcttccagaacgcgcagggcgagcccgggcagccccgctgggtgaggcgcagcgcacgcggccccggggcatagcgccaggccggcagggagacctgggccggggacgcgggggctgcaggcgtgggatctggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctgga

SEQ ID NO: 100051 - DNA, 30 bp, Homo sapiens
  misc_feature 1..30: note = chr8:9993158-9993188
  misc_feature 1..30: note = hypo
  source 1..30: mol_type = genomic DNA
cattctgtgcattcgcgtgcccctatgcta

SEQ ID NO: 100052 - DNA, 224 bp, Homo sapiens
  misc_feature 1..224: note = chr8:99950717-99950941
  misc_feature 1..224: note = hyper
  source 1..224: mol_type = genomic DNA
ggtgacaaatcaggacgccaatgctggatgcacttgaaggtggagagctaggcagattgaggcagcaggaagcagggtgggagccagtgtgcaccaagtgggtgaggggaacatgtgagtcagttccagctgtcctcagaccctcctgcccagcctcagggtaatccaggggcacagagactctgagccctggcccacccgtggtccctcggattttgacactc

SEQ ID NO: 100053 - DNA, 110 bp, Homo sapiens
  misc_feature 1..110: note = chr8:99951392-99951502
  misc_feature 1..110: note = hyper
  source 1..110: mol_type = genomic DNA
gcagatgcgtttatgcgtgcattctctcgagtgaaggaagaaggaagaggtagggacggaggaggagagagagcacgcgcgggaaagataaatcgcgcccgcccgcgatg

SEQ ID NO: 100054 - DNA, 347 bp, Homo sapiens
  misc_feature 1..347: note = chr8:99951797-99952144
  misc_feature 1..347: note = hyper
  source 1..347: mol_type = genomic DNA
aaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 100055 - DNA, 106 bp, Homo sapiens; identical to SEQ ID NO: 832
  misc_feature 1..106: note = chr8:99952198-99952304
  misc_feature 1..106: note = hyper
  source 1..106: mol_type = genomic DNA

SEQ ID NO: 100056 - DNA, 401 bp, Homo sapiens; identical to SEQ ID NO: 32188
  misc_feature 1..401: note = chr8:99952532-99952933
  misc_feature 1..401: note = hyper
  source 1..401: mol_type = genomic DNA

SEQ ID NO: 100057 - DNA, 169 bp, Homo sapiens
  misc_feature 1..169: note = chr8:99952968-99953137
  misc_feature 1..169: note = hyper
  source 1..169: mol_type = genomic DNA
cgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggaga

SEQ ID NO: 100058 - DNA, 407 bp, Homo sapiens
  misc_feature 1..407: note = chr8:99954156-99954563
  misc_feature 1..407: note = hyper
  source 1..407: mol_type = genomic DNA
gcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggcca

SEQ ID NO: 100059 - DNA, 84 bp, Homo sapiens; identical to SEQ ID NO: 32191
  misc_feature 1..84: note = chr8:99954678-99954762
  misc_feature 1..84: note = hyper
  source 1..84: mol_type = genomic DNA

SEQ ID NO: 100060 - DNA, 128 bp, Homo sapiens
  misc_feature 1..128: note = chr8:99955180-99955308
  misc_feature 1..128: note = hyper
  source 1..128: mol_type = genomic DNA
aggatattaaacactcgaatctccgtttcaagctcactttttaatctttgcgaacttaaaattggaaagacagaaaaaaaatctgcgacccctgttatgttttaccaaaggaacgaaaaattctctcc

SEQ ID NO: 100061 - DNA, 50 bp, Homo sapiens
  misc_feature 1..50: note = chr8:99955973-99956023
  misc_feature 1..50: note = hyper
  source 1..50: mol_type = genomic DNA
caagttggtttactgcgtatgaaatgaacatttgccgattaaagcttaaa

SEQ ID NO: 100062 - DNA, 423 bp, Homo sapiens
  misc_feature 1..423: note = chr8:99957286-99957709
  misc_feature 1..423: note = hyper
  source 1..423: mol_type = genomic DNA
gatatttaatctaagcggtcagcaagacttcttataaaagctggtctacgtacactgagatcaaaccccacaatcccatggtgtttctgctcctgccctagcaagcctgggtcgacttgtcccggggcagccgcggcagcgcagcgtggacgggcccggacacccggtgcctgcccagccagcgacgctgaaggcacatttcaagagggaaatagttcagtcctcggtaatttgtcaacctcgtgctggctttaaaattctcctcccaccttctagtcctgactgagggggcccaaaagcaaactccccgggggcttaaacgctcggattcctgagaaacggcaagtgagaaaggagttgcagttgtacgaagaaggagcgaggaaaaggtgtttgtggagggagccccggatctgtcttcct

SEQ ID NO: 100063 - DNA, 450 bp, Homo sapiens; identical to SEQ ID NO: 32196
  misc_feature 1..450: note = chr8:99960048-99960498
  misc_feature 1..450: note = hyper
  source 1..450: mol_type = genomic DNA

SEQ ID NO: 100064 - DNA, 253 bp, Homo sapiens
  misc_feature 1..253: note = chr8:99960921-99961174
  misc_feature 1..253: note = hyper
  source 1..253: mol_type = genomic DNA
gcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcc

SEQ ID NO: 100065 - DNA, 649 bp, Homo sapiens
  misc_feature 1..649: note = chr8:99961568-99962217
  misc_feature 1..649: note = hyper
  source 1..649: mol_type = genomic DNA
cgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacaggtgaggcgggcaaggaggatggctgggagagggaaagcgaatttgtcctggacacaccgagtcctgatagacattcccagtgtcattataatcccctgtgatctaaaatacaccctcagtcacgctcctcagcccggttcagctaattcccaacatctaccctttctttcccccagcggctcttgctacgttcttgtttggaatgagggagggcctttcctcagtcttggacaggaacaatctgttggccttagtcctgggatggttatcctgtctcctcccggtgctgtggggagtggtgcaggcagaacccaggtaccctggggtgccggtcctggctgcagtcgggctacttctgttgggtttcgtccctccccccac

SEQ ID NO: 100066 - DNA, 274 bp, Homo sapiens
  misc_feature 1..274: note = chr8:99963588-99963862
  misc_feature 1..274: note = hyper
  source 1..274: mol_type = genomic DNA
ggaagattaggagcacggatttgttcctgcaagtctcctcttttgttgtcatgagagtgttatgttaacgcttgtgataacgataagacagaaactattgaaaagggtgcagtggtggtgtgaaggattaatcctttgcttgcttcacatctgaacaggaatctccacacaaatgtcccacatgtggaagaacctttaatcagagaagtaatctgaaaactcaccttctcacccatacagacatcaagccctacagctgcgagcagtgcggcaa

SEQ ID NO: 100067 - DNA, 199 bp, Homo sapiens; identical to SEQ ID NO: 32200
  misc_feature 1..199: note = chr8:99985845-99986044
  misc_feature 1..199: note = hyper
  source 1..199: mol_type = genomic DNA

SEQ ID NO: 100068 - DNA, 302 bp, Homo sapiens; identical to SEQ ID NO: 835
  misc_feature 1..302: note = chr8:99986225-99986527
  misc_feature 1..302: note = hyper
  source 1..302: mol_type = genomic DNA

SEQ ID NO: 100069 - DNA, 229 bp, Homo sapiens
  misc_feature 1..229: note = chr8:99986791-99987020
  misc_feature 1..229: note = hyper
  source 1..229: mol_type = genomic DNA
cgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttgagtgacccgattcggaccttaggggcgttagggtctcctccaccgcctccctcccctgttaaaa

SEQ ID NO: 100070 - DNA, 94 bp, Homo sapiens
  misc_feature 1..94: note = chr8:99987080-99987174
  misc_feature 1..94: note = hyper
  source 1..94: mol_type = genomic DNA
attttagatatgctgacataggcacttaaaggaagggtgtaaggcagacattctaatccttgactatctgtgaagggctcgcctatgattgcca

SEQ ID NO: 100071 - DNA, 132 bp, Homo sapiens
  misc_feature 1..132: note = chr9:100000368-100000500
  misc_feature 1..132: note = hyper
  source 1..132: mol_type = genomic DNA
taaaagacatgcaaacgcccttaaccgctaagctcctgaggggtaacggtatgctacaaaagtgcttctgagctactactcctggaggcttggtccgagtgaccgcagcagtgggcgcggtggaagagaagg

SEQ ID NO: 100072 - DNA, 355 bp, Homo sapiens
  misc_feature 1..355: note = chr9:100000739-100001094
  misc_feature 1..355: note = hyper
  source 1..355: mol_type = genomic DNA
ccccttgggcggtggcggagctgataagcgcgctagtagcagctctggcagaagcaacggtggcttcgagggatggcggcggctgcaacaggacctgcagcatcccagaggtgcgtgtttttccttccctttgctatttattttatcccctttccttggctagtgggtcctgctgaagtcgttgttttcctgagaggttttttccagagcttctcagatgctctaatccactgcggcgttagaggtgagagagccttttctgcttcctccacccctggctgacgcgcctcctcccagcagcacctgattgggacccagggtcctgtggttactgcgtgtccgccccagtattgag

SEQ ID NO: 100073 - DNA, 172 bp, Homo sapiens
  misc_feature 1..172: note = chr9:100264699-100264871
  misc_feature 1..172: note = hyper
  source 1..172: mol_type = genomic DNA
gaaagagcttggaggcgggagccccaggttgtcgccggctctcggcatggccttggcaatccccctcttgtttctggatctcagtctcccatttgtaggggcgaggtttggtagccgcgatggagctgggagcccaagccctgagagctgcagggcgcgctcttggccgcct

SEQ ID NO: 100074 - DNA, 39 bp, Homo sapiens
  misc_feature 1..39: note = chr9:100267685-100267724
  misc_feature 1..39: note = hypo
  source 1..39: mol_type = genomic DNA
tggtgaccccagggccgtttctagcgatgattctggagg

SEQ ID NO: 100075 - DNA, 30 bp, Homo sapiens
  misc_feature 1..30: note = chr9:100278507-100278537
  misc_feature 1..30: note = hypo
  source 1..30: mol_type = genomic DNA
caggcaggggctgggcgctgagatgtgcag

SEQ ID NO: 100076 - DNA, 77 bp, Homo sapiens
  misc_feature 1..77: note = chr9:100349303-100349380
  misc_feature 1..77: note = hypo
  source 1..77: mol_type = genomic DNA
gctcctccccaccacttggcataattctatggagattcatccaagttgttgcatgtaccaatcgtttgctctttttc

SEQ ID NO: 100077 - DNA, 317 bp, Homo sapiens; identical to SEQ ID NO: 42169
  misc_feature 1..317: note = chr9:100397395-100397712
  misc_feature 1..317: note = hypo
  source 1..317: mol_type = genomic DNA

SEQ ID NO: 100078 - DNA, 151 bp, Homo sapiens
  misc_feature 1..151: note = chr9:100457244-100457395
  misc_feature 1..151: note = hypo
  source 1..151: mol_type = genomic DNA
tcagatactatgttgcgcaaaaaaagccagatactgtatgactcaatgtacatgaagtttggaaataggtaataccaatcaaatggtcagaagagtattacttctgagagtagagagtggacaccgactaggaaggcgcaataggaaaact

SEQ ID NO: 100079 - DNA, 527 bp, Homo sapiens
  misc_feature 1..527: note = chr9:100503433-100503960
  misc_feature 1..527: note = hyper
  source 1..527: mol_type = genomic DNA
gtcctgggagaagggcggaaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagcgcgacgggcgccatcccttccag

SEQ ID NO: 100080 - DNA, 77 bp, Homo sapiens
  misc_feature 1..77: note = chr9:100610058-100610135
  misc_feature 1..77: note = hyper
  source 1..77: mol_type = genomic DNA
tgggcaactggaacccggctggagtgtgcagctggccccctcacttccagcccgcaggctgccgcgggggtgactcc

SEQ ID NO: 100081 - DNA, 280 bp, Homo sapiens
  misc_feature 1..280: note = chr9:100610200-100610480
  misc_feature 1..280: note = hyper
  source 1..280: mol_type = genomic DNA
cggcgaaacctagagagacttgcactccaggcccggggggtgggggggcgggggagaagccttagggagagtggggaggaggccagaggagagctggctgctctctcgtgttgaggttcaagtgtcttccagctccccgcgccccctcctcaccgtgccaccgcccacctcatgctttgggcgccaagcagccaagcaaccgggttgcgttgtagggggaggcaatcagccctgttacccctcctcaggcggccggactgagctgcgggatgggatccct

SEQ ID NO: 100082 - DNA, 136 bp, Homo sapiens
  misc_feature 1..136: note = chr9:100610681-100610817
  misc_feature 1..136: note = hyper
  source 1..136: mol_type = genomic DNA
caagtgttccaaagccgcgcacaaatttcggaaccagaccaagaatcctggactctagacgttgcctgggggccgatcctgcgcccagggtcccagaatctaactgaaatgcgcctgcgggccgccaccttcgccc

SEQ ID NO: 100083 - DNA, 539 bp, Homo sapiens
  misc_feature 1..539: note = chr9:100611124-100611663
  misc_feature 1..539: note = hyper
  source 1..539: mol_type = genomic DNA
gggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatcaccttgactcggtggaagagaaag

SEQ ID NO: 100084 - DNA, 313 bp, Homo sapiens; identical to SEQ ID NO: 32597
  misc_feature 1..313: note = chr9:100613687-100614000
  misc_feature 1..313: note = hyper
  source 1..313: mol_type = genomic DNA

SEQ ID NO: 100085 - DNA, 230 bp, Homo sapiens; identical to SEQ ID NO: 32598
  misc_feature 1..230: note = chr9:100614192-100614422
  misc_feature 1..230: note = hyper
  source 1..230: mol_type = genomic DNA

SEQ ID NO: 100086 - DNA, 760 bp, Homo sapiens; identical to SEQ ID NO: 32599
  misc_feature 1..760: note = chr9:100614441-100615201
  misc_feature 1..760: note = hyper
  source 1..760: mol_type = genomic DNA

SEQ ID NO: 100087 - DNA, 834 bp, Homo sapiens; identical to SEQ ID NO: 3451
  misc_feature 1..834: note = chr9:100615202-100616036
  misc_feature 1..834: note = hyper
  source 1..834: mol_type = genomic DNA

SEQ ID NO: 100088 - DNA, 199 bp, Homo sapiens; identical to SEQ ID NO: 3452
  misc_feature 1..199: note = chr9:100616270-100616469
  misc_feature 1..199: note = hyper
  source 1..199: mol_type = genomic DNA

SEQ ID NO: 100089 - DNA, 770 bp, Homo sapiens; identical to SEQ ID NO: 32602
  misc_feature 1..770: note = chr9:100617285-100618055
  misc_feature 1..770: note = hyper
  source 1..770: mol_type = genomic DNA

SEQ ID NO: 100090 - DNA, 1163 bp, Homo sapiens; identical to SEQ ID NO: 32603
  misc_feature 1..1163: note = chr9:100619620-100620783
  misc_feature 1..1163: note = hyper
  source 1..1163: mol_type = genomic DNA

SEQ ID NO: 100091 - DNA, 17 bp, Homo sapiens
  misc_feature 1..17: note = chr9:100735117-100735134
  misc_feature 1..17: note = hypo
  source 1..17: mol_type = genomic DNA
tgcggcactgcactcca

SEQ ID NO: 100092 - DNA, 30 bp, Homo sapiens
  misc_feature 1..30: note = chr9:100797208-100797238
  misc_feature 1..30: note = hyper
  source 1..30: mol_type = genomic DNA
tttcacaggggaggacgttgagaagttcct

SEQ ID NO: 100093 - DNA, 52 bp, Homo sapiens
  misc_feature 1..52: note = chr9:100817046-100817098
  misc_feature 1..52: note = hypo
  source 1..52: mol_type = genomic DNA
ggcctctggatccatcgccagagggggtctacagaaccggggcaggtagcac

SEQ ID NO: 100094 - DNA, 143 bp, Homo sapiens
  misc_feature 1..143: note = chr9:100818294-100818437
  misc_feature 1..143: note = hypo
  source 1..143: mol_type = genomic DNA
tacaggtgtgagccaccgcgcccgcccaggtgattgtattttaagagcctggggctgggaggtccgggtactagtcccatctctgctttggctttctggatggctttggacaagccagtgcaacttctcgaacctgttgcctc

SEQ ID NO: 100095 - DNA, 21 bp, Homo sapiens
  misc_feature 1..21: note = chr9:100835849-100835870
  misc_feature 1..21: note = hypo
  source 1..21: mol_type = genomic DNA
ccaccgcgcctggcctgggct

SEQ ID NO: 100096 - DNA, 124 bp, Homo sapiens
  misc_feature 1..124: note = chr9:100843289-100843413
  misc_feature 1..124: note = hypo
  source 1..124: mol_type = genomic DNA
gtgcgtcttgtggagcgtgccctgggctccccaaccaagcagctgctgccctgtgagatggcctgcaatgagaaggtgtgtcctgccggactctactcggttctgctgccgtgtgtggaaaaag

SEQ ID NO: 100097 - DNA, 176 bp, Homo sapiens
  misc_feature 1..176: note = chr9:100935510-100935686
  misc_feature 1..176: note = hypo
  source 1..176: mol_type = genomic DNA
cttccaccaagttcccggtgactaggaagccgctggcccaggggccactctttgagaatcgctgctctacagcccagctctatgattcacaactatcgctcagtttacccctcacaaccatctgggggcgcggaggattatctccacttcgtgagtgtggccggggcactctgcag

SEQ ID NO: 100098 - DNA, 30 bp, Homo sapiens; identical to SEQ ID NO: 42172
  misc_feature 1..30: note = chr9:100981193-100981223
  misc_feature 1..30: note = hypo
  source 1..30: mol_type = genomic DNA

SEQ ID NO: 100099 - DNA, 94 bp, Homo sapiens; identical to SEQ ID NO: 42173
  misc_feature 1..94: note = chr9:100981840-100981934
  misc_feature 1..94: note = hypo
  source 1..94: mol_type = genomic DNA

SEQ ID NO: 100100 - DNA, 30 bp, Homo sapiens
  misc_feature 1..30: note = chr9:101016284-101016314
  misc_feature 1..30: note = hypo
  source 1..30: mol_type = genomic DNA
ggaaccacatgacctcgaaaatgccttccc

SEQ ID NO: 100101 - DNA, 38 bp, Homo sapiens
  misc_feature 1..38: note = chr9:101216438-101216476
  misc_feature 1..38: note = hypo
  source 1..38: mol_type = genomic DNA
acttgctgggccccacgcctgaccgcttgttgttgtac

SEQ ID NO: 100102 - DNA, 1179 bp, Homo sapiens
  misc_feature 1..1179: note = chr9:101469181-101470360
  misc_feature 1..1179: note = hyper
  source 1..1179: mol_type = genomic DNA
atgctcaggcaaagacgagggcgataggaatgtcattcggaaatgatttcacaccgggttagccctgcacagccagccagcttgcatcctctggggcagaggacgcctctccgcctgcagcagcctgcgcgtaccgctgccaactgccaccggttccttcaccttttatttacagcgcagagcaagctggttcaccggtgaagcgggggaggcagggaataagatacaatctagattctgctctttctctggggacataaagagggtccgaccaaggaggaggggaagcccagattgcaccaccagagcagtagcgcgaccctcctcccaaaagggttctgcacctggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggtggccccacacttgcccgcgcggagcgggctcagagctgctggcgcgcaccaggcgcccagccacgctgcacgctcaagccccttgggttccggagccttccggacctcaaagcgcggctcggcttccctgggggcctgtgagcaggcccgcggcccctccggccctgggtggcccagtttgcagtcaatgcgcctgttcctcccactcggtacctcgcagccccatgagcgggacctggacagg

SEQ ID NO: 100103 - DNA, 946 bp, Homo sapiens
  misc_feature 1..946: note = chr9:101470607-101471553
  misc_feature 1..946: note = hyper
  source 1..946: mol_type = genomic DNA
gatctgaccaaaggccggaggttgcctgtgtccaaaccacccaccccaatgccccccgaagccccgacggcaggggcagccggacactcacctccgtgtcatagagccgcaggtcgaggaagtaggggcgcaggagtgactcgttgcggatctgctcgatggccagttccacggcggggagcacaccgcgcccgatgctgcccttggccacctccttggtgagcggcatgaggcccatgatggagagcggcgggctgctgggcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 100104 - DNA, 399 bp, Homo sapiens
  misc_feature 1..399: note = chr9:101471554-101471953
  misc_feature 1..399: note = hyper
  source 1..399: mol_type = genomic DNA
gggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgcccgttggtgccaggctgcccggcctttagggcct

SEQ ID NO: 100105 - DNA, 30 bp, Homo sapiens; identical to SEQ ID NO: 42174
  misc_feature 1..30: note = chr9:101557939-101557969
  misc_feature 1..30: note = hypo
  source 1..30: mol_type = genomic DNA

SEQ ID NO: 100106 - DNA, 49 bp, Homo sapiens
  misc_feature 1..49: note = chr9:101559178-101559227
  misc_feature 1..49: note = hyper
  source 1..49: mol_type = genomic DNA
ccttgactttactagcgggctccgctgaccccaccgcagcccctggcac

SEQ ID NO: 100107 - DNA, 173 bp, Homo sapiens
  misc_feature 1..173: note = chr9:101705868-101706041
  misc_feature 1..173: note = hyper
  source 1..173: mol_type = genomic DNA
agaggattccctcagcggctgtgaaagagtgctttcttgcgggtcagccccgacaggacagacttaagggcgggagggagcccatcccgcttgccccaacgaacgcgggcgcggggctttcctcgcaggttacataaggcagccgcgggtggaggcagcagaggcgagcgcac

SEQ ID NO: 100108 - DNA, 154 bp, Homo sapiens; identical to SEQ ID NO: 32611
  misc_feature 1..154: note = chr9:101706042-101706196
  misc_feature 1..154: note = hyper
  source 1..154: mol_type = genomic DNA

SEQ ID NO: 100109 - DNA, 584 bp, Homo sapiens
  misc_feature 1..584: note = chr9:101706312-101706896
  misc_feature 1..584: note = hyper
  source 1..584: mol_type = genomic DNA
cgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagctgggtgcggagcctccaatcttaggcagagagggacttcagaaacagcgccagcgccagcgccaacagcctcagcgcacccagcgccagcagcttaggttgtgcgtgctggctggctt

SEQ ID NO: 100110 - DNA, 30 bp, Homo sapiens
  misc_feature 1..30: note = chr9:101734127-101734157
  misc_feature 1..30: note = hypo
  source 1..30: mol_type = genomic DNA
gggggagccaccccacgctctctctctctg

SEQ ID NO: 100111 - DNA, 30 bp, Homo sapiens
  misc_feature 1..30: note = chr9:101924520-101924550
  misc_feature 1..30: note = hypo
  source 1..30: mol_type = genomic DNA
tttgatacagacattcggtgcttgccaaat

SEQ ID NO: 100112 - DNA, 19 bp, Homo sapiens
  misc_feature 1..19: note = chr9:101982656-101982675
  misc_feature 1..19: note = hypo
  source 1..19: mol_type = genomic DNA
tacataagaatgtcccggc

SEQ ID NO: 100113 - DNA, 40 bp, Homo sapiens
  misc_feature 1..40: note = chr9:102107331-102107371
  misc_feature 1..40: note = hypo
  source 1..40: mol_type = genomic DNA
acacactcacacacccgagggggcacgcttccagtcccat

SEQ ID NO: 100114 - DNA, 30 bp, Homo sapiens
  misc_feature 1..30: note = chr9:102186087-102186117
  misc_feature 1..30: note = hypo
  source 1..30: mol_type = genomic DNA
ggcacaggttttctccgtggatgctcctgt

SEQ ID NO: 100115 - DNA, 28 bp, Homo sapiens
  misc_feature 1..28: note = chr9:102203901-102203929
  misc_feature 1..28: note = hypo
  source 1..28: mol_type = genomic DNA
gcatgagccactgcgcccagcctattcc

SEQ ID NO: 100116 - DNA, 341 bp, Homo sapiens
  misc_feature 1..341: note = chr9:102586644-102586985
  misc_feature 1..341: note = hyper
  source 1..341: mol_type = genomic DNA
cacccactgaaggggcgggtgggggattgctggagacccccattgaagatgcggggagacgggaagcacgtgctacagccgtgggaagatccgcttctacccgcgctacatcgagcgcaagctttccgtccgagcagctccagctggggctgggggtggcaagggaatcccccatttcctggtcgtcgagggtttcctggacctgggagccccgagtccctttctctcttcctgcaggcaagccccgggctcaggggcgccaggagatgaccctcgtggccccgcgcacctcggaggtttttggtttggtttgatttggggtttttcggtccctgttccca

SEQ ID NO: 100117 - DNA, 37 bp, Homo sapiens; identical to SEQ ID NO: 15233
  misc_feature 1..37: note = chr9:103174717-103174754
  misc_feature 1..37: note = hypo
  source 1..37: mol_type = genomic DNA

SEQ ID NO: 100118 - DNA, 87 bp, Homo sapiens
  misc_feature 1..87: note = chr9:103176794-103176881
  misc_feature 1..87: note = hypo
  source 1..87: mol_type = genomic DNA
tgatgtatgaaataacgaaggctatagcgggtcacatcctcgagttaatgaaatacagtgttcttttttttttttttgagaccgagt

SEQ ID NO: 100119 - DNA, 50 bp, Homo sapiens
  misc_feature 1..50: note = chr9:103235208-103235258
  misc_feature 1..50: note = hyper
  source 1..50: mol_type = genomic DNA
caaacaagtctgctacggtgcagcctaccgccgaggggtggccccaaccc

SEQ ID NO: 100120 - DNA, 623 bp, Homo sapiens
  misc_feature 1..623: note = chr9:103235307-103235930
  misc_feature 1..623: note = hyper
  source 1..623: mol_type = genomic DNA
cggcgccggccgcggccgggggcggagctgtcggcgcgggagctgggggtgtgcgcggggcggggtcgcagccacccctcccgccggcggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcc

SEQ ID NO: 100121 - DNA, 42 bp, Homo sapiens
  misc_feature 1..42: note = chr9:103236598-103236640
  misc_feature 1..42: note = hyper
  source 1..42: mol_type = genomic DNA
gtgactgtgtgtgtgcgcgcgcgcgcgcgtgtgtgttctttg

SEQ ID NO: 100122 - DNA, 137 bp, Homo sapiens; identical to SEQ ID NO: 32616
  misc_feature 1..137: note = chr9:103790552-103790689
  misc_feature 1..137: note = hyper
  source 1..137: mol_type = genomic DNA

SEQ ID NO: 100123 - DNA, 55 bp, Homo sapiens
  misc_feature 1..55: note = chr9:103790962-103791017
  misc_feature 1..55: note = hyper
  source 1..55: mol_type = genomic DNA
gcccggcaccctccccgcctctcccctcctccgccccctccgcgccagccttttg

SEQ ID NO: 100124 - DNA, 484 bp, Homo sapiens
  misc_feature 1..484: note = chr9:103791220-103791704
  misc_feature 1..484: note = hyper
  source 1..484: mol_type = genomic DNA
acactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggaggtgagtgcggcgcccgcagccgggccgctggggaagtctctgcaccggggcagtagggcagcgcggggcaagctcctggccggacccggcggcgcaggtgtcccatgccttgcttgtgggtgtcgaggtgcagatgaaggcggcgctggggctgtgcagaggagaggacgaacccagggagggtcgcctcctgcgaggtgtcagattgacccagcagaaagctaccacctccctgctcataaactttccttccatgtcatctgggaaacgtggagacaaagggggcgtggaggctccctccgtcccgttccaccctcctg

SEQ ID NO: 100125 - DNA, 151 bp, Homo sapiens
  misc_feature 1..151: note = chr9:103791929-103792080
  misc_feature 1..151: note = hyper
  source 1..151: mol_type = genomic DNA
ggaaaattggaggggcggccttcggctttctcatcgagctccggtgccaaaggcgccggggtgaggctcgggtcagtgcggggataaatgatgagttactgacaggcttgccataatcacctcctagaacggaggacgctaggatctctcc

SEQ ID NO: 100126 - DNA, 175 bp, Homo sapiens; identical to SEQ ID NO: 3388
  misc_feature 1..175: note = chr9:1042326-1042501
  misc_feature 1..175: note = hyper
  source 1..175: mol_type = genomic DNA

SEQ ID NO: 100127 - DNA, 332 bp, Homo sapiens
  misc_feature 1..332: note = chr9:104248291-104248623
  misc_feature 1..332: note = hyper
  source 1..332: mol_type = genomic DNA
gatcatcattggagccgccctgcggtcccccggagagagcctgggccgagcagaggatgcgggtcacaacgaccctgcaggagctcacgccccaagacaccgcgagcgcagtgcgacactagcgacgccggagccaagggccagaaagagggcgagacacacccaggtggatctaattaaccctccctcttggaaaaagaatgggggacgatgtccagggccctggatctagtgtctgtcgctgaccttgggcagtccctgccacgcttgagcctcagtttcccacccgtaggccgagctgaccgtctccatcgctgcgctccttcccttct

SEQ ID NO: 100128 - DNA, 130 bp, Homo sapiens
  misc_feature 1..130: note = chr9:104248845-104248975
  misc_feature 1..130: note = hyper
  source 1..130: mol_type = genomic DNA
ttacccagactggcacgcgccccgctcgcgtccttctattgacctgtcagcgcagctggcgcaggcaagggccagggaggcgcccccgagacactcaaccatccccgcactgatgcgggcccctgctgcc

SEQ ID NO: 100129 - DNA, 75 bp, Homo sapiens
  misc_feature 1..75: note = chr9:104249474-104249549
  misc_feature 1..75: note = hyper
  source 1..75: mol_type = genomic DNA
cttggggaaaaaggacggcaaaaggcgccaactgatgggcagccagggaaaagcaggagtcgcccccaagtcacg

SEQ ID NO: 100130 - DNA, 371 bp, Homo sapiens; identical to SEQ ID NO: 32356
  misc_feature 1..371: note = chr9:1042615-1042986
  misc_feature 1..371: note = hyper
  source 1..371: mol_type = genomic DNA

SEQ ID NO: 100131 - DNA, 260 bp, Homo sapiens
  misc_feature 1..260: note = chr9:104499922-104500182
  misc_feature 1..260: note = hyper
  source 1..260: mol_type = genomic DNA
gggcttacgggagcccggcggcccccggccatgcagggtgctccccaaccagcgtgcgcccggcgagggcgccggggaccgcctagtccctggctccggctcatccctctgggctcctgctcggctgtcgtccggagcgcggctggccgcgcggggggcggtggtccagggctgcaagtgcaccgcgcccaccctcaccgcgtgcccgatgcgcttgaggatctggcagggctgcgggtgcgaggaggagctgggcaccc

SEQ ID NO: 100132 - DNA, 823 bp, Homo sapiens
  misc_feature 1..823: note = chr9:104500207-104501030
  misc_feature 1..823: note = hyper
  source 1..823: mol_type = genomic DNA
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtgacagaggagcgacgcgctctcgcctggattcttttccttttctgcccaggcgagacccacttatttcctggggtcgcgttggagagggctttcacgcccggggtgcggaaaagaagccaaatccaccttcctccactgttggccaccctcctgcaggctcccccagcgccgacttcattttctctcttctctcgctacttcctctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgc

SEQ ID NO: 100133 - DNA, 193 bp, Homo sapiens; identical to SEQ ID NO: 10016
  misc_feature 1..193: note = chr9:104501031-104501224
  misc_feature 1..193: note = hyper
  source 1..193: mol_type = genomic DNA

SEQ ID NO: 100134 - DNA, 126 bp, Homo sapiens
  misc_feature 1..126: note = chr9:1051513-1051639
  misc_feature 1..126: note = hyper
  source 1..126: mol_type = genomic DNA
agggatggtccctgacggcggccggtgggtctttggatttctttgtgtttccccagagtgagggccgccaggctcaggccccagcgaagccccgagcgccatggccgacccgcaggctggctccgc

SEQ ID NO: 100135 - DNA, 414 bp, Homo sapiens; identical to SEQ ID NO: 32358
  misc_feature 1..414: note = chr9:1051904-1052318
  misc_feature 1..414: note = hyper
  source 1..414: mol_type = genomic DNA

SEQ ID NO: 100136 - DNA, 19 bp, Homo sapiens
  misc_feature 1..19: note = chr9:105418502-105418521
  misc_feature 1..19: note = hypo
  source 1..19: mol_type = genomic DNA
ttatttattttgagacgga

SEQ ID NO: 100137 - DNA, 307 bp, Homo sapiens
  misc_feature 1..307: note = chr9:10612684-10612991
  misc_feature 1..307: note = hyper
  source 1..307: mol_type = genomic DNA
tacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtct

SEQ ID NO: 100138 - DNA, 253 bp, Homo sapiens
  misc_feature 1..253: note = chr9:10613046-10613299
  misc_feature 1..253: note = hyper
  source 1..253: mol_type = genomic DNA
cgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcac

SEQ ID NO: 100139 - DNA, 196 bp, Homo sapiens; identical to SEQ ID NO: 42179
  misc_feature 1..196: note = chr9:107221358-107221554
  misc_feature 1..196: note = hypo
  source 1..196: mol_type = genomic DNA

SEQ ID NO: 100140 - DNA, 108 bp, Homo sapiens
  misc_feature 1..108: note = chr9:107396386-107396494
  misc_feature 1..108: note = hypo
  source 1..108: mol_type = genomic DNA
cgccctgagctctgccgggggcctcactcgggtcctccggactcgctccgcccgctcggcccggaaggctgtgttcaactagtgccaccagcccggatcccacaccag

SEQ ID NO: 100141 - DNA, 30 bp, Homo sapiens
  misc_feature 1..30: note = chr9:107526267-107526297
  misc_feature 1..30: note = hyper
  source 1..30: mol_type = genomic DNA
ttctgtcacctctaacgtctggggcaagaa

SEQ ID NO: 100142 - DNA, 332 bp, Homo sapiens
  misc_feature 1..332: note = chr9:107730465-107730797
  misc_feature 1..332: note = hyper
  source 1..332: mol_type = genomic DNA
acagaaagatgccaccgctctctccaccctcccagcgccggatcacagagcgcagaccatgcacccagccttccacacacgtcgcgatctcgccgctttaagctgctgggtaccctcggcccgcccacaagaaggcggggcggcgcggggtctgctgggagttgtagtttcgggccgggcccgagagcttcttgactcgtttccttctacccccaccgccgcacagctgcctatggactctggagttgctgtgtattgagcatggggcacagccgggggtaaaaggggagaaggctcctttaatctgcggatcggggcgccgttgatgagtg

SEQ ID NO: 100143 - DNA, 476 bp, Homo sapiens; identical to SEQ ID NO: 32627
  misc_feature 1..476: note = chr9:108418471-108418947
  misc_feature 1..476: note = hyper
  source 1..476: mol_type = genomic DNA

SEQ ID NO: 100144 - DNA, 30 bp, Homo sapiens
  misc_feature 1..30: note = chr9:109012750-109012780
  misc_feature 1..30: note = hypo
  source 1..30: mol_type = genomic DNA
ataaagctaccagtacgactcctatgataa

SEQ ID NO: 100145 - DNA, 607 bp, Homo sapiens
  misc_feature 1..607: note = chr9:109622609-109623216
  misc_feature 1..607: note = hyper
  source 1..607: mol_type = genomic DNA
tgaggcgtgttggggcgcgctcacgttctcgcaaaaggctcctccccagggctcaattccccgactgcgggaagccctttggtgccccaggagccttggaaacccaaggtttcctctgacctcgtcgctcctttctccctccccaccgcctggttccctacgtccctgcccccagggaaggacggcccccatcttaggacttacgacccaagccaacccagaaggtaccttcacgtcgatgaagattttatcgcagcctccaaaacccagcagtaataggagctttcaacctgaaatacgattgttattttcccggtgcagagcttgacagaaaaagtcagctttttattaaagacaaagaggtaaattatcagccgggacagtggagggacggcggagacctggcgcgcttcctccggttgccacgaggaatttatggggtggcggcggccagcgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 100146 - DNA, 194 bp, Homo sapiens
  misc_feature 1..194: note = chr9:109623464-109623658
  misc_feature 1..194: note = hyper
  source 1..194: mol_type = genomic DNA
ggaagtgggtgaaatcgtgcctcggggtgagagattctgctcaggaatatagggtcgggaaaatcttggaaaatgaggatttagatctgtttatgaagccccgctatcggatgggaaccaactccgcgcgcgtctcctcctcttcctttattgtatggatttataggtatatatcttctcggactgttgcttgg

SEQ ID NO: 100147 - DNA, 102 bp, Homo sapiens
  misc_feature 1..102: note = chr9:109624462-109624564
  misc_feature 1..102: note = hyper
  source 1..102: mol_type = genomic DNA
tggaaatactcacaccgcaagctggaaagggattaaaaagccccacgtggttgatctgggtttatacttgcaacctccagttccccacgtatgttctttgca

SEQ ID NO: 100148 - DNA, 30 bp, Homo sapiens
  misc_feature 1..30: note = chr9:110126233-110126263
  misc_feature 1..30: note = hypo
  source 1..30: mol_type = genomic DNA
ggtgagcagaaagcccggcagagcaggcct

SEQ ID NO: 100149 - DNA, 847 bp, Homo sapiens
  misc_feature 1..847: note = chr9:110227815-110228662
  misc_feature 1..847: note = hyper
  source 1..847: mol_type = genomic DNA
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccactgggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgcagaagccgccgcaagcgggcatcgctgtcc

SEQ ID NO: 100150 - DNA, 30 bp, Homo sapiens
  misc_feature 1..30: note = chr9:110251099-110251129
  misc_feature 1..30: note = hyper
  source 1..30: mol_type = genomic DNA
gccgctccttaccctcgttcagtggctctt

SEQ ID NO: 100151 - DNA, 616 bp, Homo sapiens
  misc_feature 1..616: note = chr9:110251462-110252078
  misc_feature 1..616: note = hyper
  source 1..616: mol_type = genomic DNA
ggcccagaaggtcctcggcagcccgaagcagctggggcacctgaaccccaaagtcaacgaagagaagaaacgaagccaaaacccaaaaccccaaattggccgagatccttcttctttggattaaatataacttggaagcgtcttttttaaaaagttcctttgtatacaaaagttcttagaaaagttgtaaacgcaaaaatagacaatcagcaaggcgagtaagtaggtccggtggccgggctgcgctctcttccactcagcagcgtcccccaccactgtcgcggtcgcctcgagtgctgccgtgggcgcaggggctgtggccggggcggtgggcgggcggtgccgccaggtgagactggctgccgtggcgcggagctgcgaactggtcggcggcgcaaggcgcggactccggtgagttgtgtggagcgcgcgcggccatgggcgcgggccacgggcgggtgggagggtggggggccagaggggcgggggagggtcactcggcggctcccggtgccgccgccgcccgccaccgcctctgctccccgcgcgcccgcagacacgttcgttctctctggtcgggaaactgccggccgccggcgcgcgttccttacttata

SEQ ID NO: 100152 - DNA, 74 bp, Homo sapiens
  misc_feature 1..74: note = chr9:110252298-110252372
  misc_feature 1..74: note = hyper
  source 1..74: mol_type = genomic DNA
cggcggcagtggtgtcggcggcggcggcggcgtccgccccagcgcggggcgcgaggaaccgggcgcaggttcgg

SEQ ID NO: 100153 - DNA, 67 bp, Homo sapiens
  misc_feature 1..67: note = chr9:110252633-110252700
  misc_feature 1..67: note = hyper
  source 1..67: mol_type = genomic DNA
cggcctgacctcgcacggttcctcgcgggcccttctgctgaggggtggggggcgctaggggtgtgga

SEQ ID NO: 100154 - DNA, 223 bp, Homo sapiens
  misc_feature 1..223: note = chr9:110253522-110253745
  misc_feature 1..223: note = hyper
  source 1..223: mol_type = genomic DNA
tcaaaaagtgcacaccgagcccgccgcaggcgtccttgcccaccgggaagggaataggaaacggcgatctttacttcaatcttataacgctgcctcccccacccccactctccccttggtttgtgatcagtaattttccagctgggaaatgttttgctctcatcttcttagcaaacagtatttttttttaaaacgtgaatgtggtgttcggtatcactttcta

SEQ ID NO: 100155 - DNA, 627 bp, Homo sapiens
  misc_feature 1..627: note = chr9:110399878-110400505
  misc_feature 1..627: note = hyper
  source 1..627: mol_type = genomic DNA
gtcagggtcggggtccggtcgtacgccctagcactgcctgcggtggggcgcgcacagtcgagcgcggggcctccccgcaggctgcgctgcctgccgggcggcctcgggaactgaccaggccgcgtgtgagcgccgggattcctgatcctgccttaaatatgccggttatttttatctccctacgtcaggcagcgaaggccatcccaccggtggcccaggcggctgctacacaatgtttccctttagtcgggaggggaaatggagggaggccagacttcctgatcacatggtgctgaagtcaatgaaaaaaaattaagggggacccctccctttttcttcaatgcctgatccagattcccccctccccgctcccccgacccaccccctctgggctccgcgcgtcggagggaagcgcagcctcccaggcggagggccagcgaggcaggagagcgcgcgcaaacataaacacgagactgttgcagtaattggtggctctgaaaacactgaggaaatgagaggcttgtacgaaacatcagccgacaagaaacggggtgatgtcagacagccttccaggattagaaacccttaaaagctccgagcccgcggccgctgcggaaaactcggctc

SEQ ID NO: 100156 - DNA, 182 bp, Homo sapiens; identical to SEQ ID NO: 32636
  misc_feature 1..182: note = chr9:111929136-111929318
  misc_feature 1..182: note = hyper
  source 1..182: mol_type = genomic DNA

SEQ ID NO: 100157 - DNA, 189 bp, Homo sapiens; identical to SEQ ID NO: 32637
  misc_feature 1..189: note = chr9:111929339-111929528
  misc_feature 1..189: note = hyper
  source 1..189: mol_type = genomic DNA

SEQ ID NO: 100158 - DNA, 15 bp, Homo sapiens
  misc_feature 1..15: note = chr9:111929585-111929600
  misc_feature 1..15: note = hyper
  source 1..15: mol_type = genomic DNA
cgcagcctccccctt

SEQ ID NO: 100159 - DNA, 18 bp, Homo sapiens
  misc_feature 1..18: note = chr9:11196695-11196713
  misc_feature 1..18: note = hypo
  source 1..18: mol_type = genomic DNA
agtgagaggtgacagcgt

SEQ ID NO: 100160 - DNA, 80 bp, Homo sapiens; identical to SEQ ID NO: 32639
  misc_feature 1..80: note = chr9:112081693-112081773
  misc_feature 1..80: note = hyper
  source 1..80: mol_type = genomic DNA

SEQ ID NO: 100161 - DNA, 427 bp, Homo sapiens
  misc_feature 1..427: note = chr9:112259825-112260252
  misc_feature 1..427: note = hyper
  source 1..427: mol_type = genomic DNA
aatttttaaggcaaccgcaacttctcagtaagtttaggtagctgaaaatgggaatttcgggggggctgggcactctcacatacactcccccatctgcagctgtctcaccgcaggtacctgataaatcattccatatcgtccgcggaacggggaggatttattggctctggagtttcgtgccaggcccaggaaatgccatctttgaaagccgagaggcggattcgccctgggagccgagcgctggcagccgctctcggctagctccccgcgggctgtgtgccccctcggagccccgagccggggtcgcggcggcacggggtcctccggaggtgccggacgcacgggctccgcgggttgcgcccgcccctgcccggctggagcgcacgcccacgctccggcgccgcgtcccggccgccagcccgccccg

SEQ ID NO: 100162 - DNA, 55 bp, Homo sapiens
  misc_feature 1..55: note = chr9:112260468-112260523
  misc_feature 1..55: note = hyper
  source 1..55: mol_type = genomic DNA
ccggcccgctggggtcgcacgggcccgtacctgcagcatccgggggcgcggagcg

SEQ ID NO: 100163 - DNA, 54 bp, Homo sapiens
  misc_feature 1..54: note = chr9:112261948-112262002
  misc_feature 1..54: note = hyper
  source 1..54: mol_type = genomic DNA
ggtcctgggggcagtcgttccagggatagactgaggcctcggcagcccctggaa

SEQ ID NO: 100164 - DNA, 802 bp, Homo sapiens
  misc_feature 1..802: note = chr9:112402499-112403301
  misc_feature 1..802: note = hyper
  source 1..802: mol_type = genomic DNA
aacgccgcattaaggcgcttcaagatagctggagttttgcttgggaaactcagagggatctcgcccggccggcacaatggcgtttctgaacccatgcccagcccactgggggcagtccttgctgcttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgc

SEQ ID NO: 100165 - DNA, 185 bp, Homo sapiens
  misc_feature 1..185: note = chr9:112403302-112403487
  misc_feature 1..185: note = hyper
  source 1..185: mol_type = genomic DNA
gcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgac

SEQ ID NO: 100166 - DNA, 688 bp, Homo sapiens
  misc_feature 1..688: note = chr9:112542235-112542923
  misc_feature 1..688: note = hyper
  source 1..688: mol_type = genomic DNA
gtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgtt

SEQ ID NO: 100167 - DNA, 30 bp, Homo sapiens
  misc_feature 1..30: note = chr9:112806909-112806939
  misc_feature 1..30: note = hypo
  source 1..30: mol_type = genomic DNA
gcgtgccaccacacccggccttccctcttt

SEQ ID NO: 100168 - DNA, 547 bp, Homo sapiens
  misc_feature 1..547: note = chr9:113341075-113341622
  misc_feature 1..547: note = hyper
  source 1..547: mol_type = genomic DNA
tgacatccctctaagcgttttaaaatccattatcccattggaacctccacaacaataataggcgggtagcgatgactctggttttgtggatggggacgcttgacttggggtggttatgccttgcccaggactgaaccccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaa

SEQ ID NO: 100169 - DNA, 169 bp, Homo sapiens; identical to SEQ ID NO: 32645
  misc_feature 1..169: note = chr9:113341679-113341848
  misc_feature 1..169: note = hyper
  source 1..169: mol_type = genomic DNA

SEQ ID NO: 100170 - DNA, 414 bp, Homo sapiens; identical to SEQ ID NO: 32646
  misc_feature 1..414: note = chr9:113341926-113342340
  misc_feature 1..414: note = hyper
  source 1..414: mol_type = genomic DNA

SEQ ID NO: 100171 - DNA, 18 bp, Homo sapiens
  misc_feature 1..18: note = chr9:113366336-113366354
  misc_feature 1..18: note = hypo
  source 1..18: mol_type = genomic DNA
gcccggtcataattccct

SEQ ID NO: 100172 - DNA, 121 bp, Homo sapiens
  misc_feature 1..121: note = chr9:113392-113513
  misc_feature 1..121: note = hyper
  source 1..121: mol_type = genomic DNA
cgccccttggaccttcgccccaggccggcgcagcccagcttcccgggcaggctccacgctaccggggtccagtgcgcggcgacgaagcggagagctgtgtccagactccggagagaaactc

SEQ ID NO: 100173 - DNA, 778 bp, Homo sapiens
  misc_feature 1..778: note = chr9:113549-114327
  misc_feature 1..778: note = hyper
  source 1..778: mol_type = genomic DNA
ggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggctt

SEQ ID NO: 100174 - DNA, 30 bp, Homo sapiens
  misc_feature 1..30: note = chr9:113689346-113689376
  misc_feature 1..30: note = hypo
  source 1..30: mol_type = genomic DNA
gaaacactgacgtagcgaagtccttcgtgg

SEQ ID NO: 100175 - DNA, 397 bp, Homo sapiens
  misc_feature 1..397: note = chr9:113800084-113800481
  misc_feature 1..397: note = hyper
  source 1..397: mol_type = genomic DNA
ctacgtgtcactgggcgggccccggggcgcactgacctggcgcgggacaggagggccggcggcccgggcggctgcggcaacttccctccaggggctcggtccgccgctgggtgcgggaggccaggggagcctcgcctcctgcaggccggctcgcaagaacgcacggccacccacccgcgccgcggcccacagcgcgcacccacactctcactggcactcgcacgcgcgcccccaaccacaaagcccgtccgcggcgggacagtgtgagcccagcgcgccgtgtggcgggccgagcagtcgccgcggcctctggcttcgcgcccagggggcgccgtccccacacgccgcgccggcccccttacctgcgctcgctgccgccgcgcgtccctctcctgcc

SEQ ID NO: 100176 - DNA, 30 bp, Homo sapiens
  misc_feature 1..30: note = chr9:113800768-113800798
  misc_feature 1..30: note = hyper
  source 1..30: mol_type = genomic DNA
ggcaggaggagggggcgcagagggagggcc

SEQ ID NO: 100177 - DNA, 334 bp, Homo sapiens
  misc_feature 1..334: note = chr9:113801080-113801414
  misc_feature 1..334: note = hyper
  source 1..334: mol_type = genomic DNA
tcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggctttgctgctaggaaggtgcatacgtttctagttctga

SEQ ID NO: 100178 - DNA, 199 bp, Homo sapiens
  misc_feature 1..199: note = chr9:114287440-114287639
  misc_feature 1..199: note = hyper
  source 1..199: mol_type = genomic DNA
aggcgcagtggttcccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacttggggcgggatgggggccgggagcagcctacc

SEQ ID NO: 100179 - DNA, 138 bp, Homo sapiens; identical to SEQ ID NO: 32651
  misc_feature 1..138: note = chr9:114287962-114288100
  misc_feature 1..138: note = hyper
  source 1..138: mol_type = genomic DNA

SEQ ID NO: 100180 - DNA, 261 bp, Homo sapiens
  misc_feature 1..261: note = chr9:114361183-114361444
  misc_feature 1..261: note = hyper
  source 1..261: mol_type = genomic DNA
ctcgtctctgaacttcgtaccctttggccaacaagcccccattcccccccgaacccgctcccagcctctggcaaccatcattctagtcgttatttctatgagttcaacttctttagagttcacacatctttgtccctttccccaaaaaagcaaccgctgggcttccaaactcgctacaagtccagaagccctcctggaaagggtctggccgcagaggggccaggtcccgggaaagtctcgcccgcccgaggagggggcctg

SEQ ID NO: 100181 - DNA, 30 bp, Homo sapiens; identical to SEQ ID NO: 32652
  misc_feature 1..30: note = chr9:114361785-114361815
  misc_feature 1..30: note = hyper
  source 1..30: mol_type = genomic DNA

SEQ ID NO: 100182 - DNA, 41 bp, Homo sapiens
  misc_feature 1..41: note = chr9:114362053-114362094
  misc_feature 1..41: note = hyper
  source 1..41: mol_type = genomic DNA
cgggaaatctgagtgcgtttgtgtgtgtgtgtgcgcgtatc

SEQ ID NO: 100183 - DNA, 87 bp, Homo sapiens
  misc_feature 1..87: note = chr9:114631024-114631111
  misc_feature 1..87: note = hypo
  source 1..87: mol_type = genomic DNA
cctcctgcccttcaccgcagaccagaagacctgcttgggacccccccatctctgcaggagagagcttttctctttcttttgcctatt

SEQ ID NO: 100184 - DNA, 26 bp, Homo sapiens
  misc_feature 1..26: note = chr9:114631171-114631197
  misc_feature 1..26: note = hypo
  source 1..26: mol_type = genomic DNA
acaatgaatcgcgggtatttatccca

SEQ ID NO: 100185 - DNA, 88 bp, Homo sapiens
  misc_feature 1..88: note = chr9:114710299-114710387
  misc_feature 1..88: note = hypo
  source 1..88: mol_type = genomic DNA
ttctgtgcagctctgcggcattcagagccttcaaagtccagttccagaatgtgggctttgtcgtgaaggcagtaggaagtaattgaaa

SEQ ID NO: 100186 - DNA, 213 bp, Homo sapiens
  misc_feature 1..213: note = chr9:114717-114930
  misc_feature 1..213: note = hyper
  source 1..213: mol_type = genomic DNA
gcaaggcaacccctgcgggtcgcgcccgaaggccggacccctccaagccgcctgggagcttccaaacaggtggacccgaagctcctgtttgatcggagaataacgttcaatttactccgccgctgaactgatggtttaaatattcatctttggatatggtttcacattaggcaaaagttaggagcttggaggcggttccgggaaggggcctga

SEQ ID NO: 100187 - DNA, 32 bp, Homo sapiens
  misc_feature 1..32: note = chr9:114784817-114784849
  misc_feature 1..32: note = hypo
  source 1..32: mol_type = genomic DNA
acagggaggccccctcgttagtaaattttatt

SEQ ID NO: 100188 - DNA, 146 bp, Homo sapiens
  misc_feature 1..146: note = chr9:114931839-114931985
  misc_feature 1..146: note = hypo
  source 1..146: mol_type = genomic DNA
agtgccattcatttacgccacaccctacggttcacgtcaggcagtcactcacttaacccctaccggttcttttcacacctgtctcatacctgattcattctccagaagggtgtaccttttttttttttttttgagatggagtttca

SEQ ID NO: 100189 - DNA, 19 bp, Homo sapiens
  misc_feature 1..19: note = chr9:115067926-115067945
  misc_feature 1..19: note = hypo
  source 1..19: mol_type = genomic DNA
ataagagctttcagccggg

SEQ ID NO: 100190 - DNA, 79 bp, Homo sapiens
  misc_feature 1..79: note = chr9:115068245-115068324
  misc_feature 1..79: note = hypo
  source 1..79: mol_type = genomic DNA
aataaaaagctttcagtgacttctgtgagtctttctagcaaattattgaacctgtgggtagcttcgggaatcccctaca

SEQ ID NO: 100191 - DNA, 30 bp, Homo sapiens; identical to SEQ ID NO: 42183
  misc_feature 1..30: note = chr9:115087309-115087339
  misc_feature 1..30: note = hypo
  source 1..30: mol_type = genomic DNA

SEQ ID NO: 100192 - DNA, 120 bp, Homo sapiens
  misc_feature 1..120: note = chr9:115087595-115087715
  misc_feature 1..120: note = hypo
  source 1..120: mol_type = genomic DNA
gggcccgtctgcacactgggggaagggggtggagccaccaggaattcacgccttaggctagggagtgtggtggcctggtattcaacctgaggtggaagccagctggcgggacccctctct

SEQ ID NO: 100193 - DNA, 146 bp, Homo sapiens; identical to SEQ ID NO: 42185
  misc_feature 1..146: note = chr9:115172301-115172447
  misc_feature 1..146: note = hypo
  source 1..146: mol_type = genomic DNA

SEQ ID NO: 100194 - DNA, 30 bp, Homo sapiens
  misc_feature 1..30: note = chr9:115202051-115202081
  misc_feature 1..30: note = hypo
  source 1..30: mol_type = genomic DNA
tagtgattaagaacacgaaatttgggagaa

SEQ ID NO: 100195 - DNA, 39 bp, Homo sapiens
  misc_feature 1..39: note = chr9:115478932-115478971
  misc_feature 1..39: note = hypo
  source 1..39: mol_type = genomic DNA
aagatacatttgtgccgggcgcggtggctcacgcctgta

SEQ ID NO: 100196 - DNA, 30 bp, Homo sapiens; identical to SEQ ID NO: 42187
  misc_feature 1..30: note = chr9:115599305-115599335
  misc_feature 1..30: note = hypo
  source 1..30: mol_type = genomic DNA

SEQ ID NO: 100197 - DNA, 635 bp, Homo sapiens
  misc_feature 1..635: note = chr9:115652922-115653557
  misc_feature 1..635: note = hyper
  source 1..635: mol_type = genomic DNA
caggtggcccctccgcgggcaggtgacctcggggctcatgtgacctctctgatggggatcgaagggctttctggctgcagtgacaaggatatgctcccaaattcggctgctacggctgctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 100198 - DNA, 30 bp, Homo sapiens; identical to SEQ ID NO: 42188
  misc_feature 1..30: note = chr9:115773781-115773811
  misc_feature 1..30: note = hypo
  source 1..30: mol_type = genomic DNA

SEQ ID NO: 100199 - DNA, 37 bp, Homo sapiens
  misc_feature 1..37: note = chr9:115774571-115774608
  misc_feature 1..37: note = hyper
  source 1..37: mol_type = genomic DNA
ctttctaatgctttgcgggttgcgaacgtgcgtcgtt

SEQ ID NO: 100200 - DNA, 53 bp, Homo sapiens
  misc_feature 1..53: note = chr9:115818864-115818917
  misc_feature 1..53: note = hyper
  source 1..53: mol_type = genomic DNA
gccatctccagtggtcgcccggcctctttggtcgtttccgcacttctcctccg

SEQ ID NO: 100201 - DNA, 63 bp, Homo sapiens
  misc_feature 1..63: note = chr9:115913757-115913820
  misc_feature 1..63: note = hyper
  source 1..63: mol_type = genomic DNA
cggcgcatttcagcccgcagccccgcgcgcacaccgagcgcacatccccggccctgctcttgt

SEQ ID NO: 100202 - DNA, 40 bp, Homo sapiens
  misc_feature 1..40: note = chr9:116028536-116028576
  misc_feature 1..40: note = hypo
  source 1..40: mol_type = genomic DNA
ccaccacacctgtccctctccccctcgtattactcagact

SEQ ID NO: 100203 - DNA, 30 bp, Homo sapiens
  misc_feature 1..30: note = chr9:116060098-116060128
  misc_feature 1..30: note = hypo
  source 1..30: mol_type = genomic DNA
ggggccaaggtccagcgtgtagacttgagg

SEQ ID NO: 100204 - DNA, 37 bp, Homo sapiens
  misc_feature 1..37: note = chr9:116065790-116065827
  misc_feature 1..37: note = hypo
  source 1..37: mol_type = genomic DNA
cagcagaaaaatagtcgggagacggttgagcgtctgc

SEQ ID NO: 100205 - DNA, 87 bp, Homo sapiens
  misc_feature 1..87: note = chr9:116128876-116128963
  misc_feature 1..87: note = hypo
  source 1..87: mol_type = genomic DNA
ctagcccgggtggttcgctgtagacttcactatgttcagcctcacatttgccctgggatgacagcttagcaccgctgacatcagctc

SEQ ID NO: 100206 - DNA, 30 bp, Homo sapiens
  misc_feature 1..30: note = chr9:116270970-116271000
  misc_feature 1..30: note = hypo
  source 1..30: mol_type = genomic DNA
ggtcacttagcctatcgacacagactctct

SEQ ID NO: 100207 - DNA, 109 bp, Homo sapiens
  misc_feature 1..109: note = chr9:116331277-116331386
  misc_feature 1..109: note = hypo
  source 1..109: mol_type = genomic DNA
gcctaagtcatcactcgagatgtgtggatagctgccaggtatgctccagatggcccagggcttctcccctctccctgccctccatgggccagcccgcttgcacctggta

SEQ ID NO: 100208 - DNA, 140 bp, Homo sapiens
  misc_feature 1..140: note = chr9:116450327-116450467
  misc_feature 1..140: note = hyper
  source 1..140: mol_type = genomic DNA
cgatctcaccctgcagcccgcacactcaggcctacactccccggtttggagcccagataaccccttcccgtcctcccctcacccgcgggaaccctggagagccggtaggggaggttcgcaccctgcgttgcagctgcctt

SEQ ID NO: 100209 - DNA, 137 bp, Homo sapiens
  misc_feature 1..137: note = chr9:116542589-116542726
  misc_feature 1..137: note = hypo
  source 1..137: mol_type = genomic DNA
ggagggacacaattgcgcccatagcaactgtgtcttaaggcccttcgtaggctgagcccgcactctccaccctggaacaatccctgtgccttcacaattctggctccaacatcatcaggcatcgttatttatgtttg

SEQ ID NO: 100210 - DNA, 80 bp, Homo sapiens
  misc_feature 1..80: note = chr9:116633829-116633909
  misc_feature 1..80: note = hypo
  source 1..80: mol_type = genomic DNA
gaggccaggatcacccgggtagtgagggcaccggaaattccacctgccgacgtgtgcgctttctctacacgagacacttt

SEQ ID NO: 100211 - DNA, 19 bp, Homo sapiens
  misc_feature 1..19: note = chr9:116634089-116634108
  misc_feature 1..19: note = hypo
  source 1..19: mol_type = genomic DNA
tcaccgtgttagccaggat

SEQ ID NO: 100212 - DNA, 186 bp, Homo sapiens
  misc_feature 1..186: note = chr9:116756509-116756695
  misc_feature 1..186: note = hyper
  source 1..186: mol_type = genomic DNA
attcagacacagccacgtgggtttcagcctgtgacagacccaggcagcgtaggtgccaggtcctgcttcatcgtgccagctgatagttcgtttcctgtttcaataggttgttggcagggcctcacacaagagcctgccagaaccaacactcagctctttgctgcagccactcggaaaggaggagtt

SEQ ID NO: 100213 - DNA, 41 bp, Homo sapiens
  misc_feature 1..41: note = chr9:116800689-116800730
  misc_feature 1..41: note = hypo
  source 1..41: mol_type = genomic DNA
cagagaatgcctggccggccatccagcgcaaagccaggctg

SEQ ID NO: 100214 - DNA, 221 bp, Homo sapiens
  misc_feature 1..221: note = chr9:116916349-116916570
  misc_feature 1..221: note = hyper
  source 1..221: mol_type = genomic DNA
aaaaggcccggcgggcgccgccgccccagcacctatgagccgcccccagctctcggagcccgcgccggagcccgtggacgcagagctgccgaagttcgagcgcaggcggaccgggtcggcggcgcagtcccgcgcgcccatgcccctcccggtgccgctgcgctccgcgcgcccgcgccccgtttagggaaggggacctcgccccccgcccccgcgcccac

SEQ ID NO: 100215 - DNA, 86 bp, Homo sapiens
  misc_feature 1..86: note = chr9:116916917-116917003
  misc_feature 1..86: note = hyper
  source 1..86: mol_type = genomic DNA
agtgtagagtatcagcgtgcgcctgagcccagatatctgaggatgcgtttcgtgtgaacctaggaagggtgcgtggctgtcccaga

SEQ ID NO: 100216 - DNA, 30 bp, Homo sapiens
  misc_feature 1..30: note = chr9:116917360-116917390
  misc_feature 1..30: note = hyper
  source 1..30: mol_type = genomic DNA
ctccgagtctgggagcgcaaacttttggtg

SEQ ID NO: 100217 - DNA, 126 bp, Homo sapiens
  misc_feature 1..126: note = chr9:116918762-116918888
  misc_feature 1..126: note = hyper
  source 1..126: mol_type = genomic DNA
ttctgctcctgtctccgtgtctgtgtggctctgcacgtccccgcgtttctggaaatctccgcgtgtttgtgttagtcggcctgggtctgtgtgtctgtgtttcctgcttctcggttcctgtccctt

SEQ ID NO: 100218 - DNA, 49 bp, Homo sapiens
  misc_feature 1..49: note = chr9:117050981-117051030
  misc_feature 1..49: note = hypo
  source 1..49: mol_type = genomic DNA
ggccctgtgggtgatcgaggagaccgcggggaaccgggagaccctgggt

SEQ ID NO: 100219 - DNA, 141 bp, Homo sapiens
  misc_feature 1..141: note = chr9:117267155-117267296
  misc_feature 1..141: note = hyper
  source 1..141: mol_type = genomic DNA
cgacagctggatccccgggagcgcggagacgacggctggagcctgggtttggggagcacgggtacagtggctggatcctagggggtcgcggagaccgctgctagagtcccggaggcgcgaagacggcgggggtcgcgaacc

SEQ ID NO: 100220 - DNA, 32 bp, Homo sapiens
  misc_feature 1..32: note = chr9:11733761-11733793
  misc_feature 1..32: note = hypo
  source 1..32: mol_type = genomic DNA
agcactttgggaggccgaggcgggcggatcac

SEQ ID NO: 100221 - DNA, 88 bp, Homo sapiens; identical to SEQ ID NO: 32331
  misc_feature 1..88: note = chr9:117872-117960
  misc_feature 1..88: note = hyper
  source 1..88: mol_type = genomic DNA

SEQ ID NO: 100222 - DNA, 82 bp, Homo sapiens
  misc_feature 1..82: note = chr9:117880343-117880425
  misc_feature 1..82: note = hyper
  source 1..82: mol_type = genomic DNA
cgagttccccagcagcgctgcctttgtgcccacggaggcgggggcgtgtatctgcgcgcgggagaggcgggtgacagtaggc

SEQ ID NO: 100223 - DNA, 753 bp, Homo sapiens
  misc_feature 1..753: note = chr9:118916326-118917079
  misc_feature 1..753: note = hyper
  source 1..753: mol_type = genomic DNA
gtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatc

SEQ ID NO: 100224 - DNA, 472 bp, Homo sapiens
  misc_feature 1..472: note = chr9:118917306-118917778
  misc_feature 1..472: note = hyper
  source 1..472: mol_type = genomic DNA
cattcccctgaaagccggcaagggcaaggttgttgtaatggccaggacttagaagtcctcgaagtgccccaaagttgctcactgattgaagcctgcctctgggactcaccctcaccccctccacgccatcccatgtcctagcttttaaagcccattgcctgtcactcggggctgggacgagaccttcctaacgcataccccgccagcgttccccagacgcggctgcgaaacggggcgcttttctcatatgggactttatgagcccgtaatgaatttgagttctccctcctcaacctccctctctctccccttcgctgttccacagcaaagcctatagtgaaatcggacactttgcgaggattgcaaaccttagaaatgctccagcatccattttcccccctctaaatgaatctgtggaaatgcctttaataaaactggggagcggaggtgggggcggcgctggaagagagga

SEQ ID NO: 100225 - DNA, 198 bp, Homo sapiens
  misc_feature 1..198: note = chr9:118919150-118919348
  misc_feature 1..198: note = hyper
  source 1..198: mol_type = genomic DNA
tgggagagccaggaccgaggtgggcagcaaggatcgggtgcgaaggctcaccctctcgcggcgacctcaggtgcccagtttgctgcctgacctctgctggctttctctggctgggcgttgccactttcctaggaatccctggtcacctatcttgagagagcagtcatcgctcagcagggaccgcgctgctatttcagg

SEQ ID NO: 100226 - DNA, 30 bp, Homo sapiens
  misc_feature 1..30: note = chr9:118950279-118950309
  misc_feature 1..30: note = hypo
  source 1..30: mol_type = genomic DNA
tgagaactgtgaccccgagtgcaaccacac

SEQ ID NO: 100227 - DNA, 1085 bp, Homo sapiens
  misc_feature 1..1085: note = chr9:120175273-120176358
  misc_feature 1..1085: note = hyper
  source 1..1085: mol_type = genomic DNA
gccgcggggagtccccgaggaacctgcaggacgctccgctgcctctcctcccggaacgctcggcacgctcaggttacagcctgcgagggtgggtacaggggctcgacccccgaggttcaagctcagagcgggagaaccactggcactcgctcaaatccccagaggtggtagcatgaaaggatggggagtgggtcacaaaaatacttttaacaatatcagggctaccaggagagtggagcgtagtccgctgattattctgtgggtcttttcaggcgagcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccattcctactctcatgaaaatccatctggaagggcagaacccgcaactccgaggcgagagcgag

SEQ ID NO: 100228 - DNA, 863 bp, Homo sapiens
  misc_feature 1..863: note = chr9:120176694-120177557
  misc_feature 1..863: note = hyper
  source 1..863: mol_type = genomic DNA
cagggcgcccccacccgtccggcatgacgcaggggctcggggttccttgggatctagcgcgtgccggcgcccagccttacccagggtgaagaagggcagctcggtgttgtccaggtcgtcctgcaccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagtggctccctcccctttcccaagatcccccaattccgccctcacagcatt

SEQ ID NO: 100229 - DNA, 140 bp, Homo sapiens; identical to SEQ ID NO: 32665
  misc_feature 1..140: note = chr9:120177898-120178038
  misc_feature 1..140: note = hyper
  source 1..140: mol_type = genomic DNA

SEQ ID NO: 100230 - DNA, 34 bp, Homo sapiens
  misc_feature 1..34: note = chr9:120315798-120315832
  misc_feature 1..34: note = hypo
  source 1..34: mol_type = genomic DNA
taaaagtaaacaccccgtctctactaaaaataca

SEQ ID NO: 100231 - skipped

SEQ ID NO: 100232 - DNA, 37 bp, Homo sapiens
  misc_feature 1..37: note = chr9:121930100-121930137
  misc_feature 1..37: note = hypo
  source 1..37: mol_type = genomic DNA
aagaaggtgtcgaggcggatctcgttgctgatgaagg

SEQ ID NO: 100233 - DNA, 30 bp, Homo sapiens
  misc_feature 1..30: note = chr9:122130678-122130708
  misc_feature 1..30: note = hyper
  source 1..30: mol_type = genomic DNA
gtagcaggattccaccgtttggaggaattt

SEQ ID NO: 100234 - DNA, 466 bp, Homo sapiens
  misc_feature 1..466: note = chr9:122130973-122131439
  misc_feature 1..466: note = hyper
  source 1..466: mol_type = genomic DNA
cctcccttacacacacggacacacacacacaccacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagagcggacaagggtgccggtagggggaggggcagaggagcgcggggacgccccgaatgcggcccggggccgggtccaagggcagcggggctgcggggcgctgcacccggcgccgccttacctggagtcaatgtccgtctttggcggagagctgcgggaggacgctttttattcggctcggtgggaacttgggagagccctgcgtgcagctcgcattccgggcacgg

SEQ ID NO: 100235 - DNA, 530 bp, Homo sapiens
  misc_feature 1..530: note = chr9:122131496-122132026
  misc_feature 1..530: note = hyper
  source 1..530: mol_type = genomic DNA
cgtaaagtccccttcgctggtcccgaggacaggcatgaatcccggctccggaaggcggtcactactccctctgcctcccggctctctcgctctcgctctcgctgttgctcgctcgctctctccctctctcgcgggttcgctcgcctgcgctctcctcctccccgcgcgccagatcagtttgcagccgtggggtccgggagcgaggcggctggcgaatggagagggaagtccaagtgcgccgcggtctccgggcggggagcggcggaggccgggctacgccgggggagggacttagccggcgacggccgaaaatgaatgggggagcggcggccggggggcggggagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgca

SEQ ID NO: 100236 - DNA, 176 bp, Homo sapiens
  misc_feature 1..176: note = chr9:122132051-122132227
  misc_feature 1..176: note = hyper
  source 1..176: mol_type = genomic DNA
cgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgcgtctctctgtgagt

SEQ ID NO: 100237 - DNA, 232 bp, Homo sapiens
  misc_feature 1..232: note = chr9:123150500-123150732
  misc_feature 1..232: note = hypo
  source 1..232: mol_type = genomic DNA
gtggtgtgggggctgcgggagcagaggtggggcatttcacctagtatcgggtcaggagaggcttccccaagggcagaaaaaatatttctaaaggaccattcaaagctaactagaaaaagaaagggtgggaggagcatgtccaagagggcgcagcctgggttagactggggagaacactgttccgtttgcctggaacacagagtggagcgggaggaggcgagatgggcaagga

SEQ ID NO: 100238 - DNA, 30 bp, Homo sapiens; identical to SEQ ID NO: 42195
  misc_feature 1..30: note = chr9:123272513-123272543
  misc_feature 1..30: note = hypo
  source 1..30: mol_type = genomic DNA

SEQ ID NO: 100239 - DNA, 79 bp, Homo sapiens
  misc_feature 1..79: note = chr9:123287834-123287913
  misc_feature 1..79: note = hypo
  source 1..79: mol_type = genomic DNA
cacactgaagggctccgatctcggttggacctagaactcccccacatgtgatacaatgttgactttttttttttccttt

SEQ ID NO: 100240 - DNA, 30 bp, Homo sapiens; identical to SEQ ID NO: 42197
  misc_feature 1..30: note = chr9:123294978-123295008
  misc_feature 1..30: note = hypo
  source 1..30: mol_type = genomic DNA

SEQ ID NO: 100241 - DNA, 53 bp, Homo sapiens
  misc_feature 1..53: note = chr9:123295496-123295549
  misc_feature 1..53: note = hypo
  source 1..53: mol_type = genomic DNA
atagaagcaggacaacgttcagccctgcattcccagcacgcattcccaaggcc

SEQ ID NO: 100242 - DNA, 30 bp, Homo sapiens
  misc_feature 1..30: note = chr9:123642193-123642223
  misc_feature 1..30: note = hypo
  source 1..30: mol_type = genomic DNA
tggccacgtgagagacgcaaatgaagagaa

SEQ ID NO: 100243 - DNA, 35 bp, Homo sapiens
  misc_feature 1..35: note = chr9:123690879-123690914
  misc_feature 1..35: note = hyper
  source 1..35: mol_type = genomic DNA
cgaggagtctctctgcgccgcgtgtccccatctcc

SEQ ID NO: 100244 - DNA, 40 bp, Homo sapiens
  misc_feature 1..40: note = chr9:124061944-124061984
  misc_feature 1..40: note = hyper
  source 1..40: mol_type = genomic DNA
gggtgcaggggctgccgcgccctgtcgggtcgatccgggt

SEQ ID NO: 100245 - DNA, 71 bp, Homo sapiens
  misc_feature 1..71: note = chr9:124261319-124261390
  misc_feature 1..71: note = hyper
  source 1..71: mol_type = genomic DNA
gtgctgcaggcaccccggatgccaaagttagtgtcggaaactttccccatgctgggcgtctgactgagtcc

SEQ ID NO: 100246 - DNA, 137 bp, Homo sapiens
  misc_feature 1..137: note = chr9:124262375-124262512
  misc_feature 1..137: note = hyper
  source 1..137: mol_type = genomic DNA
tgctgggaggggctgcgctgcgctggcgcacggccaaactctgggaaactcagagccttggagatctgatccaccgtttgtttcccgaggaaggaagagcgcgaatgtagacagcggcaggccggggctggagtcgc

SEQ ID NO: 100247 - DNA, 541 bp, Homo sapiens
  misc_feature 1..541: note = chr9:124361389-124361930
  misc_feature 1..541: note = hyper
  source 1..541: mol_type = genomic DNA
aggggtcagcggatgcgggaagattctagcgggaaggggagctgtagggtggaagagggataagtaaagcaaagtcgcggcccactcctcggtcccgtaccctcatagcgccgaaacggaagcagaggttatctctggactcctggaggcctggggactccgggaggggagggggcgtgtggtcccgccggcatctcgggccggcaccaggctggggagcgtgtgctcggagcggagggcctcggctctgcccagtccggcctgggcggggcggtggtggggaggtcgattgaccaaacaggtgcgcccccgcccctctgctccccgcccgcgctgggtcccgggcctggcgggcggagctgtgggcggctgggcctgcgattggcagggctgggcaggccgggtggccgcgggagcccgggagccgtagagcggcggcgccgggggaggcgcggagccggccgtagcgcgctcctgcctggccagccgcctactccgcccgccccgctccactcggcccagctggcgcgaaggaaacttt

SEQ ID NO: 100248 - DNA, 141 bp, Homo sapiens
  misc_feature 1..141: note = chr9:124362183-124362324
  misc_feature 1..141: note = hyper
  source 1..141: mol_type = genomic DNA
ttgctttatttaccccgcttttcccctacagtcccctctcccgcaaggaaatctgcgcgatgcattgagcctttaaactttcctgtgcgccctgcccagatctcgaccgccgggacccagggctggcgctgggttcttggg

SEQ ID NO: 100249 - DNA, 159 bp, Homo sapiens
  misc_feature 1..159: note = chr9:124461151-124461310
  misc_feature 1..159: note = hyper
  source 1..159: mol_type = genomic DNA
tggggggtgtgacctcgcacggggaggacaagctcggaggcggcagggaggtgagcggggcggccggccctggcggtccccgggggtctccgcccctccgcagccccgccccctcgtcccggtactccccctcgccccggcgcccggggggctcgggca

SEQ ID NO: 100250 - DNA, 30 bp, Homo sapiens
  misc_feature 1..30: note = chr9:124499696-124499726
  misc_feature 1..30: note = hypo
  source 1..30: mol_type = genomic DNA
tcagcacgtgcctttcgggaaggggaagcc

SEQ ID NO: 100251 - DNA, 30 bp, Homo sapiens
  misc_feature 1..30: note = chr9:124500396-124500426
  misc_feature 1..30: note = hypo
  source 1..30: mol_type = genomic DNA
aaggtgggtgtccagcggcctggctgctga

SEQ ID NO: 100252 - DNA, 30 bp, Homo sapiens
  misc_feature 1..30: note = chr9:124580756-124580786
  misc_feature 1..30: note = hypo
  source 1..30: mol_type = genomic DNA
cctgctctgtgccaacgtggacccagcaca

SEQ ID NO: 100253 - DNA, 125 bp, Homo sapiens
  misc_feature 1..125: note = chr9:124751390-124751515
  misc_feature 1..125: note = hypo
  source 1..125: mol_type = genomic DNA
atcactcatcctacacgaagccagagagccctcttgaggccggtcaaggctggaaacgcaggctgggaactggcaatggttacctggaagcacgtggggcccggcctccccgtggggatgtctga

SEQ ID NO: 100254 - DNA, 266 bp, Homo sapiens
  misc_feature 1..266: note = chr9:124990520-124990786
  misc_feature 1..266: note = hyper
  source 1..266: mol_type = genomic DNA
aagagaaaagagaggcgctcaaggggaggaaaaagcaccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcg

SEQ ID NO: 100255 - DNA, 184 bp, Homo sapiens
  misc_feature 1..184: note = chr9:124990828-124991012
  misc_feature 1..184: note = hyper
  source 1..184: mol_type = genomic DNA
cgtacccctccttcctgcaaccgcccgccaccctgctcggcccggctgggtcccggaccctgcccgaccccggcccgggccgctcacccagtcgttcgccggctcacctggtcggtggcggggccgccctcggccggcagccggcagccctcgggcaacgccggggcggcgttctcatgcttcc

SEQ ID NO: 100256 - DNA, 67 bp, Homo sapiens
  misc_feature 1..67: note = chr9:125551770-125551837
  misc_feature 1..67: note = hypo
  source 1..67: mol_type = genomic DNA
cactgctggccatctcgtgcagtgacaccagtctcaatgaactccttctcttcgccatctgtggctt

SEQ ID NO: 100257 - DNA, 39 bp, Homo sapiens; identical to SEQ ID NO: 42200
  misc_feature 1..39: note = chr9:125623471-125623510
  misc_feature 1..39: note = hypo
  source 1..39: mol_type = genomic DNA

SEQ ID NO: 100258 - DNA, 29 bp, Homo sapiens
  misc_feature 1..29: note = chr9:125676678-125676707
  misc_feature 1..29: note = hypo
  source 1..29: mol_type = genomic DNA
gctgggattacaggcgtgagccaccgagc

SEQ ID NO: 100259 - DNA, 30 bp, Homo sapiens
  misc_feature 1..30: note = chr9:126090073-126090103
  misc_feature 1..30: note = hypo
  source 1..30: mol_type = genomic DNA
ggtttgtaaaagtatcggactccagctaac

SEQ ID NO: 100260 - DNA, 30 bp, Homo sapiens
  misc_feature 1..30: note = chr9:126090387-126090417
  misc_feature 1..30: note = hypo
  source 1..30: mol_type = genomic DNA
acactctaggctgcacgtccatattctagt

SEQ ID NO: 100261 - DNA, 67 bp, Homo sapiens
  misc_feature 1..67: note = chr9:126110108-126110175
  misc_feature 1..67: note = hypo
  source 1..67: mol_type = genomic DNA
catgtagtgtgtgtgcgttgtgatgtatgtgtgtgacgtgtgggggtgtggacgggcatgacgtgta

SEQ ID NO: 100262 - DNA, 30 bp, Homo sapiens
  misc_feature 1..30: note = chr9:126111852-126111882
  misc_feature 1..30: note = hypo
  source 1..30: mol_type = genomic DNA
cccaggattctggggcggggggtggctcac

SEQ ID NO: 100263 - DNA, 54 bp, Homo sapiens
  misc_feature 1..54: note = chr9:126125543-126125597
  misc_feature 1..54: note = hypo
  source 1..54: mol_type = genomic DNA
ttcagctttgcctttcgtgtagggacgcccccaggcatccgggcagctctaggg

SEQ ID NO: 100264 - DNA, 331 bp, Homo sapiens
  misc_feature 1..331: note = chr9:126132902-126133233
  misc_feature 1..331: note = hypo
  source 1..331: mol_type = genomic DNA
ttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggcc

SEQ ID NO: 100265 - DNA, 303 bp, Homo sapiens
  misc_feature 1..303: note = chr9:126133637-126133940
  misc_feature 1..303: note = hypo
  source 1..303: mol_type = genomic DNA
ggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtgtaagtgtctggtggcggtggtggtggtggggtggggagtccttttcccaggatctgtcctgtgtcaccggggcttagtgtgt

SEQ ID NO: 100266 - DNA, 305 bp, Homo sapiens
  misc_feature 1..305: note = chr9:126138009-126138314
  misc_feature 1..305: note = hyper
  source 1..305: mol_type = genomic DNA
ctgagtaggaagacacggaggggcagggggcctgggagtccgcactggagcaggctcggcccgctgtgcaggctggccccaaccccgggtggctcagcccaggaggagcctggacagacgaaggcagcaggcgctggagctgtgaacctccccgccacaccccttcctggggcggggtggggggagtgggtgctggcgaggagaggcttggaagggaagtctggggagcagccttgatctctacaggcttctggcagcctgggtcataaaccacaaatcccctccgcttacggggaatgtttcct

SEQ ID NO: 100267 - DNA, 36 bp, Homo sapiens
  misc_feature 1..36: note = chr9:126139212-126139248
  misc_feature 1..36: note = hypo
  source 1..36: mol_type = genomic DNA
gggatcctggcagcccgaaagcgccgccagtctgag

SEQ ID NO: 100268 - DNA, 176 bp, Homo sapiens
  misc_feature 1..176: note = chr9:126140319-126140495
  misc_feature 1..176: note = hypo
  source 1..176: mol_type = genomic DNA
ctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgc

SEQ ID NO: 100269 - DNA, 36 bp, Homo sapiens; identical to SEQ ID NO: 42206
  misc_feature 1..36: note = chr9:126141357-126141393
  misc_feature 1..36: note = hypo
  source 1..36: mol_type = genomic DNA

SEQ ID NO: 100270 - DNA, 69 bp, Homo sapiens
  misc_feature 1..69: note = chr9:126145324-126145393
  misc_feature 1..69: note = hypo
  source 1..69: mol_type = genomic DNA
cacttgcaagccacacggcccgggtgccagtccctttctcctggcccaggtcctcgttcccagcaggga

SEQ ID NO: 100271 - DNA, 148 bp, Homo sapiens
  misc_feature 1..148: note = chr9:126152955-126153103
  misc_feature 1..148: note = hypo
  source 1..148: mol_type = genomic DNA
gtgaagaggtgaccacgtggccaagaagtggagaacagggactgcagcccggatggtccacccccaggggcctcaccctctcctgtgagcggggctcggagtagatgcacacgaggggacaccagccccggctcgggccaaatggagg

SEQ ID NO: 100272 - DNA, 340 bp, Homo sapiens
  misc_feature 1..340: note = chr9:126154211-126154551
  misc_feature 1..340: note = hypo
  source 1..340: mol_type = genomic DNA
agaagaaaggctggccgtccgtcatggatcagaccccatcatcccccacggctgctcccgcctctgcccaccttgtctccgcgtggagttcccatgcagatgacttcccgaaccccttctaatgtttggtttaacgtgtcgccggttagcgcgcgcgtgtgacagtggtgacaggcgaggctgttcctttttaaataccatgtcagagacacggcgtcaggaagcagggacgtgctccatgctctctgccgcgccgggatcgcaccggcttattttttaatgaggaagatctgcatctcgggagtttttttcatgtgtcacatcgcgtggacaaatcagc

SEQ ID NO: 100273 - DNA, 105 bp, Homo sapiens
  misc_feature 1..105: note = chr9:126158010-126158115
  misc_feature 1..105: note = hypo
  source 1..105: mol_type = genomic DNA
actggcagcttcatacgcacgtcctaatcacacctggcacacagtaggtgctctttacctgtttgtggttgttaccggacgcccctaccccgcctcccaggtgct

SEQ ID NO: 100274 - DNA, 119 bp, Homo sapiens
  misc_feature 1..119: note = chr9:126169372-126169491
  misc_feature 1..119: note = hypo
  source 1..119: mol_type = genomic DNA
ggcaatcagcgggatcggtggaggagactgcttcattagggatgataaaacagacagagcagggggggaggggcgggggggtggggagcacggagctggagcctcggaggctggggagg

SEQ ID NO: 100275 - DNA, 30 bp, Homo sapiens
  misc_feature 1..30: note = chr9:126283294-126283324
  misc_feature 1..30: note = hypo
  source 1..30: mol_type = genomic DNA
aagaaatttcaaacacggttctaccatgta

SEQ ID NO: 100276 - DNA, 30 bp, Homo sapiens
  misc_feature 1..30: note = chr9:126314151-126314181
  misc_feature 1..30: note = hypo
  source 1..30: mol_type = genomic DNA
ctgggcctcagcaagcggtccccttccttc

SEQ ID NO: 100277 - DNA, 30 bp, Homo sapiens
  misc_feature 1..30: note = chr9:126349144-126349174
  misc_feature 1..30: note = hypo
  source 1..30: mol_type = genomic DNA
ggaaccaagtgggggcgcagagaggtcaaa

SEQ ID NO: 100278 - DNA, 30 bp, Homo sapiens
  misc_feature 1..30: note = chr9:126357733-126357763
  misc_feature 1..30: note = hypo
  source 1..30: mol_type = genomic DNA
actcaaggggctccccgcctctccttgtgg

SEQ ID NO: 100279 - DNA, 52 bp, Homo sapiens
  misc_feature 1..52: note = chr9:126405898-126405950
  misc_feature 1..52: note = hypo
  source 1..52: mol_type = genomic DNA
gagttacagaagatacgccccagggctccaccaaggccgcactcatggtagg

SEQ ID NO: 100280 - DNA, 141 bp, Homo sapiens
  misc_feature 1..141: note = chr9:126569628-126569769
  misc_feature 1..141: note = hypo
  source 1..141: mol_type = genomic DNA
atccatccctgactacgtcagcccacatttgactggtctcctccctaagcttctgtaatattcgctactttggcagcataataaatgactaagcacctgattatgcacctaatcatttctcgtcttcgactgttaattctt

SEQ ID NO: 100281 - DNA, 30 bp, Homo sapiens
  misc_feature 1..30: note = chr9:126729042-126729072
  misc_feature 1..30: note = hypo
  source 1..30: mol_type = genomic DNA
gtgaggcaccgcacccggcctctgatctca

SEQ ID NO: 100282 - DNA, 30 bp, Homo sapiens
  misc_feature 1..30: note = chr9:126759039-126759069
  misc_feature 1..30: note = hyper
  source 1..30: mol_type = genomic DNA
ccctagggcaagtctcgcagtgtgatcgcc

SEQ ID NO: 100283 - DNA, 206 bp, Homo sapiens
  misc_feature 1..206: note = chr9:126760259-126760465
  misc_feature 1..206: note = hyper
  source 1..206: mol_type = genomic DNA
cagaaaaggggaaatcgggactcatgtggttgagggttcatgagagcagtttctgtgcgctgaggccgggacttcccagcacagcctacaagacactgcctgcccacgcctggccccgcccacctctgcagcctcatcccgctccccaccccacaccggccactccggctttcgcgctggccttgctccctcgtgccaggaacgct

SEQ ID NO: 100284 - DNA, 165 bp, Homo sapiens
  misc_feature 1..165: note = chr9:126761476-126761641
  misc_feature 1..165: note = hyper
  source 1..165: mol_type = genomic DNA
ggggagtgacttgtccgaggtctcagagcagggaaatggcttcagttgcattttgggggccgctgttccaaggagagacagagaaagagatagcgagtccccctgagcaaggcgagaaaggggggagagtgaggggaggtagaaggaagccggagagggagggag

SEQ ID NO: 100285 - DNA, 76 bp, Homo sapiens
  misc_feature 1..76: note = chr9:126762530-126762606
  misc_feature 1..76: note = hyper
  source 1..76: mol_type = genomic DNA
aaggaagcgcctcggcgcgccccgggggcctggagggctgcgcgtggtgcggggagggccacggcaggcacccgcg

SEQ ID NO: 100286 - DNA, 1618 bp, Homo sapiens
  misc_feature 1..1618: note = chr9:126770190-126771808
  misc_feature 1..1618: note = hyper
  source 1..1618: mol_type = genomic DNA
tggggccaaggagggcggctcccctgcgcggatccttccctggtggctcccaaatccggcgttttctctgccgcctctccctcgggggagactcggaaaggctgcaaaaatctgggcgcccgttcgctcgcttgtcaagaagcaaactgtcttcacattctccaagagcaacatccctgcctaggaagaggaaggaagaggcaaaataaataaaaccagttaatgttgtagttaacttgcaaatcaagtaaatctgttggtgccgtatttgagaaataaaccatcacagcgtcacagcaaacacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagc

SEQ ID NO: 100287 - DNA, 549 bp, Homo sapiens
  misc_feature 1..549: note = chr9:126773231-126773780
  misc_feature 1..549: note = hyper
  source 1..549: mol_type = genomic DNA
aggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 100288 - DNA, 39 bp, Homo sapiens
  misc_feature 1..39: note = chr9:126773939-126773978
  misc_feature 1..39: note = hyper
  source 1..39: mol_type = genomic DNA
ggctgggcccgcggccggcggctcctcctcccactctgc

SEQ ID NO: 100289 - DNA, 240 bp, Homo sapiens
  misc_feature 1..240: note = chr9:126774038-126774278
  misc_feature 1..240: note = hyper
  source 1..240: mol_type = genomic DNA
tcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagc

SEQ ID NO: 100290 - DNA, 161 bp, Homo sapiens
  misc_feature 1..161: note = chr9:126774459-126774620
  misc_feature 1..161: note = hyper
  source 1..161: mol_type = genomic DNA
cgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcc

SEQ ID NO: 100291 - DNA, 116 bp, Homo sapiens
  misc_feature 1..116: note = chr9:126775412-126775528
  misc_feature 1..116: note = hyper
  source 1..116: mol_type = genomic DNA
tccctgggggccagacgagcagacactgcccgaccagcgggcccagaagtgacctttaggaggccgcggaggtggggagcacgggagaagcttctctgctccgggagcaggagcag

SEQ ID NO: 100292 - DNA, 55 bp, Homo sapiens
  misc_feature 1..55: note = chr9:126776044-126776099
  misc_feature 1..55: note = hyper
  source 1..55: mol_type = genomic DNA
gcctgggttctgaaccgcccagaaatggaaatgggccttttggggtggggggaag

SEQ ID NO: 100293 - DNA, 66 bp, Homo sapiens
  misc_feature 1..66: note = chr9:126776270-126776336
  misc_feature 1..66: note = hyper
  source 1..66: mol_type = genomic DNA
cgctgtgcgccggctgcgggggcaagatctcggaccgctactacctgctggcggtggacaagcagt

SEQ ID NO: 100294 - DNA, 161 bp, Homo sapiens
  misc_feature 1..161: note = chr9:126777586-126777747
  misc_feature 1..161: note = hyper
  source 1..161: mol_type = genomic DNA
ggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggc

SEQ ID NO: 100295 - DNA, 15 bp, Homo sapiens
  misc_feature 1..15: note = chr9:126777973-126777988
  misc_feature 1..15: note = hyper
  source 1..15: mol_type = genomic DNA
cggctggagcgggag

SEQ ID NO: 100296 - DNA, 137 bp, Homo sapiens
  misc_feature 1..137: note = chr9:126778381-126778518
  misc_feature 1..137: note = hyper
  source 1..137: mol_type = genomic DNA
aggtctcagttttcccggactttttcctccgagtttcctggcgcctgctggggtgagggccgtgaccctcggaagcgagccccccgggcggggacgagaccggagcaggcctggcctcgcgccggggtggggtgggg

SEQ ID NO: 100297 - DNA, 15 bp, Homo sapiens
  misc_feature 1..15: note = chr9:126779147-126779162
  misc_feature 1..15: note = hyper
  source 1..15: mol_type = genomic DNA
aaaccgagttcagac

SEQ ID NO: 100298 - DNA, 568 bp, Homo sapiens
  misc_feature 1..568: note = chr9:126779476-126780044
  misc_feature 1..568: note = hyper
  source 1..568: mol_type = genomic DNA
tctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 100299 - DNA, 31 bp, Homo sapiens; identical to SEQ ID NO: 3461
  misc_feature 1..31: note = chr9:126780284-126780315
  misc_feature 1..31: note = hyper
  source 1..31: mol_type = genomic DNA

SEQ ID NO: 100300 - DNA, 390 bp, Homo sapiens
  misc_feature 1..390: note = chr9:126780564-126780954
  misc_feature 1..390: note = hyper
  source 1..390: mol_type = genomic DNA
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcggccaccggaccctcgccacaagctgcgcctgtttccgggactcgctttcccctccgc

SEQ ID NO: 100301 - DNA, 213 bp, Homo sapiens
  misc_feature 1..213: note = chr9:126781161-126781374
  misc_feature 1..213: note = hyper
  source 1..213: mol_type = genomic DNA
actaccccacctaggcggcactcagggcaggtcccttgggcccatgggggcgccggggtccccacggagctcattaacagcagccaggcccaggcgggggctcggtggagggatgggcccaaagataccccgtagggaggctgccccacccccagtggagctggggactgggggaaagaaaagggttgctcacctcagcgggttccaagcagt

SEQ ID NO: 100302 - DNA, 30 bp, Homo sapiens; identical to SEQ ID NO: 32689
  misc_feature 1..30: note = chr9:126782415-126782445
  misc_feature 1..30: note = hyper
  source 1..30: mol_type = genomic DNA

SEQ ID NO: 100303 - DNA, 140 bp, Homo sapiens
  misc_feature 1..140: note = chr9:126783400-126783540
  misc_feature 1..140: note = hyper
  source 1..140: mol_type = genomic DNA
gcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaa

SEQ ID NO: 100304 - DNA, 294 bp, Homo sapiens; identical to SEQ ID NO: 32691
  misc_feature 1..294: note = chr9:126785057-126785351
  misc_feature 1..294: note = hyper
  source 1..294: mol_type = genomic DNA

SEQ ID NO: 100305 - DNA, 30 bp, Homo sapiens
  misc_feature 1..30: note = chr9:126794671-126794701
  misc_feature 1..30: note = hyper
  source 1..30: mol_type = genomic DNA
ccagcccttccctgtcgtcccccgcaggtc

SEQ ID NO: 100306 - DNA, 66 bp, Homo sapiens
  misc_feature 1..66: note = chr9:126807864-126807930
  misc_feature 1..66: note = hyper
  source 1..66: mol_type = genomic DNA
aacacatgggacccccggagttcagcccgagcccccggggagctgtcgggacgggtcctctctggg

SEQ ID NO: 100307 - DNA, 75 bp, Homo sapiens
  misc_feature 1..75: note = chr9:126872665-126872740
  misc_feature 1..75: note = hyper
  source 1..75: mol_type = genomic DNA
caccccccttgatctcggagacgtctgagaacgtcacagaggccgatgaacttggagacacggggaagaatggta

SEQ ID NO: 100308 - DNA, 170 bp, Homo sapiens
  misc_feature 1..170: note = chr9:126930838-126931008
  misc_feature 1..170: note = hypo
  source 1..170: mol_type = genomic DNA
tattcttatatattacggaaaagtttgcatataattggtgttagttcttccttaaatattagatataattctccaataaagccaactgggcttgaagttatctttgctgtaagttttaacattgtaactatgaattcgattttcttaatagatatcggactaatcaggtt

SEQ ID NO: 100309 - DNA, 54 bp, Homo sapiens
  misc_feature 1..54: note = chr9:127106240-127106294
  misc_feature 1..54: note = hypo
  source 1..54: mol_type = genomic DNA
gtccaaaatcagtctcgctgggctaagtcaaggtgtcagcgggcaggtgccttc

SEQ ID NO: 100310 - DNA, 410 bp, Homo sapiens
  misc_feature 1..410: note = chr9:127212654-127213064
  misc_feature 1..410: note = hyper
  source 1..410: mol_type = genomic DNA
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactcaggcccattggcgcctcgcggaggagggacgcgcagtggtgggcaaacttcgcatctccctctcgggcctcaacgagtgtttggagagcaagaaaagtgggcgccagggggcttgagggcgcgaatccaggcagacgtgaacgagggagtgcttttcagaatccaaaacgcgggagcctcccagtcctccggtgaggggcgtgttggattttcg

SEQ ID NO: 100311 - DNA, 171 bp, Homo sapiens
  misc_feature 1..171: note = chr9:127215802-127215973
  misc_feature 1..171: note = hyper
  source 1..171: mol_type = genomic DNA
acctgtgggcgcgggcgctgagccccgctcagctgcaccgggcacgggcctgcgcgccgccctcagagggcctgctcttccgctgggacccgggcgccctggacgtcacgccctcgctgctgcccactgtgtgggtgcgccttctctgtcccggtacgacccgccccgccc

SEQ ID NO: 100312 - DNA, 196 bp, Homo sapiens
  misc_feature 1..196: note = chr9:127239774-127239970
  misc_feature 1..196: note = hyper
  source 1..196: mol_type = genomic DNA
tttctccacccattgcgcggatgaggaagttgaggcacagaaaggcgcagccgctagccagagcccgcacagagccagagccaggtccccactggcgcagatgggggactgcaggcacagcagtagccacgcgggtgtaaacgtagagccgcgtgaacccgggttgtgggatcccaggccccgaccagcccccatc

SEQ ID NO: 100313 - DNA, 15 bp, Homo sapiens
  misc_feature 1..15: note = chr9:127265595-127265610
  misc_feature 1..15: note = hyper
  source 1..15: mol_type = genomic DNA
gtccgtagtggtagc

SEQ ID NO: 100314 - DNA, 401 bp, Homo sapiens
  misc_feature 1..401: note = chr9:127265875-127266276
  misc_feature 1..401: note = hyper
  source 1..401: mol_type = genomic DNA
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacaca

SEQ ID NO: 100315 - DNA, 252 bp, Homo sapiens
  misc_feature 1..252: note = chr9:127266336-127266588
  misc_feature 1..252: note = hyper
  source 1..252: mol_type = genomic DNA
agagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 100316 - DNA, 219 bp, Homo sapiens; identical to SEQ ID NO: 10058
  misc_feature 1..219: note = chr9:127266628-127266847
  misc_feature 1..219: note = hyper
  source 1..219: mol_type = genomic DNA

SEQ ID NO: 100317 - DNA, 631 bp, Homo sapiens
  misc_feature 1..631: note = chr9:127266865-127267496
  misc_feature 1..631: note = hyper
  source 1..631: mol_type = genomic DNA
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 100318 - DNA, 127 bp, Homo sapiens
  misc_feature 1..127: note = chr9:127421402-127421529
  misc_feature 1..127: note = hyper
  source 1..127: mol_type = genomic DNA
gccaaacacttgtgccgcctggggcggtgggggtagaggcaagcatagacagagaggaactaagccagacatggacaaaggcacgagccaaaaccagacagtcctggccgttcgataggccagcagt

SEQ ID NO: 100319 - DNA, 142 bp, Homo sapiens
  misc_feature 1..142: note = chr9:127539774-127539916
  misc_feature 1..142: note = hyper
  source 1..142: mol_type = genomic DNA
tctcagcactgaagccgcaggggcaggggccccgagagaggggcgcgtggaggaacaagcgctggagatgtagggatgctagggacccggggcctgaggaaggggcgctgggaccgggtccgattcccggaggggtcggggg

SEQ ID NO: 100320 - DNA, 133 bp, Homo sapiens
  misc_feature 1..133: note = chr9:127597207-127597340
  misc_feature 1..133: note = hypo
  source 1..133: mol_type = genomic DNA
gggagaagctacttacggagccacctgactgcacctgagacagagtcccaggcagtgccagagggcaggggacctcctgagcctggcatcttggccttccctcctgagctccctccgacgcagagcagaccca

SEQ ID NO: 100321 - DNA, 162 bp, Homo sapiens
  misc_feature 1..162: note = chr9:12775664-12775826
  misc_feature 1..162: note = hyper
  source 1..162: mol_type = genomic DNA
gcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaa

SEQ ID NO: 100322 - DNA, 53 bp, Homo sapiens
  misc_feature 1..53: note = chr9:12776163-12776216
  misc_feature 1..53: note = hyper
  source 1..53: mol_type = genomic DNA
ggaatgagcagggggcgctcatccggaggcagctgctgcgaggcttgtttacc

SEQ ID NO: 100323 - DNA, 82 bp, Homo sapiens
  misc_feature 1..82: note = chr9:127950686-127950768
  misc_feature 1..82: note = hypo
  source 1..82: mol_type = genomic DNA
ggttaaatactagcacgagctgataagcactgctagaaacctaagctctgatttcagcaaatgcatagaaacacttttcaaa

SEQ ID NO: 100324 - DNA, 30 bp, Homo sapiens
  misc_feature 1..30: note = chr9:128104149-128104179
  misc_feature 1..30: note = hypo
  source 1..30: mol_type = genomic DNA
ggagagctgctttcacgccatactcaagcg

SEQ ID NO: 100325 - DNA, 40 bp, Homo sapiens
  misc_feature 1..40: note = chr9:128118055-128118095
  misc_feature 1..40: note = hypo
  source 1..40: mol_type = genomic DNA
ggccattgagcgaagcgtgatgaaccggattttcaagctc

SEQ ID NO: 100326 - DNA, 46 bp, Homo sapiens
  misc_feature 1..46: note = chr9:128190094-128190140
  misc_feature 1..46: note = hypo
  source 1..46: mol_type = genomic DNA
ctcccgaaacagcatcgcccataccgagtcccgagctaccccagct

SEQ ID NO: 100327 - DNA, 30 bp, Homo sapiens
  misc_feature 1..30: note = chr9:128191341-128191371
  misc_feature 1..30: note = hypo
  source 1..30: mol_type = genomic DNA
ccagctgctgggctgcgggggaggggctgc

SEQ ID NO: 100328 - DNA, 513 bp, Homo sapiens
  misc_feature 1..513: note = chr9:128651901-128652414
  misc_feature 1..513: note = hyper
  source 1..513: mol_type = genomic DNA
ttcctgtgtaagtgtcgcacaaaagtaaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 100329 - DNA, 30 bp, Homo sapiens; identical to SEQ ID NO: 42214
  misc_feature 1..30: note = chr9:128750886-128750916
  misc_feature 1..30: note = hypo
  source 1..30: mol_type = genomic DNA

SEQ ID NO: 100330 - DNA, 122 bp, Homo sapiens; identical to SEQ ID NO: 42215
  misc_feature 1..122: note = chr9:128759852-128759974
  misc_feature 1..122: note = hypo
  source 1..122: mol_type = genomic DNA

SEQ ID NO: 100331 - DNA, 111 bp, Homo sapiens
  misc_feature 1..111: note = chr9:128777807-128777918
  misc_feature 1..111: note = hypo
  source 1..111: mol_type = genomic DNA
tgcccagcggaggtgcgtgcaggagtgggcggtgtccgtccagccccgatgggggcctgtgctgagtcaggttcctgtccttgcttggtgactctccggactccagctcca

SEQ ID NO: 100332 - DNA, 176 bp, Homo sapiens
  misc_feature 1..176: note = chr9:128824558-128824734
  misc_feature 1..176: note = hypo
  source 1..176: mol_type = genomic DNA
ggcactagcactacgcggcacacaacggacccagtccctgccctcggggctctcgcctgcagacctgggaggcagaattcatgcaggtgttcagtagctagtgagtcatggttgtgctaagagcacaaaagaggggaggctgtgtgctgtaagaggctgaacgggcctcacctggc

SEQ ID NO: 100333 - DNA, 30 bp, Homo sapiens
  misc_feature 1..30: note = chr9:128874699-128874729
  misc_feature 1..30: note = hypo
  source 1..30: mol_type = genomic DNA
aagttataaacaccgcggcttccatctctg

SEQ ID NO: 100334 - DNA, 229 bp, Homo sapiens
  misc_feature 1..229: note = chr9:128984848-128985077
  misc_feature 1..229: note = hyper
  source 1..229: mol_type = genomic DNA
aggagattccagtgccgccgcagggcccagaaggggtgtaggaggcgtggccgcagccccaccctagaccccagggccgggcaggaagatgcgtctgcgcgtgcgggcaggtgtagggggcgaggaggtggggagcggtaggaaggggaagcagcgaggggagaggctgccgagccgagcctccgcggacccgctcgcccctaaatcacgcagccgcatgaataataaa

SEQ ID NO: 100335 - DNA, 30 bp, Homo sapiens
  misc_feature 1..30: note = chr9:129269531-129269561
  misc_feature 1..30: note = hypo
  source 1..30: mol_type = genomic DNA
tctggtggcagccctcggggtgctcctgga

SEQ ID NO: 100336 - DNA, 326 bp, Homo sapiens
  misc_feature 1..326: note = chr9:129276607-129276933
  misc_feature 1..326: note = hyper
  source 1..326: mol_type = genomic DNA
cgggaccccgccctgcgctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccagc

SEQ ID NO: 100337 - DNA, 10 bp, Homo sapiens
  misc_feature 1..10: note = chr9:129276961-129276971
  misc_feature 1..10: note = hyper
  source 1..10: mol_type = genomic DNA
cgactggaga

SEQ ID NO: 100338 - DNA, 316 bp, Homo sapiens; identical to SEQ ID NO: 32705
  misc_feature 1..316: note = chr9:129372722-129373038
  misc_feature 1..316: note = hyper
  source 1..316: mol_type = genomic DNA

SEQ ID NO: 100339 - DNA, 51 bp, Homo sapiens; identical to SEQ ID NO: 32706
  misc_feature 1..51: note = chr9:129373250-129373301
  misc_feature 1..51: note = hyper
  source 1..51: mol_type = genomic DNA

SEQ ID NO: 100340 - DNA, 30 bp, Homo sapiens
  misc_feature 1..30: note = chr9:129373610-129373640
  misc_feature 1..30: note = hyper
  source 1..30: mol_type = genomic DNA
gaatgcatgcgcacccggacagaccagacg

SEQ ID NO: 100341 - DNA, 30 bp, Homo sapiens
  misc_feature 1..30: note = chr9:129374281-129374311
  misc_feature 1..30: note = hyper
  source 1..30: mol_type = genomic DNA
ctagccacacaaaggcgcctagaaatacac

SEQ ID NO: 100342 - DNA, 165 bp, Homo sapiens
  misc_feature 1..165: note = chr9:129374814-129374979
  misc_feature 1..165: note = hyper
  source 1..165: mol_type = genomic DNA
tctgaccaagcctcccgcaggttccaaatccgatccgccctttcgcctccagcgaggtcaggggacccgccccccatgccctccgcccccgcccggctccgcgccgctgcctcgctccgggaggggccggggccgccccgcagcggatcgcggggggtcagcccg

SEQ ID NO: 100343 - DNA, 88 bp, Homo sapiens
  misc_feature 1..88: note = chr9:129375295-129375383
  misc_feature 1..88: note = hyper
  source 1..88: mol_type = genomic DNA
accactccctcctagcgcccctcactgcaaaccctaggaggcccgggtcttgcccactgctcctgcccctgcccggggaccccttttc

SEQ ID NO: 100344 - DNA, 1073 bp, Homo sapiens
  misc_feature 1..1073: note = chr9:129375725-129376798
  misc_feature 1..1073: note = hyper
  source 1..1073: mol_type = genomic DNA
acctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctgcgaggggcccgcggggcggccgggccggggagccggggcctgagctcggggccaggcgcggcgcggggcgcgggccaggggcgcggagccccggggcgcgcgggggggcgggacggcactatttgacgtggagccggcggcgcatcccggcgcagggataccggccgcggggttcaaatgtcaggaagtttcgggaggtgaggcggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaaga

SEQ ID NO: 100345 - DNA, 335 bp, Homo sapiens
  misc_feature 1..335: note = chr9:129377017-129377352
  misc_feature 1..335: note = hyper
  source 1..335: mol_type = genomic DNA
agagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagc

SEQ ID NO: 100346 - DNA, 44 bp, Homo sapiens; identical to SEQ ID NO: 10066
  misc_feature 1..44: note = chr9:129377592-129377636
  misc_feature 1..44: note = hyper
  source 1..44: mol_type = genomic DNA

SEQ ID NO: 100347 - DNA, 188 bp, Homo sapiens; identical to SEQ ID NO: 10067
  misc_feature 1..188: note = chr9:129377772-129377960
  misc_feature 1..188: note = hyper
  source 1..188: mol_type = genomic DNA

SEQ ID NO: 100348 - DNA, 140 bp, Homo sapiens
  misc_feature 1..140: note = chr9:129378024-129378164
  misc_feature 1..140: note = hyper
  source 1..140: mol_type = genomic DNA
cgggcactgatggggtcctgggagcctccggacggcccccagttgccatccgttgtcccggaatcctgcgctgggccggccgagggatttggtgcctgggtcctgggatatagggtctggcgctacggaggcctgaattg

SEQ ID NO: 100349 - DNA, 30 bp, Homo sapiens; identical to SEQ ID NO: 32714
  misc_feature 1..30: note = chr9:129380664-129380694
  misc_feature 1..30: note = hyper
  source 1..30: mol_type = genomic DNA

SEQ ID NO: 100350 - DNA, 30 bp, Homo sapiens
  misc_feature 1..30: note = chr9:129381473-129381503
  misc_feature 1..30: note = hyper
  source 1..30: mol_type = genomic DNA
ctccagtggcccaaccgctctgccctgcgc

SEQ ID NO: 100351 - DNA, 30 bp, Homo sapiens
  misc_feature 1..30: note = chr9:129384076-129384106
  misc_feature 1..30: note = hyper
  source 1..30: mol_type = genomic DNA
ggaaggtgtaactgacggggcagtgaaggg

SEQ ID NO: 100352 - DNA, 325 bp, Homo sapiens
  misc_feature 1..325: note = chr9:129385872-129386197
  misc_feature 1..325: note = hyper
  source 1..325: mol_type = genomic DNA
tccaactcccaaagccggatgggttctctaagtcctcctataccgaccttccggaaggtgcgggctctacattgttgctaatctcccccagaacgcccagcctgggaggggtggggagggggagtcgctacccgagggctgggagcagggtgtcactgacctcctctgcgcggattgccccctgtagggccagccctggccagcggaagaaaaaggttagaataattgccttcccctgggcgggagagcttccttcgacgtccggacacgcggatggggcggctttcagcggcctccacccgcgcacccctccaggcccacctct

SEQ ID NO: 100353 - DNA, 353 bp, Homo sapiens
  misc_feature 1..353: note = chr9:129386429-129386782
  misc_feature 1..353: note = hyper
  source 1..353: mol_type = genomic DNA
cgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaa

SEQ ID NO: 100354 - DNA, 234 bp, Homo sapiens
  misc_feature 1..234: note = chr9:129387515-129387749
  misc_feature 1..234: note = hyper
  source 1..234: mol_type = genomic DNA
ttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaag

SEQ ID NO: 100355 - DNA, 907 bp, Homo sapiens
  misc_feature 1..907: note = chr9:129387847-129388754
  misc_feature 1..907: note = hyper
  source 1..907: mol_type = genomic DNA
cgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatggga

SEQ ID NO: 100356 - DNA, 428 bp, Homo sapiens
  misc_feature 1..428: note = chr9:129388816-129389244
  misc_feature 1..428: note = hyper
  source 1..428: mol_type = genomic DNA
cgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 100357 - DNA, 411 bp, Homo sapiens
  misc_feature 1..411: note = chr9:129400848-129401259
  misc_feature 1..411: note = hyper
  source 1..411: mol_type = genomic DNA
agtgattgccaggcccgcttggcagtttttaatcattttatctctgttctcggctctcgggggagacagccagtgcttagcagtctgctcagaaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtcatttacataaactttctctccccaggacgggcggaggtgcctaatcctattgggcgcttccactgcatgcattatacatggcagctcctaggtgcggactgagggaggggcggatagccgggctctaggtgag

SEQ ID NO: 100358 - DNA, 109 bp, Homo sapiens
  misc_feature 1..109: note = chr9:129414414-129414523
  misc_feature 1..109: note = hyper
  source 1..109: mol_type = genomic DNA
aggctgcagctctcccgattgaaacccaaaccggaggagctgcctgtcacggtgcctgtgatcctgtgatccgaggcatgattgagagggggcgcggcaggagggggct

SEQ ID NO: 100359 - DNA, 215 bp, Homo sapiens
  misc_feature 1..215: note = chr9:129438508-129438723
  misc_feature 1..215: note = hyper
  source 1..215: mol_type = genomic DNA
cctgcctggcctctccgtcacctcccatccttgcctggctgatcgccctcctctccccgtctcagcccaaatctctgtcttccgaaaagtggccttctctgacttgctccccaccacagtccccaggatgggctgtctcccagtggcttgttcgctgctgtccccagcacccagcaccgcacctggcacacaataagcaccgcatcagtatttgg

SEQ ID NO: 100360 - DNA, 678 bp, Homo sapiens
  misc_feature 1..678: note = chr9:129445222-129445900
  misc_feature 1..678: note = hyper
  source 1..678: mol_type = genomic DNA
aaatgtgcatgtgggcctccctggccaggctggcctgggatggctccccgggctcccggctgtgcccgtccctccctgtccctggcccgtgacctccagccccggctgggggctcccgacagcgcccctggcgcggatcaaagggccgaggggccggcggccccgcacagctgcgggccgcaggaagcgcaggggcagccctcgctgcaggcccggccccgacgcggcgaggaggccgggggaggccgggaggctgggagaggccccgcgaggcccgcagagcgcgcccgtctcgccgcgcattccagccgcgtgattgacgcgcgtaccggggcccccgcccgcggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgactctagcagcagcagccgtgacccccagagtgtctagggtcctgtcgcctagctcctgtgaactgcagctcatccttcagccggcatcatcagagccccgtcccgcccacaaccataa

SEQ ID NO: 100361 - DNA, 92 bp, Homo sapiens; identical to SEQ ID NO: 32722
  misc_feature 1..92: note = chr9:129485680-129485772
  misc_feature 1..92: note = hyper
  source 1..92: mol_type = genomic DNA

SEQ ID NO: 100362 - skipped

SEQ ID NO: 100363 - DNA, 38 bp, Homo sapiens
  misc_feature 1..38: note = chr9:129627928-129627966
  misc_feature 1..38: note = hypo
  source 1..38: mol_type = genomic DNA
cagcttaacagaatacgtggtgcagaattttacttaaa

SEQ ID NO: 100364 - DNA, 412 bp, Homo sapiens
  misc_feature 1..412: note = chr9:130179969-130180381
  misc_feature 1..412: note = hypo
  source 1..412: mol_type = genomic DNA
gggagctgtgctaggcgggtgggaggccctggggggggttcataaagggacatttgagatcttcaatcatttttctccttatattctatttcctacctcgccctcttggcaacccccacccacaccacctgctgttgctaccagtacccacttacccgtgccaataatgtgattcatactcttcagaggtccctttgtttccctttaagtcttcccatcagagcacagaatgcttcgcggacccagagccagcccccattgaccatcctgtaggggccccagaagcccagcctggcgccatcagtaaaggattatggagaggagcactggatagaacagccccaggggacaggtgcagcataagcttgctttacccagcccagggccgaaatctgcacggcccacggacgcc

SEQ ID NO: 100365 - DNA, 103 bp, Homo sapiens
  misc_feature 1..103: note = chr9:130248346-130248449
  misc_feature 1..103: note = hypo
  source 1..103: mol_type = genomic DNA
tgtgtggcaggcactcggctaagcgatgaaccacattcgctgattgattctaggagggactgtattgttattagcccgatttcacaatcgcaactcaggttct

SEQ ID NO: 100366 - DNA, 30 bp, Homo sapiens
  misc_feature 1..30: note = chr9:130256609-130256639
  misc_feature 1..30: note = hypo
  source 1..30: mol_type = genomic DNA
ctcactgaacagctccgttgttctgagcac

SEQ ID NO: 100367 - DNA, 20 bp, Homo sapiens
  misc_feature 1..20: note = chr9:130262351-130262371
  misc_feature 1..20: note = hypo
  source 1..20: mol_type = genomic DNA
cttagcagccgggcacgttg

SEQ ID NO: 100368 - DNA, 35 bp, Homo sapiens
  misc_feature 1..35: note = chr9:130326063-130326098
  misc_feature 1..35: note = hypo
  source 1..35: mol_type = genomic DNA
attacaagcgtgagtcaccgcgcccagcagagagg

SEQ ID NO: 100369 - DNA, 50 bp, Homo sapiens
  misc_feature 1..50: note = chr9:130362069-130362119
  misc_feature 1..50: note = hypo
  source 1..50: mol_type = genomic DNA
ctactaatcaaaacccgagtcttgcggttacttaccgggtgaacaaacac

SEQ ID NO: 100370 - DNA, 245 bp, Homo sapiens; identical to SEQ ID NO: 32723
  misc_feature 1..245: note = chr9:130461686-130461931
  misc_feature 1..245: note = hyper
  source 1..245: mol_type = genomic DNA

SEQ ID NO: 100371 - DNA, 27 bp, Homo sapiens
  misc_feature 1..27: note = chr9:130505479-130505506
  misc_feature 1..27: note = hypo
  source 1..27: mol_type = genomic DNA
ttaaatattcagttacggtcggccggg

SEQ ID NO: 100372 - DNA, 30 bp, Homo sapiens; identical to SEQ ID NO: 42222
  misc_feature 1..30: note = chr9:130534900-130534930
  misc_feature 1..30: note = hypo
  source 1..30: mol_type = genomic DNA

SEQ ID NO: 100373 - DNA, 30 bp, Homo sapiens
  misc_feature 1..30: note = chr9:130587535-130587565
  misc_feature 1..30: note = hypo
  source 1..30: mol_type = genomic DNA
cgatgagccaggacacgtaggggggaccct

SEQ ID NO: 100374 - DNA, 34 bp, Homo sapiens
  misc_feature 1..34: note = chr9:130639978-130640012
  misc_feature 1..34: note = hyper
  source 1..34: mol_type = genomic DNA
ttataaggctgtcagcgcgcggcatgccgggagc

SEQ ID NO: 100375 - DNA, 93 bp, Homo sapiens
  misc_feature 1..93: note = chr9:130676150-130676243
  misc_feature 1..93: note = hypo
  source 1..93: mol_type = genomic DNA
caccaggatgtaccccggcctgcaggtgtacaccttcaccgagcgcatgatggcctactgtgaccagatcttccaggacgagacaggcaagaa

SEQ ID NO: 100376 - DNA, 30 bp, Homo sapiens; identical to SEQ ID NO: 32724
  misc_feature 1..30: note = chr9:130689420-130689450
  misc_feature 1..30: note = hyper
  source 1..30: mol_type = genomic DNA

SEQ ID NO: 100377 - DNA, 14 bp, Homo sapiens
  misc_feature 1..14: note = chr9:130689630-130689644
  misc_feature 1..14: note = hyper
  source 1..14: mol_type = genomic DNA
ggatgaggatcccc

SEQ ID NO: 100378 - DNA, 125 bp, Homo sapiens
  misc_feature 1..125: note = chr9:130828878-130829003
  misc_feature 1..125: note = hypo
  source 1..125: mol_type = genomic DNA
gggtgaccgtggctgcggctgcggtggccgagggtccgagggccacagggtggatctctgtggtgctgggcaggctgatgatggtggcctcgcccagcaggttgcagatacgttgttgcatgggg

SEQ ID NO: 100379 - DNA, 30 bp, Homo sapiens; identical to SEQ ID NO: 42224
  misc_feature 1..30: note = chr9:130857460-130857490
  misc_feature 1..30: note = hypo
  source 1..30: mol_type = genomic DNA

SEQ ID NO: 100380 - DNA, 30 bp, Homo sapiens
  misc_feature 1..30: note = chr9:130870626-130870656
  misc_feature 1..30: note = hypo
  source 1..30: mol_type = genomic DNA
agccggacaaatgagcgacttctgtgcttc

SEQ ID NO: 100381 - DNA, 30 bp, Homo sapiens
  misc_feature 1..30: note = chr9:130908223-130908253
  misc_feature 1..30: note = hypo
  source 1..30: mol_type = genomic DNA
gcacccactcttgggcgtggagagtgggga

SEQ ID NO: 100382 - DNA, 30 bp, Homo sapiens
  misc_feature 1..30: note = chr9:130980679-130980709
  misc_feature 1..30: note = hypo
  source 1..30: mol_type = genomic DNA
tgtgactgtgggcctcgttccccttaggga

SEQ ID NO: 100383 - DNA, 21 bp, Homo sapiens
  misc_feature 1..21: note = chr9:131060946-131060967
  misc_feature 1..21: note = hypo
  source 1..21: mol_type = genomic DNA
ccaccgcgcctggccccttgg

SEQ ID NO: 100384 - DNA, 30 bp, Homo sapiens
  misc_feature 1..30: note = chr9:131083970-131084000
  misc_feature 1..30: note = hypo
  source 1..30: mol_type = genomic DNA
cacgctgtttaggagcgggaggcttcctgg

SEQ ID NO: 100385 - DNA, 109 bp, Homo sapiens
  misc_feature 1..109: note = chr9:131095776-131095885
  misc_feature 1..109: note = hypo
  source 1..109: mol_type = genomic DNA
gttgatcccatgggccgttcagaacgggcgcagagccccatgtgtcctcaacctgtactatgagcggcgctgggagcagtccctgagggctctgcgggaggagctgggc

SEQ ID NO: 100386 - DNA, 115 bp, Homo sapiens; identical to SEQ ID NO: 32725
  misc_feature 1..115: note = chr9:131127226-131127341
  misc_feature 1..115: note = hyper
  source 1..115: mol_type = genomic DNA

SEQ ID NO: 100387 - DNA, 210 bp, Homo sapiens
  misc_feature 1..210: note = chr9:131159439-131159649
  misc_feature 1..210: note = hyper
  source 1..210: mol_type = genomic DNA
ggagttaggtgaaggcgggcactgtcccaggcggagggaacagcgtgctctaaagaagtacttggcgagctcagagaaggaaggaaatttggtgtggctggagcgcagtgaggaaggggaagttccacataaagctgaggtcgaccttgccaggctcttaggctattgggaggatttgcgattatatcctaaacgcggtggggatcctga

SEQ ID NO: 100388 - DNA, 167 bp, Homo sapiens
  misc_feature 1..167: note = chr9:131217228-131217395
  misc_feature 1..167: note = hypo
  source 1..167: mol_type = genomic DNA
agtatactgtgaaagcgaggcggaaaagcaggttttgtttgcgagtctgactttaggattgcaggtgaaacacttgtgtgaccctggagctgtgtggctaaggtgctgcggggtcactggagaaaggtcaagggactgtggcccagttggcccggaggtggttcagg

SEQ ID NO: 100389 - DNA, 42 bp, Homo sapiens
  misc_feature 1..42: note = chr9:131399249-131399291
  misc_feature 1..42: note = hypo
  source 1..42: mol_type = genomic DNA
cacatgcagaccctgcgcttgggctggcgggtagcccagggt

SEQ ID NO: 100390 - DNA, 24 bp, Homo sapiens
  misc_feature 1..24: note = chr9:131417485-131417509
  misc_feature 1..24: note = hypo
  source 1..24: mol_type = genomic DNA
aaagttagcctgggccggcgcggt

SEQ ID NO: 100391 - DNA, 278 bp, Homo sapiens; identical to SEQ ID NO: 42228
  misc_feature 1..278: note = chr9:131504870-131505148
  misc_feature 1..278: note = hypo
  source 1..278: mol_type = genomic DNA

SEQ ID NO: 100392 - DNA, 105 bp, Homo sapiens; identical to SEQ ID NO: 42229
  misc_feature 1..105: note = chr9:131579999-131580104
  misc_feature 1..105: note = hypo
  source 1..105: mol_type = genomic DNA

SEQ ID NO: 100393 - DNA, 30 bp, Homo sapiens
  misc_feature 1..30: note = chr9:131607517-131607547
  misc_feature 1..30: note = hypo
  source 1..30: mol_type = genomic DNA
tggcagtctgtgtaccgccaccatctggag

SEQ ID NO: 100394 - DNA, 30 bp, Homo sapiens
  misc_feature 1..30: note = chr9:131607770-131607800
  misc_feature 1..30: note = hypo
  source 1..30: mol_type = genomic DNA
gctttcaggccacagcgccatcctgtctgc

SEQ ID NO: 100395 - DNA, 30 bp, Homo sapiens
  misc_feature 1..30: note = chr9:131652716-131652746
  misc_feature 1..30: note = hypo
  source 1..30: mol_type = genomic DNA
cacgtgccacctggacgccgtcagagtgcc

SEQ ID NO: 100396 - DNA, 24 bp, Homo sapiens
  misc_feature 1..24: note = chr9:131693810-131693834
  misc_feature 1..24: note = hypo
  source 1..24: mol_type = genomic DNA
cttttttttttgagacggagtctc

SEQ ID NO: 100397 - DNA, 17 bp, Homo sapiens
  misc_feature 1..17: note = chr9:131814818-131814835
  misc_feature 1..17: note = hypo
  source 1..17: mol_type = genomic DNA
gccgaggcaggaggacc

SEQ ID NO: 100398 - DNA, 35 bp, Homo sapiens
  misc_feature 1..35: note = chr9:131821609-131821644
  misc_feature 1..35: note = hypo
  source 1..35: mol_type = genomic DNA
agaagttgcgagaaccgggtcgtggttctctcagt

SEQ ID NO: 100399 - DNA, 162 bp, Homo sapiens
  misc_feature 1..162: note = chr9:131822028-131822190
  misc_feature 1..162: note = hypo
  source 1..162: mol_type = genomic DNA
agccactgtcctcttcggacccctgcagtgaatgacaccctggcccctccctgtgcactcaaccctgtgggaccctcagactcctgagggtccagctgcctggctctgccagtggagacacagaaccggagtgggtcggccgagccacgcaccctgccctgg

SEQ ID NO: 100400 - DNA, 69 bp, Homo sapiens
  misc_feature 1..69: note = chr9:131842877-131842946
  misc_feature 1..69: note = hyper
  source 1..69: mol_type = genomic DNA
taactgaaagtgggtcggttcaaaccccctggagctgaggttgcctctcctcttcgagcacgcgctatc

SEQ ID NO: 100401 - DNA, 420 bp, Homo sapiens
  misc_feature 1..420: note = chr9:131854046-131854466
  misc_feature 1..420: note = hypo
  source 1..420: mol_type = genomic DNA
tgctccagtttgggtgatagagtgagactccctctcaaaaaaataaataaatggcaatatctgcagggaacaggaaactataaggcgagccctggcctcgaatcatagctaaaaaacaaggatccgagaggtagatttaacagcagatgagagagagttaaaaaggaaaagcaaactggagggtgtgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggtggctcacgcctgta

SEQ ID NO: 100402 - DNA, 91 bp, Homo sapiens
  misc_feature 1..91: note = chr9:131868867-131868958
  misc_feature 1..91: note = hypo
  source 1..91: mol_type = genomic DNA
ccaccagcccccagacgctctaaggacctttcgggggaagcatcttggttctggagtccaaagtcctgacctgacgcgtctcagcaaatgt

SEQ ID NO: 100403 - DNA, 118 bp, Homo sapiens
  misc_feature 1..118: note = chr9:131870288-131870406
  misc_feature 1..118: note = hypo
  source 1..118: mol_type = genomic DNA
tggtgtgccttgaagcggctggaagccttcatcaaggagaagggcttcaggaagcccagaggcttcacctgcaggtagcagaacatcctgttcattccctccccggctctggagccct

SEQ ID NO: 100404 - DNA, 387 bp, Homo sapiens
  misc_feature 1..387: note = chr9:131872458-131872845
  misc_feature 1..387: note = hyper
  source 1..387: mol_type = genomic DNA
gtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 100405 - DNA, 64 bp, Homo sapiens; identical to SEQ ID NO: 32728
  misc_feature 1..64: note = chr9:131872856-131872920
  misc_feature 1..64: note = hyper
  source 1..64: mol_type = genomic DNA

SEQ ID NO: 100406 - DNA, 26 bp, Homo sapiens
  misc_feature 1..26: note = chr9:132000549-132000575
  misc_feature 1..26: note = hypo
  source 1..26: mol_type = genomic DNA
atcctctcccatgtgcgccttctctt

SEQ ID NO: 100407 - DNA, 193 bp, Homo sapiens
  misc_feature 1..193: note = chr9:132020917-132021110
  misc_feature 1..193: note = hyper
  source 1..193: mol_type = genomic DNA
acaggggaccatgtgcgcggcagcgcgggagcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgg

SEQ ID NO: 100408 - DNA, 144 bp, Homo sapiens; identical to SEQ ID NO: 42233
  misc_feature 1..144: note = chr9:132040507-132040651
  misc_feature 1..144: note = hypo
  source 1..144: mol_type = genomic DNA

SEQ ID NO: 100409 - DNA, 35 bp, Homo sapiens
  misc_feature 1..35: note = chr9:132114141-132114176
  misc_feature 1..35: note = hyper
  source 1..35: mol_type = genomic DNA
tctctctggggccctcggggcgcaggtccctcctc

SEQ ID NO: 100410 - DNA, 30 bp, Homo sapiens
  misc_feature 1..30: note = chr9:132114392-132114422
  misc_feature 1..30: note = hyper
  source 1..30: mol_type = genomic DNA
ccatctctccatctgcgtcctcccacttgc

SEQ ID NO: 100411 - DNA, 75 bp, Homo sapiens
  misc_feature 1..75: note = chr9:132197706-132197781
  misc_feature 1..75: note = hypo
  source 1..75: mol_type = genomic DNA
gttcaatctggcaaccccgccgtcggagtcagcctcggaactgaaacagctgaactgaaccgctgtgcagagagt

SEQ ID NO: 100412 - DNA, 30 bp, Homo sapiens
  misc_feature 1..30: note = chr9:132200261-132200291
  misc_feature 1..30: note = hyper
  source 1..30: mol_type = genomic DNA
gcaggggccaaggaccggggtctctggaca

SEQ ID NO: 100413 - DNA, 42 bp, Homo sapiens
  misc_feature 1..42: note = chr9:132244699-132244741
  misc_feature 1..42: note = hyper
  source 1..42: mol_type = genomic DNA
ataactgattggggtcgcgcacgcgcccggtgtccctaggac

SEQ ID NO: 100414 - DNA, 50 bp, Homo sapiens
  misc_feature 1..50: note = chr9:132245295-132245345
  misc_feature 1..50: note = hyper
  source 1..50: mol_type = genomic DNA
gggggagcagggaggcggccccagccggtcgccggcgcccccaggcgctg

SEQ ID NO: 100415 - DNA, 18 bp, Homo sapiens
  misc_feature 1..18: note = chr9:132257308-132257326
  misc_feature 1..18: note = hypo
  source 1..18: mol_type = genomic DNA
acccggcaacagaacata

SEQ ID NO: 100416 - DNA, 23 bp, Homo sapiens
  misc_feature 1..23: note = chr9:132268469-132268492
  misc_feature 1..23: note = hypo
  source 1..23: mol_type = genomic DNA
ttggcctgcgataaaattgcaca

SEQ ID NO: 100417 - DNA, 105 bp, Homo sapiens
  misc_feature 1..105: note = chr9:132331231-132331336
  misc_feature 1..105: note = hyper
  source 1..105: mol_type = genomic DNA
gtctgcagccctcagcgccaagcgcggccccgcggccccaccgagggatcgataactaatttcaccgcggcagccgccccagttttttcccgataattgcgcgcc

SEQ ID NO: 100418 - DNA, 456 bp, Homo sapiens
  misc_feature 1..456: note = chr9:132359682-132360138
  misc_feature 1..456: note = hyper
  source 1..456: mol_type = genomic DNA
ccgggaaggctggaccggcccgcggcttgccctttcaagtcggcctcccggagtctccggagccgtccgagcgctggggccgctggcgcggacttcaaagcccgccgcccccagccagatccggttgcgggtggggcgggcgagctgggagggaggcgggtttcggtggattcccctttcatcccgcggctgcagccgggcgcagacctcggggaggcccggcgcgtccccgctgggcaagtccctgcagggcagcgaccgggaacggagggctggggacgccacgaggccgcgccgcagggcgggggaggcctgaacccagactgggggcttcggacccgcctgcgctgtgggacctcaggccagcgcctacctgtcgctgggcctcagctttcctgaatgccctactccctgcccaggactcctctggggaggggcattcgggaacattcagtg

SEQ ID NO: 100419 - DNA, 160 bp, Homo sapiens
  misc_feature 1..160: note = chr9:132382195-132382355
  misc_feature 1..160: note = hyper
  source 1..160: mol_type = genomic DNA
ctcaaggacgggttgcgagggctctgagatactcagctaacattagcatccttctagcctgggtggtggggtggtgggtgcggggacacaagggaccaccccccaccggaaatgactcgggcccgccccccgggccccgcggggcctcactcagtggctc

SEQ ID NO: 100420 - DNA, 383 bp, Homo sapiens; identical to SEQ ID NO: 32731
  misc_feature 1..383: note = chr9:132382634-132383017
  misc_feature 1..383: note = hyper
  source 1..383: mol_type = genomic DNA

SEQ ID NO: 100421 - DNA, 235 bp, Homo sapiens
  misc_feature 1..235: note = chr9:132402075-132402310
  misc_feature 1..235: note = hypo
  source 1..235: mol_type = genomic DNA
acacagcagctctggcggctctgctttgtaggcctggtggtaacagccaggttctccaagctggtctccaagtcactggcttcagaaccggccctcccgtctcagctccttgaccctccaggagcccagcagactccaagcccgtcttcggatggggaaaggagacgtgcctggctgtctcaggcccctattaggtcacaaggcagccctgcctgtctgccgactaaccctgccc

SEQ ID NO: 100422 - DNA, 485 bp, Homo sapiens
  misc_feature 1..485: note = chr9:132402755-132403240
  misc_feature 1..485: note = hypo
  source 1..485: mol_type = genomic DNA
tgggcgcccacccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaagtagagagagggccacgctgcatctcttaatacgggagcagactgggatttgcggagaatgggctgggtctgtctgcgctctcctcccgcg

SEQ ID NO: 100423 - DNA, 19 bp, Homo sapiens
  misc_feature 1..19: note = chr9:132427621-132427640
  misc_feature 1..19: note = hyper
  source 1..19: mol_type = genomic DNA
tgggagtggggggctcgtc

SEQ ID NO: 100424 - DNA, 51 bp, Homo sapiens
  misc_feature 1..51: note = chr9:132427641-132427692
  misc_feature 1..51: note = hyper
  source 1..51: mol_type = genomic DNA
ccttcgtctctgggccgccccctccacctgcggaggcgattgtaaagggaa

SEQ ID NO: 100425 - DNA, 71 bp, Homo sapiens; identical to SEQ ID NO: 32732
  misc_feature 1..71: note = chr9:132428052-132428123
  misc_feature 1..71: note = hyper
  source 1..71: mol_type = genomic DNA

SEQ ID NO: 100426 - DNA, 277 bp, Homo sapiens
  misc_feature 1..277: note = chr9:132428401-132428678
  misc_feature 1..277: note = hyper
  source 1..277: mol_type = genomic DNA
gatggtgagtacggccggccagggacgggggtggcggggccggggccggggccggggccggggcgcggggtccggggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattcggctcccgaacagcctgggaa

SEQ ID NO: 100427 - DNA, 392 bp, Homo sapiens
  misc_feature 1..392: note = chr9:132459541-132459933
  misc_feature 1..392: note = hyper
  source 1..392: mol_type = genomic DNA
gagctggaaggaaggcgaggagggagctggctgggctgcaggggagcgctgcgtcccgctccccctcccctaggccgtgccccctcccgcccggccggggcgcgcaccctcggagcagctgggcggcggcggcgcgggcagcgcggggctgggcgcgggatctattaacgtctgtgtgtctgggccgcgggactgcggcgaggcaggcgccaggggctcgtctggaaccagatgtgccgcggcgccgctctggccgccaccagcgcggcgcgctcgcacgcactggctggcgcgcacatggccgggctgggcggcggcggctggcgcgccggccctggcatcccctggatttcggaccgaccccagacccgcgcgtgcggaggggagacccc

SEQ ID NO: 100428 - DNA, 93 bp, Homo sapiens; identical to SEQ ID NO: 42235
  misc_feature 1..93: note = chr9:132491528-132491621
  misc_feature 1..93: note = hypo
  source 1..93: mol_type = genomic DNA

SEQ ID NO: 100429 - DNA, 37 bp, Homo sapiens
  misc_feature 1..37: note = chr9:132513020-132513057
  misc_feature 1..37: note = hypo
  source 1..37: mol_type = genomic DNA
ctggcgctgctgtcacgacccccgtttacaggtgagg

SEQ ID NO: 100430 - DNA, 30 bp, Homo sapiens
  misc_feature 1..30: note = chr9:132523662-132523692
  misc_feature 1..30: note = hypo
  source 1..30: mol_type = genomic DNA
aatgactgcttcatgcgtataaagttttct

SEQ ID NO: 100431 - DNA, 120 bp, Homo sapiens
  misc_feature 1..120: note = chr9:132559293-132559413
  misc_feature 1..120: note = hypo
  source 1..120: mol_type = genomic DNA
tgctgggattacaggcgtgagtcacctcgccctgcccattgtgagtttaaatggtcacaaaagacataatttttgcactttaagataacactgtagggccgggcgcggtggctcacacct

SEQ ID NO: 100432 - DNA, 30 bp, Homo sapiens
  misc_feature 1..30: note = chr9:132643791-132643821
  misc_feature 1..30: note = hypo
  source 1..30: mol_type = genomic DNA
ccccccacactactgcgtctttgtttctat

SEQ ID NO: 100433 - DNA, 161 bp, Homo sapiens
  misc_feature 1..161: note = chr9:132691954-132692115
  misc_feature 1..161: note = hypo
  source 1..161: mol_type = genomic DNA
atttgagcttgttgtcgggccttagggcaaaaacaagaatactcctacgtttatacaccatagataaaagcctgggtgcaatcaataaaagcctagaactgcacactgggatgcctaggggccagatttacctcaaatgtattccgcgggtgctttttaat

SEQ ID NO: 100434 - DNA, 30 bp, Homo sapiens
  misc_feature 1..30: note = chr9:13278312-13278342
  misc_feature 1..30: note = hyper
  source 1..30: mol_type = genomic DNA
cggggtcttcccaagcggagcacctcaaaa

SEQ ID NO: 100435 - DNA, 221 bp, Homo sapiens
  misc_feature 1..221: note = chr9:13278735-13278956
  misc_feature 1..221: note = hyper
  source 1..221: mol_type = genomic DNA
tgagggacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggcta

SEQ ID NO: 100436 - DNA, 103 bp, Homo sapiens
  misc_feature 1..103: note = chr9:13279303-13279406
  misc_feature 1..103: note = hyper
  source 1..103: mol_type = genomic DNA
cgagcccagggcgcccgcgcaccttccccgccggcgcgcgcgcagggcgcgggggcgcgcctcggcctctgggccggggctcaagcgccgcttacccggctcg

SEQ ID NO: 100437 - DNA, 116 bp, Homo sapiens; identical to SEQ ID NO: 32380
  misc_feature 1..116: note = chr9:13279633-13279749
  misc_feature 1..116: note = hyper
  source 1..116: mol_type = genomic DNA

SEQ ID NO: 100438 - DNA, 30 bp, Homo sapiens
  misc_feature 1..30: note = chr9:132805344-132805374
  misc_feature 1..30: note = hyper
  source 1..30: mol_type = genomic DNA
cgacggcggaaagcccggagtccgcgcggc

SEQ ID NO: 100439 - DNA, 48 bp, Homo sapiens
  misc_feature 1..48: note = chr9:132805845-132805893
  misc_feature 1..48: note = hyper
  source 1..48: mol_type = genomic DNA
cctggcagccatgcgcgccgagcagagtcagcccgggaggctcttttc

SEQ ID NO: 100440 - DNA, 120 bp, Homo sapiens
  misc_feature 1..120: note = chr9:132815000-132815120
  misc_feature 1..120: note = hypo
  source 1..120: mol_type = genomic DNA
ccaccctgccaggcctcatttcgtttttagtacagtattatattcaaatttaaaaccagagattttcaaagatgccacttaactttaaaagataaaaagtactccaaagcaggttgggcg

SEQ ID NO: 100441 - DNA, 100 bp, Homo sapiens
  misc_feature 1..100: note = chr9:132881395-132881495
  misc_feature 1..100: note = hypo
  source 1..100: mol_type = genomic DNA
aacaatggagggagtcgtgggaccccaggctgcgacctgctgcctggctgctcactgcatcatgctggtttcaccctgctcagagcgggctccacccctg

SEQ ID NO: 100442 - DNA, 30 bp, Homo sapiens
  misc_feature 1..30: note = chr9:133267430-133267460
  misc_feature 1..30: note = hypo
  source 1..30: mol_type = genomic DNA
gagctggctcaaggacggcctgcccctccc

SEQ ID NO: 100443 - DNA, 30 bp, Homo sapiens
  misc_feature 1..30: note = chr9:133270785-133270815
  misc_feature 1..30: note = hypo
  source 1..30: mol_type = genomic DNA
cagacctgacctggccggatccaagatcca

SEQ ID NO: 100444 - DNA, 216 bp, Homo sapiens
  misc_feature 1..216: note = chr9:133308836-133309052
  misc_feature 1..216: note = hyper
  source 1..216: mol_type = genomic DNA
cgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgct

SEQ ID NO: 100445 - DNA, 36 bp, Homo sapiens
  misc_feature 1..36: note = chr9:133319966-133320002
  misc_feature 1..36: note = hyper
  source 1..36: mol_type = genomic DNA
aagtctctcgaaggacggctgcggccaccctccgcc

SEQ ID NO: 100446 - DNA, 367 bp, Homo sapiens
  misc_feature 1..367: note = chr9:133320407-133320774
  misc_feature 1..367: note = hyper
  source 1..367: mol_type = genomic DNA
tgcccactccctagccgagagcacccgcttcccgggcccagaggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtggggg

SEQ ID NO: 100447 - DNA, 30 bp, Homo sapiens
  misc_feature 1..30: note = chr9:133366620-133366650
  misc_feature 1..30: note = hypo
  source 1..30: mol_type = genomic DNA
agcccggcgggattgcgaccccgaaaggag

SEQ ID NO: 100448 - DNA, 23 bp, Homo sapiens
  misc_feature 1..23: note = chr9:133409075-133409098
  misc_feature 1..23: note = hypo
  source 1..23: mol_type = genomic DNA
ttttttttttttagacggagtct

SEQ ID NO: 100449 - DNA, 86 bp, Homo sapiens
  misc_feature 1..86: note = chr9:133506386-133506472
  misc_feature 1..86: note = hypo
  source 1..86: mol_type = genomic DNA
aggactcaccaaggccgcagcagccgaggccccagagccgttcccctgcgggcttagatgagcggctggggcggcagcctcccccc

SEQ ID NO: 100450 - DNA, 30 bp, Homo sapiens; identical to SEQ ID NO: 42237
  misc_feature 1..30: note = chr9:133510031-133510061
  misc_feature 1..30: note = hypo
  source 1..30: mol_type = genomic DNA

SEQ ID NO: 100451 - DNA, 161 bp, Homo sapiens
  misc_feature 1..161: note = chr9:133518349-133518510
  misc_feature 1..161: note = hypo
  source 1..161: mol_type = genomic DNA
ttactcacacaggcacggaggggccagttccatggcaagttcgtgctccactctgctggggtttcagtggagagctacactcttgctgaggcctcctcaaaccttagcctggctgcgataccggcctgccttgccacacccacacacgagcagagccaggc

SEQ ID NO: 100452 - DNA, 981 bp, Homo sapiens
  misc_feature 1..981: note = chr9:133534580-133535561
  misc_feature 1..981: note = hyper
  source 1..981: mol_type = genomic DNA
cgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtggggg

SEQ ID NO: 100453 - DNA, 228 bp, Homo sapiens
  misc_feature 1..228: note = chr9:133535706-133535934
  misc_feature 1..228: note = hyper
  source 1..228: mol_type = genomic DNA
cgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 100454 - DNA, 149 bp, Homo sapiens; identical to SEQ ID NO: 3472
  misc_feature 1..149: note = chr9:133535971-133536120
  misc_feature 1..149: note = hyper
  source 1..149: mol_type = genomic DNA

SEQ ID NO: 100455 - DNA, 196 bp, Homo sapiens; identical to SEQ ID NO: 3473
  misc_feature 1..196: note = chr9:133536149-133536345
  misc_feature 1..196: note = hyper
  source 1..196: mol_type = genomic DNA

SEQ ID NO: 100456 - DNA, 2874 bp, Homo sapiens
  misc_feature 1..2874: note = chr9:133536346-133539220
  misc_feature 1..2874: note = hyper
  source 1..2874: mol_type = genomic DNA
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 100457 - DNA, 722 bp, Homo sapiens
  misc_feature 1..722: note = chr9:133539510-133540232
  misc_feature 1..722: note = hyper
  source 1..722: mol_type = genomic DNA
cgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 100458 - DNA, 43 bp, Homo sapiens
  misc_feature 1..43: note = chr9:133540453-133540496
  misc_feature 1..43: note = hyper
  source 1..43: mol_type = genomic DNA
gcagcccacccggctcaaggaccgaccccggcgaccccgtcgc

SEQ ID NO: 100459 - DNA, 1363 bp, Homo sapiens
  misc_feature 1..1363: note = chr9:133541059-133542422
  misc_feature 1..1363: note = hyper
  source 1..1363: mol_type = genomic DNA
attagcaatttctttcgaatggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggcacctccaacacctgccagcccgaggtctgtccccagcgctgatcacggcccggctcctctgccagtgcccagagcctggacacacagtgggctcccggaagccgactaggcgaaagagtctccggttggccttcacctccttgcaggacctggcctcagtttccctgtgcataaaaccgctcgctgccgttggctcattaattcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccccggacaccctggcag

SEQ ID NO: 100460 - DNA, 90 bp, Homo sapiens
  misc_feature 1..90: note = chr9:133550849-133550939
  misc_feature 1..90: note = hypo
  source 1..90: mol_type = genomic DNA
accctgggcttccaccgaaccagcggcctctgcagctctgctggctcagtgagcactcctgcagggacctggatgcgccagaaaccgctg

SEQ ID NO: 100461 - DNA, 16 bp, Homo sapiens
  misc_feature 1..16: note = chr9:133585587-133585603
  misc_feature 1..16: note = hypo
  source 1..16: mol_type = genomic DNA
gcgactgagcgagact

SEQ ID NO: 100462 - DNA, 24 bp, Homo sapiens
  misc_feature 1..24: note = chr9:133604058-133604082
  misc_feature 1..24: note = hypo
  source 1..24: mol_type = genomic DNA
gagccactgcgcccagcctgtttt

SEQ ID NO: 100463 - DNA, 69 bp, Homo sapiens
  misc_feature 1..69: note = chr9:133767809-133767878
  misc_feature 1..69: note = hypo
  source 1..69: mol_type = genomic DNA
tgctttgcctggccccgggcctgcagccactcccggctgagcgtgggctctccccggggcagagaagtt

SEQ ID NO: 100464 - DNA, 30 bp, Homo sapiens
  misc_feature 1..30: note = chr9:133772234-133772264
  misc_feature 1..30: note = hypo
  source 1..30: mol_type = genomic DNA
gcacacgtgcgtacacgtgtgtgtgctcgt

SEQ ID NO: 100465 - DNA, 30 bp, Homo sapiens
  misc_feature 1..30: note = chr9:133772670-133772700
  misc_feature 1..30: note = hypo
  source 1..30: mol_type = genomic DNA
tgcacccctgtgccccgcaggcacccctgt

SEQ ID NO: 100466 - DNA, 367 bp, Homo sapiens
  misc_feature 1..367: note = chr9:133773692-133774059
  misc_feature 1..367: note = hypo
  source 1..367: mol_type = genomic DNA
catgacagcagtgcccgtgtggtggggtggggttgtcggggtggcatggtgcccgcttaggcagtgttcactgctgctgctagggagggcgcagggtggtggcccccatctaagcccgggtcccctgggctgttggcaactgccgctccggttctgctggccgaacccctcctgccctgggaagccgcttcccatgctgttgggcaccatttctcgcggaattgcatgagcccttgtctgaggacctctgtgactgagtccttgaacctttccaggagctgcctcaggctggtctggtggttgcgggaaaagggttgagttgggcacacctgcacctggcatgggtgtggcacgtggggaggcaggt

SEQ ID NO: 100467 - DNA, 38 bp, Homo sapiens
  misc_feature 1..38: note = chr9:133777251-133777289
  misc_feature 1..38: note = hypo
  source 1..38: mol_type = genomic DNA
acctgcacctgcccccggcccctcgccaggccccagcc

SEQ ID NO: 100468 - DNA, 611 bp, Homo sapiens
  misc_feature 1..611: note = chr9:133779336-133779947
  misc_feature 1..611: note = hypo
  source 1..611: mol_type = genomic DNA
actggagagtgggtccgccaggcacaggtgggtggagaacattcacgaaagagtgaggtggggtcggggatggggcgacagggaccagcagggccaaggacaaggtgcaccagtctagcggtcctcccggaccggccggatcttcatctcagagaacttgagtgagtactgccagccggtccaggaggaccactccacgccgtcggcataggaggcgtgcgcaccgcgcaggtactgcccattgaggttggacgtgtggcagttgcggtaccaccaggcaccgcggtagaaggcggcacagttgttctctgaatggtcgctgtcacggtccttggtggtgaacctcatgccgctgtgcttcaggagggagtcgcctgcgcaggggtgcacacaggtgtgggcacggggggcacgggtacacccactggtgttgcatgtgtgagcagacaccgagacactgcacgtgcacctggacgtgagtgcatacacgtacgcacgtgctctcacacatactgctgtgcacgcgtgcaagcgcacctgcccctccacacccgggtgtgtccatgcagctcacacgcacgcagtcccttctcgggcgtgcctggggctgc

SEQ ID NO: 100469 - DNA, 44 bp, Homo sapiens
  misc_feature 1..44: note = chr9:133782143-133782187
  misc_feature 1..44: note = hypo
  source 1..44: mol_type = genomic DNA
gcaagggcccagcaccgttctcagcccttcgtgcagatgagtga

SEQ ID NO: 100470 - DNA, 72 bp, Homo sapiens
  misc_feature 1..72: note = chr9:133787196-133787268
  misc_feature 1..72: note = hypo
  source 1..72: mol_type = genomic DNA
tgagcctgccaaagccgtctcggtacgcatcccagccccggaagaagttcacggagccgtcctcccggcgct

SEQ ID NO: 100471 - DNA, 48 bp, Homo sapiens
  misc_feature 1..48: note = chr9:133788368-133788416
  misc_feature 1..48: note = hypo
  source 1..48: mol_type = genomic DNA
aaaccggagtccaggcgatggctcaggggaggacgaggagcccacagt

SEQ ID NO: 100472 - DNA, 30 bp, Homo sapiens
  misc_feature 1..30: note = chr9:133794635-133794665
  misc_feature 1..30: note = hypo
  source 1..30: mol_type = genomic DNA
gttgtccccggtcaccggtcacctcgccat

SEQ ID NO: 100473 - DNA, 81 bp, Homo sapiens
  misc_feature 1..81: note = chr9:133799115-133799196
  misc_feature 1..81: note = hypo
  source 1..81: mol_type = genomic DNA
gcctgggacactcaccgtccagccgccgccgtccgtgcgcatgtcacagtacacctggaagccggccgggtagtgggtggg

SEQ ID NO: 100474 - DNA, 30 bp, Homo sapiens
  misc_feature 1..30: note = chr9:133808587-133808617
  misc_feature 1..30: note = hyper
  source 1..30: mol_type = genomic DNA
agatgaagtactgttcgcttttatgggctg

SEQ ID NO: 100475 - DNA, 34 bp, Homo sapiens
  misc_feature 1..34: note = chr9:133814201-133814235
  misc_feature 1..34: note = hyper
  source 1..34: mol_type = genomic DNA
aagccgccagcccaacgcccgccgctcgcgctgc

SEQ ID NO: 100476 - DNA, 70 bp, Homo sapiens
  misc_feature 1..70: note = chr9:133814841-133814911
  misc_feature 1..70: note = hyper
  source 1..70: mol_type = genomic DNA
ccctgcgccggaccccgacgcgtgagcctggccggtgggcgtcccagtccgcgtccgcagacccgtgccc

SEQ ID NO: 100477 - DNA, 70 bp, Homo sapiens
  misc_feature 1..70: note = chr9:133815217-133815287
  misc_feature 1..70: note = hyper
  source 1..70: mol_type = genomic DNA
aaagtccttaatctgcgcggcgaacgagctgctattgtggcttctgaccgggaggcgcccacactgcccg

SEQ ID NO: 100478 - DNA, 30 bp, Homo sapiens
  misc_feature 1..30: note = chr9:133819170-133819200
  misc_feature 1..30: note = hypo
  source 1..30: mol_type = genomic DNA
aagcctggtcggggtcgggggggagtccaa

SEQ ID NO: 100479 - DNA, 33 bp, Homo sapiens
  misc_feature 1..33: note = chr9:133857774-133857807
  misc_feature 1..33: note = hypo
  source 1..33: mol_type = genomic DNA
gagagtgtgtggggccgggcacggtggctcatg

SEQ ID NO: 100480 - DNA, 64 bp, Homo sapiens; identical to SEQ ID NO: 42243
  misc_feature 1..64: note = chr9:133864850-133864914
  misc_feature 1..64: note = hypo
  source 1..64: mol_type = genomic DNA

SEQ ID NO: 100481 - DNA, 189 bp, Homo sapiens; identical to SEQ ID NO: 42244
  misc_feature 1..189: note = chr9:133865355-133865544
  misc_feature 1..189: note = hypo
  source 1..189: mol_type = genomic DNA

SEQ ID NO: 100482 - DNA, 577 bp, Homo sapiens
  misc_feature 1..577: note = chr9:133884368-133884945
  misc_feature 1..577: note = hyper
  source 1..577: mol_type = genomic DNA
tctggggcagactcccgagccgcgcactgccgggcacgtccagcaggtgggagtgggcgcccggggacggcgcggtccctggtatttttagtggggtggggccgccgccgcccgcccctccctccagcctccccgccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccc

SEQ ID NO: 100483 - DNA, 90 bp, Homo sapiens
  misc_feature 1..90: note = chr9:133901867-133901957
  misc_feature 1..90: note = hypo
  source 1..90: mol_type = genomic DNA
cacctctgagttcagcgacatctccccgctgagtggcggcaacgtggccttctccaccctggagggccggcccagcgcctacaacttcga

SEQ ID NO: 100484 - DNA, 65 bp, Homo sapiens
  misc_feature 1..65: note = chr9:133911658-133911723
  misc_feature 1..65: note = hypo
  source 1..65: mol_type = genomic DNA
cccttcttccaggaccgcccgtgggcccggggcaccgccgaggctgcccacgagtgtctgcgtga

SEQ ID NO: 100485 - DNA, 134 bp, Homo sapiens
  misc_feature 1..134: note = chr9:133927347-133927481
  misc_feature 1..134: note = hypo
  source 1..134: mol_type = genomic DNA
ctagtgccttctttccgagttcagggcaagttctgattggaagggaaagcatggcccggggcccagagcacctctgctcactcagccagctcacttaccttgctgtcacctggaggtcccgctaaactcctgct

SEQ ID NO: 100486 - DNA, 66 bp, Homo sapiens
  misc_feature 1..66: note = chr9:133928206-133928272
  misc_feature 1..66: note = hypo
  source 1..66: mol_type = genomic DNA
ggatctcactttgaccgcttctctcgccagcctgcaggagacctccgaggacgtggcccctccact

SEQ ID NO: 100487 - DNA, 241 bp, Homo sapiens
  misc_feature 1..241: note = chr9:133936538-133936779
  misc_feature 1..241: note = hypo
  source 1..241: mol_type = genomic DNA
gccagtcggcctgtacgaccatcccagagagccgggaggtggtgtgtacccactgccccccgggccagagaggtaagtgactcctgccccggagccctgccccgcagagggccaagccccggcactgtgactatgccctgggctccagggttagggccctgggtttagggtgtggcaggtgagggagagcccagcttacgggcagcaggcatgacctctgaggacacggaatccctcagcc

SEQ ID NO: 100488 - DNA, 30 bp, Homo sapiens
  misc_feature 1..30: note = chr9:133948389-133948419
  misc_feature 1..30: note = hypo
  source 1..30: mol_type = genomic DNA
gatgtttgcaaagggcgaggcatgttccga

SEQ ID NO: 100489 - DNA, 30 bp, Homo sapiens
  misc_feature 1..30: note = chr9:133971630-133971660
  misc_feature 1..30: note = hyper
  source 1..30: mol_type = genomic DNA
ggacttgctgaggtccggggaggggcagag

SEQ ID NO: 100490 - DNA, 190 bp, Homo sapiens
  misc_feature 1..190: note = chr9:133971948-133972138
  misc_feature 1..190: note = hyper
  source 1..190: mol_type = genomic DNA
cctgtgcctcctcctcgtccctcgccgcgtccgcgaagcctggagccggcgggagccccgcgctcgccatgtcgggcgagctcagcaacaggttccaaggtaggcgccgccgtccccgagcagccacctgtgcgcgccgggcggaccgcggggtccaccgcgcgcgggaagcgggcggggacgggggcgc

SEQ ID NO: 100491 - DNA, 31 bp, Homo sapiens; identical to SEQ ID NO: 42247
  misc_feature 1..31: note = chr9:134119973-134120004
  misc_feature 1..31: note = hypo
  source 1..31: mol_type = genomic DNA

SEQ ID NO: 100492 - DNA, 28 bp, Homo sapiens
  misc_feature 1..28: note = chr9:134120951-134120979
  misc_feature 1..28: note = hypo
  source 1..28: mol_type = genomic DNA
gggagagacccaccgatcctgtggggct

SEQ ID NO: 100493 - DNA, 30 bp, Homo sapiens
  misc_feature 1..30: note = chr9:134131898-134131928
  misc_feature 1..30: note = hyper
  source 1..30: mol_type = genomic DNA
aacccacagaagacccgaattctgatgccc

SEQ ID NO: 100494 - DNA, 126 bp, Homo sapiens; identical to SEQ ID NO: 42248
  misc_feature 1..126: note = chr9:134135879-134136005
  misc_feature 1..126: note = hypo
  source 1..126: mol_type = genomic DNA

SEQ ID NO: 100495 - DNA, 94 bp, Homo sapiens
  misc_feature 1..94: note = chr9:134136231-134136325
  misc_feature 1..94: note = hypo
  source 1..94: mol_type = genomic DNA
ccaccagcggctgcccgtacttgggccgccacatgaggacctgggcatcgttggcattgggcttgaccagggcgctgggcgggatgggctcatt

SEQ ID NO: 100496 - DNA, 753 bp, Homo sapiens
  misc_feature 1..753: note = chr9:134151929-134152682
  misc_feature 1..753: note = hyper
  source 1..753: mol_type = genomic DNA
ggaaggctctgtccccgcgcggccgcgccaccctcgcggcagaagcctgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcctcaaagttaagccgaactttgctgcggggggcgcgcgggggcggcgacgcgtgtgcgctgggcgcgggctgcggagctgacggcgcagctctgggcggtctccccggaggcggtggcccccgccccccgcgcccgccccgtcagtggcggccgcacgaccgcgcgcaccagcgaataatagccgcccgtgacatctccgctgataccgtcccggacgggcggggtggggggcgagcggctgccgctgcagggggcggcgagcacttgccctgctctgtccccaccgccgcgccgccagcgccaggtgcccctt

SEQ ID NO: 100497 - DNA, 225 bp, Homo sapiens; identical to SEQ ID NO: 32753
  misc_feature 1..225: note = chr9:134158243-134158468
  misc_feature 1..225: note = hyper
  source 1..225: mol_type = genomic DNA

SEQ ID NO: 100498 - DNA, 142 bp, Homo sapiens
  misc_feature 1..142: note = chr9:134171926-134172068
  misc_feature 1..142: note = hypo
  source 1..142: mol_type = genomic DNA
cacggtgcccagcctacacattcttgtagtaagaaaaaatgcaatgattacaaggctagatcaagaagaaagtgagcctctcccttaaaccctctcccaggaagagcctctgccgcagcttgggtcacgtgcccctggattt

SEQ ID NO: 100499 - DNA, 25 bp, Homo sapiens
  misc_feature 1..25: note = chr9:134176645-134176670
  misc_feature 1..25: note = hypo
  source 1..25: mol_type = genomic DNA
gcgctggcctcgaaaggcagatttt

SEQ ID NO: 100500 - DNA, 739 bp, Homo sapiens
  misc_feature 1..739: note = chr9:134191006-134191745
  misc_feature 1..739: note = hypo
  source 1..739: mol_type = genomic DNA
gtgtggaggaatctccgttcctgcccctgtgagcctggcttttctgggaagctctcataagagtgtccaaggtataagcacctctcaggggtggcgagggtgttgcgttgcctccttctacagacgcaaatgccacctaatcacacagctccctctgcaaacccgctcccatctccatagcaactacagggcttcggcgctcttgggctcctggtcactgtggttcaactcctaagagagggagggaccccgggtttgtccccatccagctccaggaaagagacgttggctcgaggaatccgtctcaaggtcaaagagggcgaggtgagggcagggcggggacaggcaggctgcaaacagatccgctctctgctgctctggtcaggaggattctgggaagagaggacggagggacagagatgcagctctgggtgggagggccacagagctcagcgtccactcatcctgtgtgcggctcccacccgccccatccaaaaagtctcagggaggcagcggcacaagggctggctctgggcagtttcctcatctgtaagatgcgtcgatgctctgcgccagcgtatggagaggcagccgctgcagtctgtgccccccacagtctgtacattgaaatcccaaccaaaacacgagggtatgaagaggtgggcgtttggggtcattaggtcatgagggtgggcccacacgacgggattagtgcccttacaaaaaaggctccggatgc

SEQ ID NO: 100501 - DNA, 81 bp, Homo sapiens
  misc_feature 1..81: note = chr9:134207916-134207997
  misc_feature 1..81: note = hypo
  source 1..81: mol_type = genomic DNA
gtggctttgacttaccgtgtaagactccatttcctcatctgtaaaatgaggagaaccggccagccgggcgcagtgactcac

SEQ ID NO: 100502 - DNA, 35 bp, Homo sapiens
  misc_feature 1..35: note = chr9:134421523-134421558
  misc_feature 1..35: note = hyper
  source 1..35: mol_type = genomic DNA
ggcagctcagctcaccgccccggccaggctgaagt

SEQ ID NO: 100503 - DNA, 61 bp, Homo sapiens
  misc_feature 1..61: note = chr9:134421906-134421967
  misc_feature 1..61: note = hyper
  source 1..61: mol_type = genomic DNA
cccctcatcccccagcgcgactgatcttgagagcccggggatggggcgcaccagtcccatc

SEQ ID NO: 100504 - DNA, 33 bp, Homo sapiens
  misc_feature 1..33: note = chr9:134648075-134648108
  misc_feature 1..33: note = hypo
  source 1..33: mol_type = genomic DNA
agccatgtcaggagccgccgccgacatgcgggc

SEQ ID NO: 100505 - DNA, 122 bp, Homo sapiens
  misc_feature 1..122: note = chr9:134717223-134717345
  misc_feature 1..122: note = hypo
  source 1..122: mol_type = genomic DNA
caacagccccagagccgggtgagcccgagtaatggacatacattgagggaagagaaaaagccgagaaaaaagcggtttgaacggggggtgatgtcaccggttacacgcgtggtttctgatgg

SEQ ID NO: 100506 - DNA, 30 bp, Homo sapiens
  misc_feature 1..30: note = chr9:134717710-134717740
  misc_feature 1..30: note = hypo
  source 1..30: mol_type = genomic DNA
gcaggagggtggggacgggctctgggccac

SEQ ID NO: 100507 - DNA, 30 bp, Homo sapiens
  misc_feature 1..30: note = chr9:134718796-134718826
  misc_feature 1..30: note = hypo
  source 1..30: mol_type = genomic DNA
gtttaaagctgagtccgtgaacctcacata

SEQ ID NO: 100508 - DNA, 29 bp, Homo sapiens
  misc_feature 1..29: note = chr9:134723620-134723649
  misc_feature 1..29: note = hypo
  source 1..29: mol_type = genomic DNA
gtgggtggctctgacgctaagactggcct

SEQ ID NO: 100509 - DNA, 30 bp, Homo sapiens; identical to SEQ ID NO: 42254
  misc_feature 1..30: note = chr9:134724244-134724274
  misc_feature 1..30: note = hypo
  source 1..30: mol_type = genomic DNA

SEQ ID NO: 100510 - DNA, 416 bp, Homo sapiens
  misc_feature 1..416: note = chr9:134818649-134819065
  misc_feature 1..416: note = hypo
  source 1..416: mol_type = genomic DNA
aacagacccaaccttcgaaacacaaatcaaccactagtgacttgacagaaataaggaaagcttggaagctcaaattaaaaatctagagacaaaaatgacactctttcttgttgagggagggggtgttggtatgggaggtggtctctggcagtactctctgagtgctgcctcccgagacggtgagcacggctagcgtctgcagcgggctctgcagtgcggcgccccactttgagagcagggctaaggacaggtaggaacagtgtgctcccctcctacacttccaccatatgttacactctgttctgtggcagaatcaaattactttaatttttacctttggaatataggcaaacaagcagtaacacagcagtggtgactagtttacacttgagcagacgcggcgcggaaagacatta

SEQ ID NO: 100511 - DNA, 341 bp, Homo sapiens
  misc_feature 1..341: note = chr9:134913048-134913389
  misc_feature 1..341: note = hypo
  source 1..341: mol_type = genomic DNA
gcaatgacagaaaaccggagctaccctgctggtgatgggaaatgacaatggcattgcaaagaggctctggaaacatcaccaaatgaaagtgggcaaaacagtcaggctttcaccgggcagctgtagactgggaaaagtgctgtgtttctgacacatgagctttggctgacacacaacatgtcccgaccccagacaggagctgcacctagatctctagatctagcaatgcaggatatgtcatctgcctccccaacaccagctgaattctgcctgccccacgaatctcacatcctagggtgcgtgagggtggatttgtgatgcattgacgcaaccaatatgca

SEQ ID NO: 100512 - DNA, 30 bp, Homo sapiens
  misc_feature 1..30: note = chr9:134915848-134915878
  misc_feature 1..30: note = hypo
  source 1..30: mol_type = genomic DNA
gaaggcatcacctgacgagagactgcccgt

SEQ ID NO: 100513 - DNA, 30 bp, Homo sapiens
  misc_feature 1..30: note = chr9:135012697-135012727
  misc_feature 1..30: note = hypo
  source 1..30: mol_type = genomic DNA
cctttcccgtgacaccggggctgcagttcc

SEQ ID NO: 100514 - DNA, 30 bp, Homo sapiens; identical to SEQ ID NO: 42257
  misc_feature 1..30: note = chr9:135027845-135027875
  misc_feature 1..30: note = hypo
  source 1..30: mol_type = genomic DNA

SEQ ID NO: 100515 - DNA, 708 bp, Homo sapiens
  misc_feature 1..708: note = chr9:135036580-135037288
  misc_feature 1..708: note = hyper
  source 1..708: mol_type = genomic DNA
tccacccacccaccccggtacccactgcttggggccttctgggtggcagcacttcacagagagagaccgaggagcagccctgagcccttggctgtggggggtgggggaactgactcacttggcccccctccctcgtgccgatggggcagcccccacacccatgggcgctggcaccccggcaggcccccgggttttggaagaggaagctgcagcccggctgcgcctgaccggagccggctgaggatgcgctctgggcgcagggacccgctggcccccgggccgggaggcgatgtttaggcagcgaccccccagaggctgccggggccaccctggccacgggcccgccgggacgcccctgctcgccgcgcccctccccgggccgtggcgcgtcccccgagccgcgcaatatttccttcctgcacctttaagaagaccgttgctccgtggtgggatggtgtgttaaagccacacagaggaagttacgcagcccggatcagaccgagagataaaagccccgatggtgatcgtgagtgatggcaagaggatttagcctcggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggc

SEQ ID NO: 100516 - DNA, 107 bp, Homo sapiens
  misc_feature 1..107: note = chr9:135037333-135037440
  misc_feature 1..107: note = hyper
  source 1..107: mol_type = genomic DNA
cgctcagcccgggcgggcgatgcgggcggcgcgggcggccccctcccccggcccgcgtctccgggacggctgcgggcggcccccccggcggccggagggctccctgg

SEQ ID NO: 100517 - DNA, 26 bp, Homo sapiens
  misc_feature 1..26: note = chr9:135038238-135038264
  misc_feature 1..26: note = hyper
  source 1..26: mol_type = genomic DNA
gcactggtttggggccggcgtggagt

SEQ ID NO: 100518 - DNA, 111 bp, Homo sapiens; identical to SEQ ID NO: 32758
  misc_feature 1..111: note = chr9:135038352-135038463
  misc_feature 1..111: note = hyper
  source 1..111: mol_type = genomic DNA

SEQ ID NO: 100519 - DNA, 30 bp, Homo sapiens; identical to SEQ ID NO: 42258
  misc_feature 1..30: note = chr9:135054774-135054804
  misc_feature 1..30: note = hypo
  source 1..30: mol_type = genomic DNA

SEQ ID NO: 100520 - DNA, 17 bp, Homo sapiens
  misc_feature 1..17: note = chr9:135067234-135067251
  misc_feature 1..17: note = hypo
  source 1..17: mol_type = genomic DNA
ggcgtgagccaccgcgc

SEQ ID NO: 100521 - DNA, 114 bp, Homo sapiens
  misc_feature 1..114: note = chr9:135091410-135091524
  misc_feature 1..114: note = hypo
  source 1..114: mol_type = genomic DNA
agggttacaggacaccgactgattccccaaggctggtcaccttcctgcctttgcctagcttgaggggtcagaggtttgaacccgactgtctggccaccgcgctacctggtgctg

SEQ ID NO: 100522 - DNA, 175 bp, Homo sapiens
  misc_feature 1..175: note = chr9:135102332-135102507
  misc_feature 1..175: note = hypo
  source 1..175: mol_type = genomic DNA
tgcaagaagaatttccgcacccggtcctggcgggccggctcctacctgccgctgccccatggctctcccaacgcctgtacgtgccatgccccggggccacgagcccacatggctataatcttccctgcccgtcaatcccaggagctgtggatcatacacacgcacacaaacctgc

SEQ ID NO: 100523 - DNA, 165 bp, Homo sapiens
  misc_feature 1..165: note = chr9:135116306-135116471
  misc_feature 1..165: note = hyper
  source 1..165: mol_type = genomic DNA
caaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaa

SEQ ID NO: 100524 - DNA, 40 bp, Homo sapiens
  misc_feature 1..40: note = chr9:135118020-135118060
  misc_feature 1..40: note = hyper
  source 1..40: mol_type = genomic DNA
gaggcccggtgaccacggaactcaccgtctgggggaggag

SEQ ID NO: 100525 - DNA, 30 bp, Homo sapiens
  misc_feature 1..30: note = chr9:135121068-135121098
  misc_feature 1..30: note = hypo
  source 1..30: mol_type = genomic DNA
gggctgccctgtgcacgtgggatgtgcagc

SEQ ID NO: 100526 - DNA, 92 bp, Homo sapiens
  misc_feature 1..92: note = chr9:135129056-135129148
  misc_feature 1..92: note = hypo
  source 1..92: mol_type = genomic DNA
cctccagtgtggcagcggattcaggcaggctcatagacagatgctcaaggcactggtgaaggacctgtgggccacagcgcactcccacggcc

SEQ ID NO: 100527 - DNA, 23 bp, Homo sapiens
  misc_feature 1..23: note = chr9:135135287-135135310
  misc_feature 1..23: note = hypo
  source 1..23: mol_type = genomic DNA
caaaactccgtctcaaaaaaaca

SEQ ID NO: 100528 - DNA, 38 bp, Homo sapiens
  misc_feature 1..38: note = chr9:135230930-135230968
  misc_feature 1..38: note = hypo
  source 1..38: mol_type = genomic DNA
gcagagtaaatccctcgctggtgcggtggctcccgctt

SEQ ID NO: 100529 - DNA, 30 bp, Homo sapiens
  misc_feature 1..30: note = chr9:135239643-135239673
  misc_feature 1..30: note = hypo
  source 1..30: mol_type = genomic DNA
tgtgtgtgtacaaaacgctcttcttgattc

SEQ ID NO: 100530 - DNA, 533 bp, Homo sapiens
  misc_feature 1..533: note = chr9:135285332-135285865
  misc_feature 1..533: note = hyper
  source 1..533: mol_type = genomic DNA
ccgtcgccaaggagacgggccgttgcattcgtcctccaggggtggtcttggttttctttcctctcccagtctgcaacgcggggcccaggagacgccctgaggatcccgcggggctcctgcattgctccggggctctttgcgatgaggggccggcgcgagcggggcgcgcctggctccggaggggtcctggcatctgagtttccccctcaggatcccggtggtgcggcccgggccgcccggcaggcccttcggagctccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggtgagcacccca

SEQ ID NO: 100531 - DNA, 444 bp, Homo sapiens
  misc_feature 1..444: note = chr9:135285880-135286324
  misc_feature 1..444: note = hyper
  source 1..444: mol_type = genomic DNA
cgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcctcacagtgggatgataatggcaccactaaagggactgattgggaagattgaatagggtaatttctgcgggacctcgggacagcgcctgacatggggtaaggctgcaatgggtgctgctgtggtttcccacagagtgaacccacagggtgacagataggtcgcacacgcccagtctaagtcgtggctgccagccctcccagggtaaaggccgcctctccggttccgctgcacgcctggggtacgtctatgcagcggtggctccgtgtctgtcctgga

SEQ ID NO: 100532 - DNA, 68 bp, Homo sapiens
  misc_feature 1..68: note = chr9:135287745-135287813
  misc_feature 1..68: note = hyper
  source 1..68: mol_type = genomic DNA
ccttcgtgggttcttcggggtctttaaggtactttctggagcagttaagatgacgtccacttttcagt

SEQ ID NO: 100533 - DNA, 39 bp, Homo sapiens
  misc_feature 1..39: note = chr9:135426974-135427013
  misc_feature 1..39: note = hypo
  source 1..39: mol_type = genomic DNA
gcccggcccaagcctgggtgctttcgtgagttatcccat

SEQ ID NO: 100534 - DNA, 259 bp, Homo sapiens
  misc_feature 1..259: note = chr9:135454985-135455244
  misc_feature 1..259: note = hyper
  source 1..259: mol_type = genomic DNA
tggagctgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcc

SEQ ID NO: 100535 - DNA, 737 bp, Homo sapiens; identical to SEQ ID NO: 32767
  misc_feature 1..737: note = chr9:135455287-135456024
  misc_feature 1..737: note = hyper
  source 1..737: mol_type = genomic DNA

SEQ ID NO: 100536 - DNA, 126 bp, Homo sapiens; identical to SEQ ID NO: 32768
  misc_feature 1..126: note = chr9:135456079-135456205
  misc_feature 1..126: note = hyper
  source 1..126: mol_type = genomic DNA

SEQ ID NO: 100537 - DNA, 702 bp, Homo sapiens
  misc_feature 1..702: note = chr9:135456234-135456936
  misc_feature 1..702: note = hyper
  source 1..702: mol_type = genomic DNA
cgccctttccgccgcagacccgggttgcgatccctggggctgtgcagagaggatccaggcccgggacacagttcggatctgcccgcggtcctgggccccaacgccgggggctgaccctagaaaggcgctggactggagcccgtgacggggtgggaagggcgagggggcgcatgattcacaatgaaaaggccacgtttccagagttgccttgaaaatgcatccctggacgagctctggctctgcgtggaataagaagccgttagcaggcgtctacactcgcactcggaagctcttgcgtgggtcctgttcagaggtacaacagcaccggccccccaagaggtgcccatgggagaggccataagtggggggtgggcgggttactgccttctttgtcccttgagctgcctcccttgagccacacggatttctcgaggtctccctaacgcccctgacaagatcttcccaagtcctccaacctcgccctgaagtgaagccatcggtctcgtcacttcccaggaagacacctggctttccccactcccgccaggcccacagggtcccaagaggccagagagacaggactgcaaattgtcctacatgggaaacaccgagagcccaacagaaatgccgcaaacaacataacttgaattttcttccccacactagaaaaggggttctcgacgcgcgcgcgcacacacacac

SEQ ID NO: 100538 - DNA, 1444 bp, Homo sapiens
  misc_feature 1..1444: note = chr9:135456996-135458440
  misc_feature 1..1444: note = hyper
  source 1..1444: mol_type = genomic DNA
tccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccc

SEQ ID NO: 100539 - DNA, 191 bp, Homo sapiens; identical to SEQ ID NO: 32774
  misc_feature 1..191: note = chr9:135458456-135458647
  misc_feature 1..191: note = hyper
  source 1..191: mol_type = genomic DNA

SEQ ID NO: 100540 - DNA, 746 bp, Homo sapiens
  misc_feature 1..746: note = chr9:135459996-135460742
  misc_feature 1..746: note = hyper
  source 1..746: mol_type = genomic DNA
caaaccgaaattcatcggtccgactgcacatcccattttcttgatttcccccacacaaatggccgagcctccttcagccaggctgtgccgaccatgcctggaaagtaggcaggtttaacggagcggccaggaggagatccagaggcatgcgggtgtccccaggcccgggcccagtggtccttgctcctcccccggggggcctgcttagagaggcaaagaaaacttgcgctggagagagactggcatggagaagggggaggaggaaggagggggaagtcaatgtaaatatatattcataacatcatggttattatttaccatttgcaacaagaacggccccgctttagttagagcaaagagcacgaatcttccaccgcccatgctaatggctggaactggagatagtgaggcccttgcctccttttatttatttgcccccaggaaggattttgaggacaggtttcgtttaagataattagaatatcaattttcttctcctgtctctgaggatatctgatcgggaggtgacgagggccggctgtctacatatcgcttaaataggtttggagcgaagggggtagaaggtcttgcccaacccccaccccaggtgttgctgcctttgcccctagtgaaaaaaggagcagggtcaggcagcgaggccttgtctggagcgtttctcaaacgtggaggggaccttttcagagctgagaaacagacaccctgagccagtccgtggagcatttaag

SEQ ID NO: 100541 - DNA, 30 bp, Homo sapiens; identical to SEQ ID NO: 32776
  misc_feature 1..30: note = chr9:135461292-135461322
  misc_feature 1..30: note = hyper
  source 1..30: mol_type = genomic DNA

SEQ ID NO: 100542 - DNA, 537 bp, Homo sapiens; identical to SEQ ID NO: 32777
  misc_feature 1..537: note = chr9:135461541-135462078
  misc_feature 1..537: note = hyper
  source 1..537: mol_type = genomic DNA

SEQ ID NO: 100543 - DNA, 519 bp, Homo sapiens
  misc_feature 1..519: note = chr9:135462647-135463166
  misc_feature 1..519: note = hyper
  source 1..519: mol_type = genomic DNA
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctggctgcgggggtagaggcagaaagggaacttcccctttcctcacagctcctggaggggaccaggagtctacaggttggtgctaagggagggccccagagcctcccccattctgtaaaagtgggaaactgagtccctaaggggacaaggccttgcccaaagtccccacagcgagggacagagatgagactagacttggtgtccagcgtccagtcagccct

SEQ ID NO: 100544 - DNA, 34 bp, Homo sapiens
  misc_feature 1..34: note = chr9:135463680-135463714
  misc_feature 1..34: note = hyper
  source 1..34: mol_type = genomic DNA
agccccacagtcactcgcacgctcttagcagagg

SEQ ID NO: 100545 - DNA, 262 bp, Homo sapiens
  misc_feature 1..262: note = chr9:135463992-135464254
  misc_feature 1..262: note = hyper
  source 1..262: mol_type = genomic DNA
tggggccagacagtgcgcagggctcgcagtgcgagccctggaggatggcaggtgcagcctgctccagccggcagggcgtgcgagccgggagcgggtcctctccggttgccatttcaggcctgctcgcttctgctagcttgcagcccggccagcctgcagaggaatcaatcgcattcccttccctgaagagcacccccccatcccctcaggcctctccagggtgatcctaccttcataaagaggcacgcgcagggaggagcac

SEQ ID NO: 100546 - DNA, 275 bp, Homo sapiens
  misc_feature 1..275: note = chr9:135464664-135464939
  misc_feature 1..275: note = hyper
  source 1..275: mol_type = genomic DNA
caggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 100547 - DNA, 874 bp, Homo sapiens
  misc_feature 1..874: note = chr9:135465191-135466065
  misc_feature 1..874: note = hyper
  source 1..874: mol_type = genomic DNA
acccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 100548 - DNA, 576 bp, Homo sapiens
  misc_feature 1..576: note = chr9:135466117-135466693
  misc_feature 1..576: note = hyper
  source 1..576: mol_type = genomic DNA
cgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttcagactataacccctctcgaaaaccatacccacagccaggtccgctactgtttcctccctgccccgaaacaccctcgcacagcagctttc

SEQ ID NO: 100549 - DNA, 204 bp, Homo sapiens; identical to SEQ ID NO: 42260
  misc_feature 1..204: note = chr9:135512910-135513114
  misc_feature 1..204: note = hypo
  source 1..204: mol_type = genomic DNA

SEQ ID NO: 100550 - DNA, 86 bp, Homo sapiens
  misc_feature 1..86: note = chr9:135548179-135548265
  misc_feature 1..86: note = hypo
  source 1..86: mol_type = genomic DNA
agggggataatgaagcgttgtttaggttttttggaagattaaacacacataatcacttggcccagttcttggcacgctgtaaatgc

SEQ ID NO: 100551 - DNA, 85 bp, Homo sapiens
  misc_feature 1..85: note = chr9:135548565-135548650
  misc_feature 1..85: note = hypo
  source 1..85: mol_type = genomic DNA
tctcaaaaaaaaagaaagaaaatataatgcagttatacaggtatgaaggagtaggagtctggattaatgtcgtggttgtggacat

SEQ ID NO: 100552 - DNA, 38 bp, Homo sapiens
  misc_feature 1..38: note = chr9:135645212-135645250
  misc_feature 1..38: note = hyper
  source 1..38: mol_type = genomic DNA
catcaccgccttgtccgcccctccgcttgccagcaatt

SEQ ID NO: 100553 - DNA, 280 bp, Homo sapiens; identical to SEQ ID NO: 32783
  misc_feature 1..280: note = chr9:135645863-135646143
  misc_feature 1..280: note = hyper
  source 1..280: mol_type = genomic DNA

SEQ ID NO: 100554 - DNA, 70 bp, Homo sapiens
  misc_feature 1..70: note = chr9:13568991-13569061
  misc_feature 1..70: note = hyper
  source 1..70: mol_type = genomic DNA
aggccctggttgtgtcgaagtgggactttctgaagagggggcactctgggagagacgggagcaaaggggc

SEQ ID NO: 100555 - DNA, 74 bp, Homo sapiens; identical to SEQ ID NO: 42262
  misc_feature 1..74: note = chr9:135768018-135768092
  misc_feature 1..74: note = hypo
  source 1..74: mol_type = genomic DNA

SEQ ID NO: 100556 - DNA, 30 bp, Homo sapiens; identical to SEQ ID NO: 42263
  misc_feature 1..30: note = chr9:135833429-135833459
  misc_feature 1..30: note = hypo
  source 1..30: mol_type = genomic DNA

SEQ ID NO: 100557 - DNA, 188 bp, Homo sapiens
  misc_feature 1..188: note = chr9:135865042-135865230
  misc_feature 1..188: note = hypo
  source 1..188: mol_type = genomic DNA
tggagtgtcctgttccgcaggggatcccggccgggtccagtcctgagcctgcacctgaccccccggggcctcatttcctccggcaggagcgcagcttcgagtgccgcatgtgcggcaaggccttcaagcgctcgtccacgctgtccacccacctgctcatccactcagacacgcggccctacccctgc

SEQ ID NO: 100558 - DNA, 246 bp, Homo sapiens; identical to SEQ ID NO: 42265
  misc_feature 1..246: note = chr9:135898878-135899124
  misc_feature 1..246: note = hypo
  source 1..246: mol_type = genomic DNA

SEQ ID NO: 100559 - DNA, 56 bp, Homo sapiens; identical to SEQ ID NO: 42266
  misc_feature 1..56: note = chr9:135908143-135908199
  misc_feature 1..56: note = hypo
  source 1..56: mol_type = genomic DNA

SEQ ID NO: 100560 - DNA, 30 bp, Homo sapiens
  misc_feature 1..30: note = chr9:135909759-135909789
  misc_feature 1..30: note = hypo
  source 1..30: mol_type = genomic DNA
ttgttcgtatctgcacggggtaagaacaag

SEQ ID NO: 100561 - DNA, 107 bp, Homo sapiens
  misc_feature 1..107: note = chr9:136029028-136029135
  misc_feature 1..107: note = hypo
  source 1..107: mol_type = genomic DNA
gctggggcttcctgtcgtcccagaggtactcgggggacagcaccttggacggcttgtttgagatgaagtgacggttcaggtggctttcctcccgccaggcagccatg

SEQ ID NO: 100562 - DNA, 675 bp, Homo sapiens
  misc_feature 1..675: note = chr9:136038772-136039447
  misc_feature 1..675: note = hyper
  source 1..675: mol_type = genomic DNA
cccggggggaggacacgcgggaacggctgtaaaacgctgggcgcagcccgggccacagtgagcggagagccggggtcctggggattaggccgctgccactcgggagtgtccggcaagccctctccctctctcttcctctggggcctcagtttccccactcgggcctccaagccccgtctcgcccccgcctcccgcgaacgcagagcccagccccgagcgccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagaggaagacagacaggaaagaggacagaaaagagaagccagacgggaaagagggcgccgcagccccgcccacctaccgcaggccccgcccctgcggtcccagagccccttccctgcggcctgggagcaggatcccgggggaccgagcgc

SEQ ID NO: 100563 - DNA, 30 bp, Homo sapiens
  misc_feature 1..30: note = chr9:136151457-136151487
  misc_feature 1..30: note = hyper
  source 1..30: mol_type = genomic DNA
accctgatcccgtcccgccctcccggggca

SEQ ID NO: 100564 - DNA, 160 bp, Homo sapiens
  misc_feature 1..160: note = chr9:136375573-136375733
  misc_feature 1..160: note = hypo
  source 1..160: mol_type = genomic DNA
aaagtgcttggattacaggcgtgaacctccgcacctggccggacccatgtgactattcgaacttaaattatttaaaatgaggataacatttaaagatccaggtttggggttgtaccagctacgttgcagatgcccaggcaccaggcgtgttgggcagccc

SEQ ID NO: 100565 - DNA, 90 bp, Homo sapiens
  misc_feature 1..90: note = chr9:136378429-136378519
  misc_feature 1..90: note = hypo
  source 1..90: mol_type = genomic DNA
agatgggcctggaatcgctgggtgccgggggacgcaggttgtgaggtgatgtctgggacctgctgccaccacccccgcagtccttcacag

SEQ ID NO: 100566 - DNA, 86 bp, Homo sapiens
  misc_feature 1..86: note = chr9:136383935-136384021
  misc_feature 1..86: note = hypo
  source 1..86: mol_type = genomic DNA
acaggggagaggtgacgggcctcctgggtccccgttcatcgaggctcgcgcagtacgcacccactttgccgcgatgatgaggatgg

SEQ ID NO: 100567 - DNA, 30 bp, Homo sapiens
  misc_feature 1..30: note = chr9:136395929-136395959
  misc_feature 1..30: note = hypo
  source 1..30: mol_type = genomic DNA
agaagcttctgccctcgcccaaagtcaccc

SEQ ID NO: 100568 - DNA, 127 bp, Homo sapiens
  misc_feature 1..127: note = chr9:136399516-136399643
  misc_feature 1..127: note = hyper
  source 1..127: mol_type = genomic DNA
ctggggctttgccaccgccagcctccccggtaacctcaggccagcggctgctccgtctggacacccgacatgtggcccccagttctggacccgggaagaaggcctccctgctcgccgctcctgggcc

SEQ ID NO: 100569 - DNA, 94 bp, Homo sapiens
  misc_feature 1..94: note = chr9:136400112-136400206
  misc_feature 1..94: note = hyper
  source 1..94: mol_type = genomic DNA
ggggtaggagcaccccgcgccctctggagccgttacataacgtggggaggcttgtggggaggggtcgggccgcagagcacggggcagggtggcc

SEQ ID NO: 100570 - DNA, 131 bp, Homo sapiens; identical to SEQ ID NO: 32786
  misc_feature 1..131: note = chr9:136474260-136474391
  misc_feature 1..131: note = hyper
  source 1..131: mol_type = genomic DNA

SEQ ID NO: 100571 - DNA, 161 bp, Homo sapiens; identical to SEQ ID NO: 32787
  misc_feature 1..161: note = chr9:136474431-136474592
  misc_feature 1..161: note = hyper
  source 1..161: mol_type = genomic DNA

SEQ ID NO: 100572 - DNA, 58 bp, Homo sapiens
  misc_feature 1..58: note = chr9:136474724-136474782
  misc_feature 1..58: note = hyper
  source 1..58: mol_type = genomic DNA
cggggcgttccggcttccacaacgttgggatctggagtcaggccgaagctgctgctta

SEQ ID NO: 100573 - DNA, 30 bp, Homo sapiens
  misc_feature 1..30: note = chr9:136477280-136477310
  misc_feature 1..30: note = hypo
  source 1..30: mol_type = genomic DNA
aggatcctagttacacgcagttcttttagg

SEQ ID NO: 100574 - DNA, 59 bp, Homo sapiens
  misc_feature 1..59: note = chr9:136521608-136521667
  misc_feature 1..59: note = hypo
  source 1..59: mol_type = genomic DNA
atggcccggggctgacgggtctcctccaacttgcaggggggcttcgggatcctggagga

SEQ ID NO: 100575 - DNA, 42 bp, Homo sapiens
  misc_feature 1..42: note = chr9:136527279-136527321
  misc_feature 1..42: note = hypo
  source 1..42: mol_type = genomic DNA
tgggttctctctcctcgggacagggagcgcagccaggttctc

SEQ ID NO: 100576 - DNA, 123 bp, Homo sapiens
  misc_feature 1..123: note = chr9:136553113-136553236
  misc_feature 1..123: note = hypo
  source 1..123: mol_type = genomic DNA
cggccgcccccgggccgcaccttgatcggtccatctgccacctcctccctccacggcccacctgcctcccccacactaaaaatatccccactccctgtccaaggctggcgtggcaatgaagcc

SEQ ID NO: 100577 - DNA, 30 bp, Homo sapiens; identical to SEQ ID NO: 42270
  misc_feature 1..30: note = chr9:136559282-136559312
  misc_feature 1..30: note = hypo
  source 1..30: mol_type = genomic DNA

SEQ ID NO: 100578 - DNA, 188 bp, Homo sapiens
  misc_feature 1..188: note = chr9:136573297-136573485
  misc_feature 1..188: note = hypo
  source 1..188: mol_type = genomic DNA
accgcacctgacctgcggttggggtacaccttgcatttctgtcactccgctgccctgaggacgtcccagaccctcgctgccagtccccagcaggagctgtaggggcgttacctcgtgcagcgggtctctcctcatgttgcgcccggccagcggctcatcgtgggggaagacgacggagtagttcttgg

SEQ ID NO: 100579 - DNA, 110 bp, Homo sapiens
  misc_feature 1..110: note = chr9:136603522-136603632
  misc_feature 1..110: note = hyper
  source 1..110: mol_type = genomic DNA
aggatctgggcggagcgtaccgcccaccactgcggcttctaggccagcttagttggggcttctaggccagccctgtgggcagctccctctgagggcggcagagcagggtt

SEQ ID NO: 100580 - DNA, 112 bp, Homo sapiens
  misc_feature 1..112: note = chr9:136658252-136658364
  misc_feature 1..112: note = hyper
  source 1..112: mol_type = genomic DNA
ccggcgcctgcctgccgtgctgcaatcctcgtgctggccaccagagagcagtgcccacttcagtccagaaaacgcagtgtccagacctggcccacagcggaacccaagggag

SEQ ID NO: 100581 - DNA, 39 bp, Homo sapiens
  misc_feature 1..39: note = chr9:136708022-136708061
  misc_feature 1..39: note = hypo
  source 1..39: mol_type = genomic DNA
gcagcgtggagggcccgccagacccgtttaattattgag

SEQ ID NO: 100582 - DNA, 30 bp, Homo sapiens
  misc_feature 1..30: note = chr9:136727495-136727525
  misc_feature 1..30: note = hypo
  source 1..30: mol_type = genomic DNA
agctgtcacaactcacggggtgaatggagc

SEQ ID NO: 100583 - DNA, 97 bp, Homo sapiens
  misc_feature 1..97: note = chr9:136728397-136728494
  misc_feature 1..97: note = hypo
  source 1..97: mol_type = genomic DNA
gctgatcaatccctccgaggagccgggcgcaggcccagagccctcctccgtggagtctaaggaggcaccagcattcggtcagcgctgacacacaaga

SEQ ID NO: 100584 - DNA, 53 bp, Homo sapiens
  misc_feature 1..53: note = chr9:136837620-136837673
  misc_feature 1..53: note = hypo
  source 1..53: mol_type = genomic DNA
tttgccgctggctcccgcagacacatgtagccgaggggcggcccgcctcctgc

SEQ ID NO: 100585 - DNA, 42 bp, Homo sapiens
  misc_feature 1..42: note = chr9:136860951-136860993
  misc_feature 1..42: note = hypo
  source 1..42: mol_type = genomic DNA
tggaagccacagatgcgttaaactgatccaaagacagcttat

SEQ ID NO: 100586 - DNA, 178 bp, Homo sapiens
  misc_feature 1..178: note = chr9:136931060-136931238
  misc_feature 1..178: note = hyper
  source 1..178: mol_type = genomic DNA
tgggtatgactacttcggagtgtagggcaggcactgtttgcaagtcccgtccttcattcaaagctcactcacttccgaagcaggcgcgagctgttgtcaaaggaaagtaattactctactttctaaaaacaaaacaaaaataaaaatggagtgactgcccactcggagaaagcttttg

SEQ ID NO: 100587 - DNA, 145 bp, Homo sapiens
  misc_feature 1..145: note = chr9:136990501-136990646
  misc_feature 1..145: note = hypo
  source 1..145: mol_type = genomic DNA
cacaggagatggggacgaggcccatgctgtagaaggggcagatctgggatctcaccctagacagaccatccaatgggaagggtccgggattgcgggacagaaagaggagacaagagagccaggctagcagcgcccagatggacag

SEQ ID NO: 100588 - DNA, 30 bp, Homo sapiens; identical to SEQ ID NO: 15265
  misc_feature 1..30: note = chr9:136999528-136999558
  misc_feature 1..30: note = hypo
  source 1..30: mol_type = genomic DNA

SEQ ID NO: 100589 - DNA, 32 bp, Homo sapiens
  misc_feature 1..32: note = chr9:137024169-137024201
  misc_feature 1..32: note = hypo
  source 1..32: mol_type = genomic DNA
gggttgggtgctaagcgcgagcctcgccgtcc

SEQ ID NO: 100590 - DNA, 151 bp, Homo sapiens
  misc_feature 1..151: note = chr9:137248217-137248368
  misc_feature 1..151: note = hypo
  source 1..151: mol_type = genomic DNA
ttgtttagctcccaccgggaacacacctgggatggccttgggctggggattgcatgctggccgggccggggagccaggagttgctgcctgtgctcctgcaatgcccaccagggctttcggggtatatagagcagcacggtctgcgggatgg

SEQ ID NO: 100591 - DNA, 126 bp, Homo sapiens
  misc_feature 1..126: note = chr9:137281012-137281138
  misc_feature 1..126: note = hypo
  source 1..126: mol_type = genomic DNA
atggcacagactgcacgttgttgccatttcacggaacccgttttcccggatttgtcaggaggggagagaatggtggaaatgcagttttgctgggttccctgcacacgtgggcgctggctttggtca

SEQ ID NO: 100592 - DNA, 39 bp, Homo sapiens; identical to SEQ ID NO: 32791
  misc_feature 1..39: note = chr9:137295661-137295700
  misc_feature 1..39: note = hyper
  source 1..39: mol_type = genomic DNA

SEQ ID NO: 100593 - DNA, 456 bp, Homo sapiens
  misc_feature 1..456: note = chr9:137299119-137299575
  misc_feature 1..456: note = hyper
  source 1..456: mol_type = genomic DNA
gaggggagcttcctgcgcacaagcggcggcaggggtttgcagaagtggaggctgggggctgcctggccaagcgcttaccgccctgcgcagccaggctggctggcaggctgcagcgggaagcgcctgtgggtcctcggcgctgactgcagagctgggtggaggcagcggaaccaaaactgctgtgtcactgcacgctgcagctgttgccagggtgaccgggtgagtttcccacgcttgcccgggcggcagcgtgcgggccggcgggtggggcggaggggtgtgcagagaggccagtggtgtcgtgccacccgatgcccgggggtgtccactcccctctcctgggtcacgtgaccagggcccctgccctgcggtgttgtggggtgtatgtgtggttcttgggggggtccccagccctcctccgtcctgggaactgggcttcggcgtcctcatgtgtgg

SEQ ID NO: 100594 - DNA, 30 bp, Homo sapiens
  misc_feature 1..30: note = chr9:137306458-137306488
  misc_feature 1..30: note = hypo
  source 1..30: mol_type = genomic DNA
gctcactgtcttgagcgctcagccctgccc

SEQ ID NO: 100595 - DNA, 30 bp, Homo sapiens
  misc_feature 1..30: note = chr9:137312093-137312123
  misc_feature 1..30: note = hypo
  source 1..30: mol_type = genomic DNA
cctttcagcccccagcgtgacagaaggaga

SEQ ID NO: 100596 - DNA, 42 bp, Homo sapiens
  misc_feature 1..42: note = chr9:137312331-137312373
  misc_feature 1..42: note = hypo
  source 1..42: mol_type = genomic DNA
tgccctgccctcttccgagggtcctggcgagtctctgtgcca

SEQ ID NO: 100597 - DNA, 33 bp, Homo sapiens
  misc_feature 1..33: note = chr9:137312923-137312956
  misc_feature 1..33: note = hypo
  source 1..33: mol_type = genomic DNA
ccagtttcgtcagctcgccgcacctgccttcca

SEQ ID NO: 100598 - DNA, 30 bp, Homo sapiens
  misc_feature 1..30: note = chr9:137328381-137328411
  misc_feature 1..30: note = hypo
  source 1..30: mol_type = genomic DNA
cttcttcaagctcatcggggacacacccat

SEQ ID NO: 100599 - DNA, 48 bp, Homo sapiens
  misc_feature 1..48: note = chr9:137386151-137386199
  misc_feature 1..48: note = hypo
  source 1..48: mol_type = genomic DNA
tggggtggtggatggcgctggtatggtgaatggcgctggggtggtgga

SEQ ID NO: 100600 - DNA, 46 bp, Homo sapiens
  misc_feature 1..46: note = chr9:137427038-137427084
  misc_feature 1..46: note = hypo
  source 1..46: mol_type = genomic DNA
gctgccgtaacaaatcgccgtgaatttaaaacgtgtagtttaaaac

SEQ ID NO: 100601 - DNA, 30 bp, Homo sapiens
  misc_feature 1..30: note = chr9:137439116-137439146
  misc_feature 1..30: note = hypo
  source 1..30: mol_type = genomic DNA
agcccgtcctgtggacggctctggagctgg

SEQ ID NO: 100602 - DNA, 195 bp, Homo sapiens
  misc_feature 1..195: note = chr9:137457365-137457560
  misc_feature 1..195: note = hypo
  source 1..195: mol_type = genomic DNA
aaaaggagtgaagtacggatacacaccgcaacacggatacaacttgaaaaggtgccaagcaaaagaagccagtcacagaagaccacacagcccatgatcccatttatcccatgttcacgacagggatctgcagagacagagctgtggtctctcaggaatgaggggctgcggggtagcgggcgatggctaaagggc

SEQ ID NO: 100603 - DNA, 87 bp, Homo sapiens
  misc_feature 1..87: note = chr9:137489165-137489252
  misc_feature 1..87: note = hypo
  source 1..87: mol_type = genomic DNA
ttttcactgtggactcgcctcagagcctcggttttgtccacctgtaaactgaggacagcaaggtctacctgacgggccagcagagag

SEQ ID NO: 100604 - DNA, 195 bp, Homo sapiens
  misc_feature 1..195: note = chr9:137519751-137519946
  misc_feature 1..195: note = hypo
  source 1..195: mol_type = genomic DNA
ccaccagcttcaaagcggggaaaattcctcatcgggcaggggctttggcggggcgccctggtgaatggaagtgcctctccagggggcagcagccaggagatgcccaggcccatggtctcattaacggtgcacaacattctgcctcattttccttggcgcgaggcgtgggttttcctaagccgagaggtgagacgt

SEQ ID NO: 100605 - DNA, 30 bp, Homo sapiens; identical to SEQ ID NO: 32793
  misc_feature 1..30: note = chr9:137533003-137533033
  misc_feature 1..30: note = hyper
  source 1..30: mol_type = genomic DNA

SEQ ID NO: 100606 - DNA, 471 bp, Homo sapiens
  misc_feature 1..471: note = chr9:137533496-137533967
  misc_feature 1..471: note = hyper
  source 1..471: mol_type = genomic DNA
gcgcccagtgggaggcgggggctggcctcgccgagcccagcgccgggctctgatttgctgcgggcgttggggatcgacagcctccgcggctgccttccaggagagagggagggaggaaaagggggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 100607 - DNA, 493 bp, Homo sapiens; identical to SEQ ID NO: 32796
  misc_feature 1..493: note = chr9:137534065-137534558
  misc_feature 1..493: note = hyper
  source 1..493: mol_type = genomic DNA

SEQ ID NO: 100608 - DNA, 90 bp, Homo sapiens
  misc_feature 1..90: note = chr9:137539456-137539546
  misc_feature 1..90: note = hypo
  source 1..90: mol_type = genomic DNA
ccggccccagctggacgggagaggaggagatggcacgtggaacctgccggttgagcgtgaggctgtgggttctgccgcagggcaagccgg

SEQ ID NO: 100609 - DNA, 180 bp, Homo sapiens
  misc_feature 1..180: note = chr9:137580727-137580907
  misc_feature 1..180: note = hypo
  source 1..180: mol_type = genomic DNA
catgaatgagaaatgcggcttcgatttccctccaccctggtctccttcagagccctgcccaggctgctgtcttccctgcactgtcagctggtcatggcgggggtgggggtggcacaggttcctgtctgtacctccttgtggcctgcgcaccaagcacagtgcccgcgctgagtcccctgg

SEQ ID NO: 100610 - DNA, 30 bp, Homo sapiens
  misc_feature 1..30: note = chr9:137601900-137601930
  misc_feature 1..30: note = hypo
  source 1..30: mol_type = genomic DNA
ggcatctgagggagccgcagtcaagcccca

SEQ ID NO: 100611 - DNA, 35 bp, Homo sapiens; identical to SEQ ID NO: 42278
  misc_feature 1..35: note = chr9:137602268-137602303
  misc_feature 1..35: note = hypo
  source 1..35: mol_type = genomic DNA

SEQ ID NO: 100612 - DNA, 34 bp, Homo sapiens
  misc_feature 1..34: note = chr9:137602975-137603009
  misc_feature 1..34: note = hypo
  source 1..34: mol_type = genomic DNA
tgggcatgaattgttcggtcggtggtttggtgcc

SEQ ID NO: 100613 - DNA, 48 bp, Homo sapiens
  misc_feature 1..48: note = chr9:137609353-137609401
  misc_feature 1..48: note = hypo
  source 1..48: mol_type = genomic DNA
agctccagaccctagcgctgcccgtggctctcccggcctccgtccctc

SEQ ID NO: 100614 - DNA, 36 bp, Homo sapiens
  misc_feature 1..36: note = chr9:137616322-137616358
  misc_feature 1..36: note = hypo
  source 1..36: mol_type = genomic DNA
tccctccgccccgcccgtgtgcgcagtggttgtgat

SEQ ID NO: 100615 - DNA, 33 bp, Homo sapiens
  misc_feature 1..33: note = chr9:137616641-137616674
  misc_feature 1..33: note = hypo
  source 1..33: mol_type = genomic DNA
cccagagaggggcctcggcgggggaggtggtgc

SEQ ID NO: 100616 - DNA, 192 bp, Homo sapiens
  misc_feature 1..192: note = chr9:137623351-137623543
  misc_feature 1..192: note = hypo
  source 1..192: mol_type = genomic DNA
ctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaaggggtgagagggtgcaggcccccgttccgggtggggt

SEQ ID NO: 100617 - DNA, 184 bp, Homo sapiens
  misc_feature 1..184: note = chr9:137624178-137624362
  misc_feature 1..184: note = hypo
  source 1..184: mol_type = genomic DNA
ctgtgatggagggggcgggataggtgctgatcaaagccggtcctgcacccaagctctgggcatctcagtgctggtcagtttcacctgggatgaaaagcagctcagagctatcgaggcggaggcggagtcccctttgaggggtggaggagaggatgtaaatggcccattccgtgtaaaagatgcg

SEQ ID NO: 100618 - DNA, 30 bp, Homo sapiens; identical to SEQ ID NO: 42280
  misc_feature 1..30: note = chr9:137631987-137632017
  misc_feature 1..30: note = hypo
  source 1..30: mol_type = genomic DNA

SEQ ID NO: 100619 - DNA, 51 bp, Homo sapiens
  misc_feature 1..51: note = chr9:137638944-137638995
  misc_feature 1..51: note = hypo
  source 1..51: mol_type = genomic DNA
caaatttgaacacttcggaagggttcatgggggtggcgacattctttcctt

SEQ ID NO: 100620 - DNA, 30 bp, Homo sapiens
  misc_feature 1..30: note = chr9:137650802-137650832
  misc_feature 1..30: note = hypo
  source 1..30: mol_type = genomic DNA
ttctttcaataacaacgtgatagaaagcct

SEQ ID NO: 100621 - DNA, 30 bp, Homo sapiens
  misc_feature 1..30: note = chr9:137652857-137652887
  misc_feature 1..30: note = hypo
  source 1..30: mol_type = genomic DNA
acacacgcatacacacgtgcacaggctcca

SEQ ID NO: 100622 - DNA, 233 bp, Homo sapiens
  misc_feature 1..233: note = chr9:137656918-137657151
  misc_feature 1..233: note = hypo
  source 1..233: mol_type = genomic DNA
gttctgcacgagcctcgccgaccggagagggcgtgccagctcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcaggagcgagccggtaatgaggatag

SEQ ID NO: 100623 - DNA, 125 bp, Homo sapiens
  misc_feature 1..125: note = chr9:137667232-137667357
  misc_feature 1..125: note = hypo
  source 1..125: mol_type = genomic DNA
atctgggtgggccagcgctgtcgcaaggcggagttcatgggagctgtccatttattcacaatcattcgtgtttctgccatgacgggctctgacaacctcgttacatggggcgcacagctccagag

SEQ ID NO: 100624 - DNA, 30 bp, Homo sapiens
  misc_feature 1..30: note = chr9:137674975-137675005
  misc_feature 1..30: note = hypo
  source 1..30: mol_type = genomic DNA
gctgcccaggccacacggccggcgcccaca

SEQ ID NO: 100625 - DNA, 35 bp, Homo sapiens; identical to SEQ ID NO: 42284
  misc_feature 1..35: note = chr9:137685677-137685712
  misc_feature 1..35: note = hypo
  source 1..35: mol_type = genomic DNA

SEQ ID NO: 100626 - DNA, 165 bp, Homo sapiens
  misc_feature 1..165: note = chr9:137687742-137687907
  misc_feature 1..165: note = hypo
  source 1..165: mol_type = genomic DNA
cgtccctcggctgaccggaatgcacccacaggccaccctgaactcctccaggacaagctctggggcacttctcgtgtgccccgtgacctgacctgaggctcacctatgagaactcagagcagcagctgtcacatgggggtggccctagagcgggtccctgcgttc

SEQ ID NO: 100627 - DNA, 381 bp, Homo sapiens
  misc_feature 1..381: note = chr9:137694270-137694651
  misc_feature 1..381: note = hypo
  source 1..381: mol_type = genomic DNA
cttagagctgcagaacggggaggggtcaccttgtgtcctagaaagcgcacacctcatgtagcggtgagtaagacgtagacctgctgcagccacagaactgaagggcatgtgggctctgcccctggtgtggcttttctcccatccttggcctgtcctgtggctgaatcagcctccctcagggcacatcccaggaaggcaggcttggccgtgcctcctgaaggcgccaggtgggggaagagggccacgcggggcccagcagatgccaggcagtgagcagcgtaccaacacccaccctctagatttttgccgggaagagaaggcttgcaaaggcacttggaggtttggtgtgcccgcagcagacctttgcgtccatgaccaggg

SEQ ID NO: 100628 - DNA, 30 bp, Homo sapiens
  misc_feature 1..30: note = chr9:137696349-137696379
  misc_feature 1..30: note = hypo
  source 1..30: mol_type = genomic DNA
tatggaaaagatagacgtgccctcagctcc

SEQ ID NO: 100629 - DNA, 30 bp, Homo sapiens
  misc_feature 1..30: note = chr9:137698436-137698466
  misc_feature 1..30: note = hypo
  source 1..30: mol_type = genomic DNA
ggtgttccccacatgcgtggacagaggaag

SEQ ID NO: 100630 - DNA, 30 bp, Homo sapiens
  misc_feature 1..30: note = chr9:137701048-137701078
  misc_feature 1..30: note = hypo
  source 1..30: mol_type = genomic DNA
cccagctggccgagacggtctccaggggcc

SEQ ID NO: 100631 - DNA, 30 bp, Homo sapiens
  misc_feature 1..30: note = chr9:137703099-137703129
  misc_feature 1..30: note = hypo
  source 1..30: mol_type = genomic DNA
cccgggctcaggatgcggtccacccctccc

SEQ ID NO: 100632 - DNA, 397 bp, Homo sapiens
  misc_feature 1..397: note = chr9:137710195-137710592
  misc_feature 1..397: note = hypo
  source 1..397: mol_type = genomic DNA
ctgttgttaaggagacgggaggttgtgcggttccatccctgctcgggcagtggcgctgtgacacccggtctgtggtcggcgcagtcagcggagacgggatccctgctggcctgggagatgatcgggatggagacttgaccagggcagcttccacaggcaatgaaatgtggagaattagggcaaccccggatatggggtcacctgggactcctccagaggtgcccagggtttccgagcagtggtcctgggccagggtgcctggagcctagagctccggacctcattctgccctccgccgtcctgcagggagaagccggcttggaaggccctcctgggaagactggccccatcggcccccagggggcccctgggaagcccggaccggatggccttcgag

SEQ ID NO: 100633 - DNA, 40 bp, Homo sapiens
  misc_feature 1..40: note = chr9:137711094-137711134
  misc_feature 1..40: note = hypo
  source 1..40: mol_type = genomic DNA
gggtcctgagcagctcgggagatcccggaggcccctgcgg

SEQ ID NO: 100634 - DNA, 198 bp, Homo sapiens
  misc_feature 1..198: note = chr9:137716801-137716999
  misc_feature 1..198: note = hypo
  source 1..198: mol_type = genomic DNA
gacaggacgggcagccgcagcctccccatctgtggggccggggtgcgcaagagcctcccctcttgaactttatggaggcatctcagggtgaggccgggtgcagaggccaaggctttgaggtcagactctccaggttctcatctggtcttaggcattttctggcggggtgacctgcttgaacctcgtgttcctgacctg

SEQ ID NO: 100635 - DNA, 264 bp, Homo sapiens
  misc_feature 1..264: note = chr9:137718850-137719114
  misc_feature 1..264: note = hypo
  source 1..264: mol_type = genomic DNA
caagcctgcagctctcgtgcccctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacccctcaatcacgccctgaccgtgct

SEQ ID NO: 100636 - DNA, 300 bp, Homo sapiens
  misc_feature 1..300: note = chr9:137719318-137719618
  misc_feature 1..300: note = hypo
  source 1..300: mol_type = genomic DNA
tctggccagaggccccgcgtggaattcccttagaaaagaggtttctcggccctccttcgcggcctgcctctgcaaatgggtggccttgccgctgtggaaatcacgggccagactcctccaaactcagaggtttcctgggaagccgcggctggtgttcacggcacagcagcgtggggctgctgagcgaccccaggctcccccagtgttgaccagccaggcgtccacaggctgcagcctcgggcctgggctacagctgcttggccaagggcaagtggagacgctttccgaggtggccccctt

SEQ ID NO: 100637 - DNA, 30 bp, Homo sapiens
  misc_feature 1..30: note = chr9:137720183-137720213
  misc_feature 1..30: note = hypo
  source 1..30: mol_type = genomic DNA
agtgccccatggcagcgtgagctggctgca

SEQ ID NO: 100638 - DNA, 63 bp, Homo sapiens
  misc_feature 1..63: note = chr9:137721214-137721277
  misc_feature 1..63: note = hypo
  source 1..63: mol_type = genomic DNA
ggcctccggtctccccgagggcccaggtcaggctcctcacgcagcctccggtctccctgaggg

SEQ ID NO: 100639 - DNA, 161 bp, Homo sapiens
  misc_feature 1..161: note = chr9:137721661-137721822
  misc_feature 1..161: note = hypo
  source 1..161: mol_type = genomic DNA
aggctgcactgaaggcgctcggtgggtcctccctgcagcccccccggcgtgaggatgcaggcgcgggggccgggaaagcctggggccttgctctggaggccggagaagtaacccttttgttctgtttctctccctccccacctccccgctgcatgtttagg

SEQ ID NO: 100640 - DNA, 41 bp, Homo sapiens
  misc_feature 1..41: note = chr9:137722056-137722097
  misc_feature 1..41: note = hypo
  source 1..41: mol_type = genomic DNA
tgcctgcttgcggcacggctggctcgcggctctgcatggca

SEQ ID NO: 100641 - DNA, 156 bp, Homo sapiens
  misc_feature 1..156: note = chr9:137724524-137724680
  misc_feature 1..156: note = hypo
  source 1..156: mol_type = genomic DNA
ccctcccagaaggagcgccggacggcccagcctgtcggttggtattcacttttcctcctcaaggtttgcccgtaaggttctcgtggctgcgtctgaaagcgtggagttcgccgatagccctgggactgcagcgtgttccctcgcccctgggaaggc

SEQ ID NO: 100642 - DNA, 69 bp, Homo sapiens
  misc_feature 1..69: note = chr9:137726887-137726956
  misc_feature 1..69: note = hypo
  source 1..69: mol_type = genomic DNA
ctctgcccaccagaacgtcacctaccactgctaccagtcagtggcctggcaggacgcagccacgggcag

SEQ ID NO: 100643 - DNA, 45 bp, Homo sapiens
  misc_feature 1..45: note = chr9:137730826-137730871
  misc_feature 1..45: note = hypo
  source 1..45: mol_type = genomic DNA
ttgaaaagtcacaaccgtctcatttaattacggaggctgctgcag

SEQ ID NO: 100644 - DNA, 33 bp, Homo sapiens
  misc_feature 1..33: note = chr9:137731553-137731586
  misc_feature 1..33: note = hypo
  source 1..33: mol_type = genomic DNA
tggtctctggctcctcgccggtggggagggtga

SEQ ID NO: 100645 - DNA, 30 bp, Homo sapiens
  misc_feature 1..30: note = chr9:137731848-137731878
  misc_feature 1..30: note = hypo
  source 1..30: mol_type = genomic DNA
ttttgctgtcaagtccgggggtgccccatg

SEQ ID NO: 100646 - DNA, 60 bp, Homo sapiens; identical to SEQ ID NO: 42294
  misc_feature 1..60: note = chr9:137734084-137734144
  misc_feature 1..60: note = hypo
  source 1..60: mol_type = genomic DNA

SEQ ID NO: 100647 - DNA, 30 bp, Homo sapiens
  misc_feature 1..30: note = chr9:137747704-137747734
  misc_feature 1..30: note = hypo
  source 1..30: mol_type = genomic DNA
gccaggcatgggagtcgattagatcagtgc

SEQ ID NO: 100648 - DNA, 30 bp, Homo sapiens
  misc_feature 1..30: note = chr9:137771562-137771592
  misc_feature 1..30: note = hypo
  source 1..30: mol_type = genomic DNA
cattgaaggaaaatccgatgggattttgtt

SEQ ID NO: 100649 - DNA, 30 bp, Homo sapiens
  misc_feature 1..30: note = chr9:137771832-137771862
  misc_feature 1..30: note = hypo
  source 1..30: mol_type = genomic DNA
ctcttctccaaaaggcgaacacaaccactg

SEQ ID NO: 100650 - DNA, 30 bp, Homo sapiens
  misc_feature 1..30: note = chr9:137774917-137774947
  misc_feature 1..30: note = hypo
  source 1..30: mol_type = genomic DNA
tggatttccagctcccggcccctgagtgaa

SEQ ID NO: 100651 - DNA, 30 bp, Homo sapiens
  misc_feature 1..30: note = chr9:137777607-137777637
  misc_feature 1..30: note = hypo
  source 1..30: mol_type = genomic DNA
ccacaggttttccagcggagggtggatggc

SEQ ID NO: 100652 - DNA, 30 bp, Homo sapiens
  misc_feature 1..30: note = chr9:137804943-137804973
  misc_feature 1..30: note = hypo
  source 1..30: mol_type = genomic DNA
ctcaggaaatacccccggtctagcaggtcc

SEQ ID NO: 100653 - DNA, 33 bp, Homo sapiens
  misc_feature 1..33: note = chr9:137805825-137805858
  misc_feature 1..33: note = hypo
  source 1..33: mol_type = genomic DNA
ttgggactcaggtatcggcggaccctcagcccc

SEQ ID NO: 100654 - DNA, 30 bp, Homo sapiens
  misc_feature 1..30: note = chr9:137832202-137832232
  misc_feature 1..30: note = hypo
  source 1..30: mol_type = genomic DNA
gcaccaatcaggcaccggcttccatggctg

SEQ ID NO: 100655 - DNA, 30 bp, Homo sapiens
  misc_feature 1..30: note = chr9:137840749-137840779
  misc_feature 1..30: note = hypo
  source 1..30: mol_type = genomic DNA
gttcctggagtgtggcgcgcccagcaagga

SEQ ID NO: 100656 - DNA, 30 bp, Homo sapiens; identical to SEQ ID NO: 42295
  misc_feature 1..30: note = chr9:137851369-137851399
  misc_feature 1..30: note = hypo
  source 1..30: mol_type = genomic DNA

SEQ ID NO: 100657 - DNA, 576 bp, Homo sapiens
  misc_feature 1..576: note = chr9:137854764-137855340
  misc_feature 1..576: note = hypo
  source 1..576: mol_type = genomic DNA
attgttgagctcccctttcctcctctgcgtaattagtaagatctcttccacctgcctcatgggctgactgagggaacaacccagacagggatgatcatgacggtgctgttggctgactgtggggctcgacactgtgctcatcactttatgcatctgagatggaaatggtctcagccacaggcacagatggggaacccaaggcaaagagaggttaagtaacttacccttggtcatgcagacagtggctgagcccgaattcagccccagtgtctttaactccaggtgtgagggcagcggctccagcacgcgaggccccaggagccaggcactgctcacagcaccaggcgtgaccgcagcggctccagcacgcggggccccgggagccaggcactgctcgcagcgcgggtcgctcacgtgttctttggaggcaaatccatgcggcgttcacacacacggaccttgcagttgcttgcgcctttttttctctccaactcatcacagggcatgacttctctccaagctgcctgaaataaaatgaataactttttatgtgaagttcttcgtgctgaagagaac

SEQ ID NO: 100658 - DNA, 163 bp, Homo sapiens
  misc_feature 1..163: note = chr9:137865081-137865244
  misc_feature 1..163: note = hypo
  source 1..163: mol_type = genomic DNA
cccgacatcaccgggcgtcaagtgcacacgcaggggactgtggtggtgtaaggagagttagccctagactcaattctgctgttttcacttaagaaagcctaaaagcaagatccaagaggacaaattgtttccatgtaacttaactgtgtttcagaatgaactc

SEQ ID NO: 100659 - DNA, 30 bp, Homo sapiens
  misc_feature 1..30: note = chr9:137901149-137901179
  misc_feature 1..30: note = hypo
  source 1..30: mol_type = genomic DNA
attcactggcacccccgtattacccatgct

SEQ ID NO: 100660 - DNA, 30 bp, Homo sapiens
  misc_feature 1..30: note = chr9:137937191-137937221
  misc_feature 1..30: note = hypo
  source 1..30: mol_type = genomic DNA
cgcggcgggacaaaacgcatggaaccattg

SEQ ID NO: 100661 - DNA, 30 bp, Homo sapiens
  misc_feature 1..30: note = chr9:137937533-137937563
  misc_feature 1..30: note = hypo
  source 1..30: mol_type = genomic DNA
agggaccggagatgccgtcacagcagttcc

SEQ ID NO: 100662 - DNA, 170 bp, Homo sapiens; identical to SEQ ID NO: 32797
  misc_feature 1..170: note = chr9:137967194-137967364
  misc_feature 1..170: note = hyper
  source 1..170: mol_type = genomic DNA

SEQ ID NO: 100663 - DNA, 179 bp, Homo sapiens; identical to SEQ ID NO: 32798
  misc_feature 1..179: note = chr9:137967472-137967651
  misc_feature 1..179: note = hyper
  source 1..179: mol_type = genomic DNA

SEQ ID NO: 100664 - DNA, 243 bp, Homo sapiens; identical to SEQ ID NO: 32799
  misc_feature 1..243: note = chr9:137967688-137967931
  misc_feature 1..243: note = hyper
  source 1..243: mol_type = genomic DNA

SEQ ID NO: 100665 - DNA, 30 bp, Homo sapiens
  misc_feature 1..30: note = chr9:137977952-137977982
  misc_feature 1..30: note = hyper
  source 1..30: mol_type = genomic DNA
cttgtggccttgaatcggtgttaaacatgc

SEQ ID NO: 100666 - DNA, 126 bp, Homo sapiens
  misc_feature 1..126: note = chr9:137978937-137979063
  misc_feature 1..126: note = hyper
  source 1..126: mol_type = genomic DNA
aaggccttagggcaccgcggctgccctgggatcgcaggggcgcctttagctctccaccgatgccccgacgcccccctggcgctggaggccctcgcgagtctggctgcttttcggagcctgccctgc

SEQ ID NO: 100667 - DNA, 669 bp, Homo sapiens
  misc_feature 1..669: note = chr9:137979475-137980144
  misc_feature 1..669: note = hyper
  source 1..669: mol_type = genomic DNA
cccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 100668 - DNA, 792 bp, Homo sapiens
  misc_feature 1..792: note = chr9:137980216-137981008
  misc_feature 1..792: note = hyper
  source 1..792: mol_type = genomic DNA
cggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccctcctaagacccctcttgaggccgccctccctgctcc

SEQ ID NO: 100669 - DNA, 30 bp, Homo sapiens
  misc_feature 1..30: note = chr9:138054641-138054671
  misc_feature 1..30: note = hypo
  source 1..30: mol_type = genomic DNA
ctcatgagatcacagcggtaacaccaagga

SEQ ID NO: 100670 - DNA, 30 bp, Homo sapiens
  misc_feature 1..30: note = chr9:138080405-138080435
  misc_feature 1..30: note = hypo
  source 1..30: mol_type = genomic DNA
ccatgacacacttgccgcatgcccactatg

SEQ ID NO: 100671 - DNA, 30 bp, Homo sapiens
  misc_feature 1..30: note = chr9:138131370-138131400
  misc_feature 1..30: note = hypo
  source 1..30: mol_type = genomic DNA
cccagagctcaggcacgtgactgttcagca

SEQ ID NO: 100672 - DNA, 30 bp, Homo sapiens
  misc_feature 1..30: note = chr9:138133678-138133708
  misc_feature 1..30: note = hypo
  source 1..30: mol_type = genomic DNA
aggtttgagatacgccgggatggttcccct

SEQ ID NO: 100673 - DNA, 173 bp, Homo sapiens
  misc_feature 1..173: note = chr9:138218634-138218807
  misc_feature 1..173: note = hypo
  source 1..173: mol_type = genomic DNA
ggctggcctcggcatcgcaggaggtcacacccctgtcagggaatcacagctccttccgggtgcttctgccttcagatctgttgggctactgcgtcatcagcctggagtcctcctcgtcttagagaggagagactgtgccgaaaggtctcagggagctgcgctggaccacacag

SEQ ID NO: 100674 - DNA, 155 bp, Homo sapiens
  misc_feature 1..155: note = chr9:138265117-138265272
  misc_feature 1..155: note = hypo
  source 1..155: mol_type = genomic DNA
aggctctgccagccacgagggcggggaaggtgaagtggagtcagcgtcctctgccagtgcctggaatcctgcaacctggaggcagccttgcgatgagctctgctgcaggcctgtggacgcgagccccactgcttcatggtcgcccactccctctg

SEQ ID NO: 100675 - DNA, 142 bp, Homo sapiens
  misc_feature 1..142: note = chr9:138270882-138271024
  misc_feature 1..142: note = hypo
  source 1..142: mol_type = genomic DNA
ccggccaagccttcacgcagtccacacatccctagcccgggagcccctgctcagaagtctctttacctcctcgggggaaggcagagggaggggagctgaggacactcagcacccagggctttcgcaccgctaacacgtgtcc

SEQ ID NO: 100676 - DNA, 30 bp, Homo sapiens
  misc_feature 1..30: note = chr9:138275014-138275044
  misc_feature 1..30: note = hypo
  source 1..30: mol_type = genomic DNA
taaaaaataggcaaccgacaccagatgtag

SEQ ID NO: 100677 - DNA, 64 bp, Homo sapiens
  misc_feature 1..64: note = chr9:138288949-138289013
  misc_feature 1..64: note = hypo
  source 1..64: mol_type = genomic DNA
tttgtgggaaaggaccgtgagatgcagccagcagatgatttctgtgcttcgtgacccagtttct

SEQ ID NO: 100678 - DNA, 438 bp, Homo sapiens
  misc_feature 1..438: note = chr9:138289352-138289790
  misc_feature 1..438: note = hypo
  source 1..438: mol_type = genomic DNA
gagcccacaacccagcgaggacctggcacagttggcaatgtgagtggtggcccacgacgcaacttgtgattgtggttgtggtggagtaacaacacctcgtccacacctgcccgtggaatgctgcaggccaggcgctgggtcacactcttcacgcggattatctcgtgtgacacctggcccacacccgtccgtggaatgctgcaggccaggcgctcggttacactcttcacgcggattatctcgtgtgacacctggcccacacccgcctgtggaatgctccaagccaggcgctgggttacactcttcacatggatcatctcgtgtgacacctggcccccacccgcctgttgaatgctgcaggccatgcgctgggttacactcttcatgcggattatctcatgtgacacctggcccacacccgtccgtggaatgctgcag

SEQ ID NO: 100679 - DNA, 30 bp, Homo sapiens; identical to SEQ ID NO: 42299
  misc_feature 1..30: note = chr9:138290031-138290061
  misc_feature 1..30: note = hypo
  source 1..30: mol_type = genomic DNA

SEQ ID NO: 100680 - DNA, 30 bp, Homo sapiens
  misc_feature 1..30: note = chr9:138339327-138339357
  misc_feature 1..30: note = hypo
  source 1..30: mol_type = genomic DNA
tacaggtgtcagaatcgcttcagtcacaag

SEQ ID NO: 100681 - DNA, 30 bp, Homo sapiens
  misc_feature 1..30: note = chr9:138354047-138354077
  misc_feature 1..30: note = hypo
  source 1..30: mol_type = genomic DNA
tagacggctccaaaccgtttccagggttcg

SEQ ID NO: 100682 - DNA, 30 bp, Homo sapiens
  misc_feature 1..30: note = chr9:138388283-138388313
  misc_feature 1..30: note = hypo
  source 1..30: mol_type = genomic DNA
atattttaccccatacgggtgacctgtcct

SEQ ID NO: 100683 - DNA, 242 bp, Homo sapiens
  misc_feature 1..242: note = chr9:138393554-138393796
  misc_feature 1..242: note = hypo
  source 1..242: mol_type = genomic DNA
gggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctggga

SEQ ID NO: 100684 - DNA, 146 bp, Homo sapiens
  misc_feature 1..146: note = chr9:138416374-138416520
  misc_feature 1..146: note = hypo
  source 1..146: mol_type = genomic DNA
ccccaaggggagaggcgcttcctccagggtgggcctgtcgtgccgtccatcctcactccgggagatgctcagggatggatggagagcccttcccgttctcccggttctgctgccacaggagccttctcagccgtgcacggcaccct

SEQ ID NO: 100685 - DNA, 48 bp, Homo sapiens
  misc_feature 1..48: note = chr9:138444796-138444844
  misc_feature 1..48: note = hypo
  source 1..48: mol_type = genomic DNA
accacacccaccccacgcctctgcctcccactccgcctcccggacccg

SEQ ID NO: 100686 - DNA, 237 bp, Homo sapiens
  misc_feature 1..237: note = chr9:138506017-138506254
  misc_feature 1..237: note = hypo
  source 1..237: mol_type = genomic DNA
ggtggcaggtgggtccgggcagcgcagaggagggagctggctagggacgctcccccttccccggagccatggccctggagaaaggcccgctcctgctgctggcccttggcctgggcctggcgggtgcccagaaggctctggaagaggtaccggtacagccgggcttcaatgcgcagaaggtacgtgtcatgggtccagtccccagactcaggcctggaacaacggcttgagtgtcac

SEQ ID NO: 100687 - DNA, 30 bp, Homo sapiens
  misc_feature 1..30: note = chr9:138508740-138508770
  misc_feature 1..30: note = hypo
  source 1..30: mol_type = genomic DNA
ggggtctccaacagtcgagggcggcagcat

SEQ ID NO: 100688 - DNA, 176 bp, Homo sapiens
  misc_feature 1..176: note = chr9:138557647-138557823
  misc_feature 1..176: note = hypo
  source 1..176: mol_type = genomic DNA
tgggaggtgtgcctgcggggtccctgtccctgcgctgagagccccctctgtccttccagatccctgctactccaagcattacaggagcccgcccaggcctcccatgcgtgagctgcgactcgggacgggcagggggctggatggggagagcttggggccaacgtcagaggctgcgg

SEQ ID NO: 100689 - DNA, 586 bp, Homo sapiens
  misc_feature 1..586: note = chr9:138562694-138563280
  misc_feature 1..586: note = hypo
  source 1..586: mol_type = genomic DNA
cctgcagtgtggactcggccacccacctgcctctgccagccatgcccggcttgtgtggcccctcaccatagcccgcccagggtctctcgggcatcgaaaggacaagcttaagggtcgtgcaaatgcaccgcgtgtacaggacggctgtgtgcacacgtgcaccggggcgaggggctgtcgatgccacttcccttcgcagtgttctcttagttaccgacagcgtggcagcctgcagttaccagggaagccggagctaggagcagaggcaggcgaagccccaggaggggaggcatgtccactccccacagcccctcccataccagaggcccttgacaatgcgcctgcaggtcaggcgaccagctaggtgtggggtgagcccccgcctctgtttccccaaatgactggtatgttcctgggcacacatccgatggctgccagcctgcacgtcacgcccagctgccggagctactgcgggattccagaacaaggaacgtgacatgctcggcctggagcggaacaaggcacctggctcccgcaccctcgacggggccctgcccagtggacacgaccacgtggaagcctcttc

SEQ ID NO: 100690 - DNA, 78 bp, Homo sapiens
  misc_feature 1..78: note = chr9:138577356-138577434
  misc_feature 1..78: note = hypo
  source 1..78: mol_type = genomic DNA
aggggtagggtgagccggagatgaggtgagcctggggtgagttgagccagggatgcgatgagccgggggtggggtgac

SEQ ID NO: 100691 - DNA, 235 bp, Homo sapiens
  misc_feature 1..235: note = chr9:138577643-138577878
  misc_feature 1..235: note = hypo
  source 1..235: mol_type = genomic DNA
agaaggtcagcagggcggtgagggggtaggaatcggagctgctcagtgggcccagctaccaggagccccggagggtcctcgacggatttgtgcatgagaaaccagatcgcttctacctggggtgggcagctctgctcccgggtggccttggcgctccttggctggctccctggaactggaaagggcagccctggggctcctggtcactgcagggggagtgcgtgggcccctgcac

SEQ ID NO: 100692 - DNA, 30 bp, Homo sapiens; identical to SEQ ID NO: 42308
  misc_feature 1..30: note = chr9:138587151-138587181
  misc_feature 1..30: note = hypo
  source 1..30: mol_type = genomic DNA

SEQ ID NO: 100693 - DNA, 30 bp, Homo sapiens
  misc_feature 1..30: note = chr9:138590884-138590914
  misc_feature 1..30: note = hypo
  source 1..30: mol_type = genomic DNA
gggaccctcggccaccgtaggggccttggg

SEQ ID NO: 100694 - DNA, 36 bp, Homo sapiens
  misc_feature 1..36: note = chr9:138591435-138591471
  misc_feature 1..36: note = hypo
  source 1..36: mol_type = genomic DNA
aatccgcccccatagcgcatgcgctctagccctccc

SEQ ID NO: 100695 - DNA, 30 bp, Homo sapiens; identical to SEQ ID NO: 42310
  misc_feature 1..30: note = chr9:138598276-138598306
  misc_feature 1..30: note = hypo
  source 1..30: mol_type = genomic DNA

SEQ ID NO: 100696 - DNA, 95 bp, Homo sapiens; identical to SEQ ID NO: 3486
  misc_feature 1..95: note = chr9:138606154-138606249
  misc_feature 1..95: note = hyper
  source 1..95: mol_type = genomic DNA

SEQ ID NO: 100697 - DNA, 242 bp, Homo sapiens
  misc_feature 1..242: note = chr9:138606523-138606765
  misc_feature 1..242: note = hyper
  source 1..242: mol_type = genomic DNA
gggacctgctgctgggcgacccgtccttccagaacgacgacaggtagggaccgggcgcggggtgggggctggggtcgccgtcccggcgccgccgcacgcccggagctgtccgcggtgctgacggccggtcccgcgcgcccccgcagccgccggcgcccttcaacttttcccggcttctggggacgcagaagtttcggagggggtgcgggcagggggaagcatcttctcgggagggggtctcc

SEQ ID NO: 100698 - DNA, 46 bp, Homo sapiens
  misc_feature 1..46: note = chr9:138607023-138607069
  misc_feature 1..46: note = hyper
  source 1..46: mol_type = genomic DNA
cctggtcacttattccgagtcaccgtgtccccgtcccctcaacatc

SEQ ID NO: 100699 - DNA, 30 bp, Homo sapiens
  misc_feature 1..30: note = chr9:138610744-138610774
  misc_feature 1..30: note = hypo
  source 1..30: mol_type = genomic DNA
gcaggccgctcccagcggggatgacccagc

SEQ ID NO: 100700 - DNA, 30 bp, Homo sapiens
  misc_feature 1..30: note = chr9:138617193-138617223
  misc_feature 1..30: note = hypo
  source 1..30: mol_type = genomic DNA
gaggccattctggaccgaggggctcagatc

SEQ ID NO: 100701 - DNA, 45 bp, Homo sapiens
  misc_feature 1..45: note = chr9:138627005-138627050
  misc_feature 1..45: note = hypo
  source 1..45: mol_type = genomic DNA
gacaggcagccagggcgacatgcataggagcgtgtgctcagacca

SEQ ID NO: 100702 - DNA, 234 bp, Homo sapiens
  misc_feature 1..234: note = chr9:138627598-138627832
  misc_feature 1..234: note = hypo
  source 1..234: mol_type = genomic DNA
gagcgtggacaagtccggagggctctgccacccggcactgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagccacatcatgtgagatgtgcgggcccagccaggc

SEQ ID NO: 100703 - DNA, 676 bp, Homo sapiens
  misc_feature 1..676: note = chr9:138628067-138628743
  misc_feature 1..676: note = hyper
  source 1..676: mol_type = genomic DNA
gcaggccatcctgagcgccaggcctggtccgcaggccggctggagggccctgccctgccaagcgggactccggctcctctccagcatctgccgcccggggtgggcgcccagggccaccagccctcgcggctcctcccctccccccgtgcgcgactgtcattgttaccattgcttggcttctgccaaagcagccgcagggccaccgggtgcttgaaccttctccatggggcgtcctggcggtggtttgagccgggcagtcctccccgccctccccagccccccagccccggcacccggccgttccactgcgcggcggcgtggggagggcgcggcgcgagctgagatggttccgcccggcgccgcccccgctgcccgccgcccgccgcccgccgcgccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 100704 - DNA, 189 bp, Homo sapiens
  misc_feature 1..189: note = chr9:138634034-138634223
  misc_feature 1..189: note = hypo
  source 1..189: mol_type = genomic DNA
ttggggcagggctggcgggtgcctcacccgctggtctgggtgtagggcaggggagtggagacaaggggacagcctcgcagacctcggcatgaggtggagctcaccgcgctcgcttctggatgctggggaccacacatggggcctgggctggcttcgtgctgagcagggccagggcgagtgcccaaagca

SEQ ID NO: 100705 - DNA, 41 bp, Homo sapiens
  misc_feature 1..41: note = chr9:138636443-138636484
  misc_feature 1..41: note = hypo
  source 1..41: mol_type = genomic DNA
ctcggggggctacagcgggcttcagccgtgtagggacgggg

SEQ ID NO: 100706 - DNA, 46 bp, Homo sapiens
  misc_feature 1..46: note = chr9:138637140-138637186
  misc_feature 1..46: note = hypo
  source 1..46: mol_type = genomic DNA
tcccacctctcagggcgttccaccgagcccacgcccagctcctggg

SEQ ID NO: 100707 - DNA, 168 bp, Homo sapiens
  misc_feature 1..168: note = chr9:138637881-138638049
  misc_feature 1..168: note = hypo
  source 1..168: mol_type = genomic DNA
ctcgtgaagacagatcgcaccagtcacctgaaatacactgcaggggaaaatggatcgttttcatctcctttttgtggtggtgctcggagaagtgggcggccacagttcattaaaaattaaaagcagaggaggcttcattaatgtctctggcatcgcaggctccagttt

SEQ ID NO: 100708 - DNA, 92 bp, Homo sapiens
  misc_feature 1..92: note = chr9:138642834-138642926
  misc_feature 1..92: note = hypo
  source 1..92: mol_type = genomic DNA
ctgctctacattgtgcgcgtcctgctcgatgacccggccctgggcatcggatggtgggccacgtgcgcggccgggcgcggggtcccgggtcc

SEQ ID NO: 100709 - DNA, 144 bp, Homo sapiens
  misc_feature 1..144: note = chr9:138650083-138650227
  misc_feature 1..144: note = hypo
  source 1..144: mol_type = genomic DNA
cccatgggcctcagccgagacacaggtgtggccaggtacaggctgccccgtgggcctcagccgagacgcaggtgtggccgggccgtctgctttccactgtccttctagtctctattcattggctcctggcggggtccacagtcc

SEQ ID NO: 100710 - DNA, 30 bp, Homo sapiens; identical to SEQ ID NO: 42316
  misc_feature 1..30: note = chr9:138651295-138651325
  misc_feature 1..30: note = hypo
  source 1..30: mol_type = genomic DNA

SEQ ID NO: 100711 - DNA, 167 bp, Homo sapiens
  misc_feature 1..167: note = chr9:138651534-138651701
  misc_feature 1..167: note = hypo
  source 1..167: mol_type = genomic DNA
atccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccact

SEQ ID NO: 100712 - DNA, 30 bp, Homo sapiens
  misc_feature 1..30: note = chr9:138653799-138653829
  misc_feature 1..30: note = hypo
  source 1..30: mol_type = genomic DNA
caaataaagcaggagcgaagcgctctctcc

SEQ ID NO: 100713 - DNA, 169 bp, Homo sapiens
  misc_feature 1..169: note = chr9:138655771-138655940
  misc_feature 1..169: note = hypo
  source 1..169: mol_type = genomic DNA
tgacagcagagcccccgccagcaccatccgcggggaagcctctgttccggtcgccctggagtcttgagcacctcccagctgtggaaactgttttgtgtggcaaggcagtggagcctcgtcaccggaacaaagcaggcgctggataagtgcaatgcgatggtcccattta

SEQ ID NO: 100714 - DNA, 240 bp, Homo sapiens; identical to SEQ ID NO: 42319
  misc_feature 1..240: note = chr9:138659727-138659967
  misc_feature 1..240: note = hypo
  source 1..240: mol_type = genomic DNA

SEQ ID NO: 100715 - DNA, 1191 bp, Homo sapiens
  misc_feature 1..1191: note = chr9:138660771-138661962
  misc_feature 1..1191: note = hypo
  source 1..1191: mol_type = genomic DNA
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagctgtgtggggcagcgggaggggctggccctggagctcctcacacaagcacaccaggaggtgctggaggggacggcagacccccatcctcaccgcatccgagaagggacctagggggtccaaactcttcagatgaagtcttatgctgggatcctggggtcagtgaaggcagggtcagaggtcaggtgggggcaggagcaccgtctgatgagcacctctatgggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcggggcagagatgctgaagccggacagcagacacgggggtgccaggcaagggtgcatctgcatagcaccttcaggaagtgagcaggtactgtgggggaggagagagccggcagagcggcaggtggaccggcctcccccactgcccgcagaccacgtggtgtgtgaggaggagtgcaagtacgccatgctggcgctgaactgcatctgcccggcgacctccaccctcatcaccctgctggtgcacacgtcccgcggccagtgagtgccccgtgccccgggggaccgacctccatggcggggccggcgcagggagacaacg

SEQ ID NO: 100716 - DNA, 41 bp, Homo sapiens
  misc_feature 1..41: note = chr9:138662644-138662685
  misc_feature 1..41: note = hypo
  source 1..41: mol_type = genomic DNA
gggagcgggacagggcgggtgagcggcggtacctgaagttg

SEQ ID NO: 100717 - DNA, 222 bp, Homo sapiens
  misc_feature 1..222: note = chr9:138666427-138666649
  misc_feature 1..222: note = hypo
  source 1..222: mol_type = genomic DNA
tgtccatgtgtggtacgtgttgtgtgttgtgtatgttgtgtgtcgatgtgtgtgttgtgtgtctgggtgtgtggtgtgtatgttatgtgtccgtgcacgtggtgcacgtgtgcatacgcctgcatgtgttcatttctgtgcgcatgtgttgtgtgtgtgtccgggtgtgtccatttccgtgtgcctgtatggggccatgtgttatgccgagggctgaccatg

SEQ ID NO: 100718 - DNA, 127 bp, Homo sapiens
  misc_feature 1..127: note = chr9:138670651-138670778
  misc_feature 1..127: note = hypo
  source 1..127: mol_type = genomic DNA
gtgcagaccatgttccggtgcgtccagtgtccggggctcggctctaaaccaccccacagccacgaccacgggccctcgccctgagacccccacagccacgaccacgggccctcgccctgagaccccc

SEQ ID NO: 100719 - DNA, 125 bp, Homo sapiens
  misc_feature 1..125: note = chr9:138671163-138671288
  misc_feature 1..125: note = hypo
  source 1..125: mol_type = genomic DNA
aaccaccatgggccccgccctgagccgcctgcctcccccaggctcttccccagcctcagcatcaccacggagctcacccacccttccaacatgcgcttcatgcagttccgcgccaaggacagcta

SEQ ID NO: 100720 - DNA, 84 bp, Homo sapiens
  misc_feature 1..84: note = chr9:138675763-138675847
  misc_feature 1..84: note = hypo
  source 1..84: mol_type = genomic DNA
tcatgcacacatgtacggtgcacacacagtgccctcgaccccgtggctgccgtgccactggagggacctcggcaccagcccatc

SEQ ID NO: 100721 - DNA, 60 bp, Homo sapiens
  misc_feature 1..60: note = chr9:138678104-138678164
  misc_feature 1..60: note = hypo
  source 1..60: mol_type = genomic DNA
ctcccgcgctggcaccggaggcagctcccagggccgccacacgggcggcggtgaccccgc

SEQ ID NO: 100722 - DNA, 89 bp, Homo sapiens
  misc_feature 1..89: note = chr9:138678379-138678468
  misc_feature 1..89: note = hypo
  source 1..89: mol_type = genomic DNA
ggcgcgggtgggggccggacggacggactgggccagggtcgggccacagccaagaacagtcggccacggcgtcccggggcccgggccgt

SEQ ID NO: 100723 - DNA, 30 bp, Homo sapiens
  misc_feature 1..30: note = chr9:138679557-138679587
  misc_feature 1..30: note = hypo
  source 1..30: mol_type = genomic DNA
gtgtccccctgtccccgccttgaagcttcc

SEQ ID NO: 100724 - DNA, 97 bp, Homo sapiens
  misc_feature 1..97: note = chr9:138680008-138680105
  misc_feature 1..97: note = hypo
  source 1..97: mol_type = genomic DNA
gtaattctgccctggcgggtgccgaccaccgcacaacggggctcgccaacccttcaccgccggcagccttgctgcgccatcccggccaggcaggtgg

SEQ ID NO: 100725 - DNA, 156 bp, Homo sapiens
  misc_feature 1..156: note = chr9:138688832-138688988
  misc_feature 1..156: note = hypo
  source 1..156: mol_type = genomic DNA
tgctcagagagcagccggcccagcccctgcacctgcccggagcctcgctgctccacttgccctggcattcccgaaagcaggctgcaggggagccacagggcacccggggcagagtctcacggagcccccaactcacacattcgatctactgctgcg

SEQ ID NO: 100726 - DNA, 182 bp, Homo sapiens
  misc_feature 1..182: note = chr9:138743697-138743879
  misc_feature 1..182: note = hypo
  source 1..182: mol_type = genomic DNA
ctatgcgtgtacagacgggtgttgcccaggcatactctgagaggggactcgctgggccacgagctaggcacgccctcctgtgtcacctggcaacgcccttctgcctggttgtgcctcgctccagtcccacccacagcactccacagcttgctccttcccacctgcaccgcagcatgaccgac

SEQ ID NO: 100727 - DNA, 284 bp, Homo sapiens; identical to SEQ ID NO: 42327
  misc_feature 1..284: note = chr9:138780586-138780870
  misc_feature 1..284: note = hypo
  source 1..284: mol_type = genomic DNA

SEQ ID NO: 100728 - DNA, 30 bp, Homo sapiens; identical to SEQ ID NO: 42328
  misc_feature 1..30: note = chr9:138781904-138781934
  misc_feature 1..30: note = hypo
  source 1..30: mol_type = genomic DNA

SEQ ID NO: 100729 - DNA, 17 bp, Homo sapiens
  misc_feature 1..17: note = chr9:138812042-138812059
  misc_feature 1..17: note = hypo
  source 1..17: mol_type = genomic DNA
ggcgggaggattgcttt

SEQ ID NO: 100730 - DNA, 58 bp, Homo sapiens
  misc_feature 1..58: note = chr9:138813127-138813185
  misc_feature 1..58: note = hypo
  source 1..58: mol_type = genomic DNA
ctctctcacactgctcggccagccatccggctcctgggacgggcgagcccaggacacc

SEQ ID NO: 100731 - DNA, 32 bp, Homo sapiens
  misc_feature 1..32: note = chr9:138825931-138825963
  misc_feature 1..32: note = hypo
  source 1..32: mol_type = genomic DNA
cactgtgaaggagcacgcgttctgccagcccc

SEQ ID NO: 100732 - DNA, 323 bp, Homo sapiens
  misc_feature 1..323: note = chr9:138831815-138832138
  misc_feature 1..323: note = hypo
  source 1..323: mol_type = genomic DNA
tgtagttagcagagccggggggcagtgcagctcccaggcttgtcttcagggagccacaggttgtgacaggtagaaacgcatcgcttatgtggacacgaggcagtcaggccaacttcagaccctttcaggtttgtcccgatgactgtgtggataagactgtctcggcagccaccgcaggtttaccccagagggccttgttacccaaagagaagtggcattagggaaaggccacgtcagtaagtgcaatctcaacggaaacaaaaatgccattgtaacctgtgaaaaaaggttttattcagattttatcttagaaaaaaaaaaat

SEQ ID NO: 100733 - DNA, 139 bp, Homo sapiens
  misc_feature 1..139: note = chr9:138851512-138851651
  misc_feature 1..139: note = hypo
  source 1..139: mol_type = genomic DNA
ccggcccagagaagttttttaaaatacacacaactagacaagcaacaccacctggctcaaacagcctggatgcccacggagttaccggcgctggagcttagtgatgccccgatggttgttcagacggcaaaatcatgca

SEQ ID NO: 100734 - DNA, 124 bp, Homo sapiens
  misc_feature 1..124: note = chr9:138873414-138873538
  misc_feature 1..124: note = hypo
  source 1..124: mol_type = genomic DNA
ggcgtagccctgccacgaagcctccccatgtcttgcctccagcatcacctggccgagacggacctagggcgtccttctccagcatcatctggccgagacggacctagggcgtccttctccagca

SEQ ID NO: 100735 - DNA, 30 bp, Homo sapiens
  misc_feature 1..30: note = chr9:138880956-138880986
  misc_feature 1..30: note = hypo
  source 1..30: mol_type = genomic DNA
cggagctcagagactcggctgggcactgga

SEQ ID NO: 100736 - DNA, 51 bp, Homo sapiens
  misc_feature 1..51: note = chr9:138970797-138970848
  misc_feature 1..51: note = hypo
  source 1..51: mol_type = genomic DNA
tcgccggcatgatgccgcgccgccgccgcccctctccgattccctaacggt

SEQ ID NO: 100737 - DNA, 30 bp, Homo sapiens
  misc_feature 1..30: note = chr9:138986039-138986069
  misc_feature 1..30: note = hyper
  source 1..30: mol_type = genomic DNA
acgggcccaccagcacgtgggtgaaacacc

SEQ ID NO: 100738 - DNA, 61 bp, Homo sapiens
  misc_feature 1..61: note = chr9:138986272-138986333
  misc_feature 1..61: note = hyper
  source 1..61: mol_type = genomic DNA
agaagcaggaaactccgtcggaaggcctcggtccgccctggccgtgcggggtgcgcggcgg

SEQ ID NO: 100739 - DNA, 76 bp, Homo sapiens
  misc_feature 1..76: note = chr9:138991914-138991990
  misc_feature 1..76: note = hypo
  source 1..76: mol_type = genomic DNA
ttttaccagcggcgccgcctccataccctgcacgaggccccctttctgttttctgagtgctcgctcctttcttcca

SEQ ID NO: 100740 - DNA, 87 bp, Homo sapiens; identical to SEQ ID NO: 42332
  misc_feature 1..87: note = chr9:138994353-138994440
  misc_feature 1..87: note = hypo
  source 1..87: mol_type = genomic DNA

SEQ ID NO: 100741 - DNA, 275 bp, Homo sapiens
  misc_feature 1..275: note = chr9:139000396-139000671
  misc_feature 1..275: note = hypo
  source 1..275: mol_type = genomic DNA
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcatacagcattctgctgggaccgtcgttaatattctgaggaagcggcaagaatgcccgtccccatgtcgtgagccatggtcaacgtgctgctgacacgatggtggctgtgg

SEQ ID NO: 100742 - DNA, 234 bp, Homo sapiens
  misc_feature 1..234: note = chr9:139012272-139012506
  misc_feature 1..234: note = hypo
  source 1..234: mol_type = genomic DNA
ccctcccatgtggctcgtgctgggacgccggcaccgtgagatggcgcccgtggccagatagagggtggcgtgtaaagcaggtggtcacccgtcactcgacttttcgcgtgctggtgagggtggtcgcatgtccatggatcagggctcacacctggcccatctggtggctgtgccatgggaggagcagagccacagccccgctccttgctgtgggtttcccgtgtcctccctgcc

SEQ ID NO: 100743 - DNA, 162 bp, Homo sapiens
  misc_feature 1..162: note = chr9:139024359-139024521
  misc_feature 1..162: note = hyper
  source 1..162: mol_type = genomic DNA
ctccccttcccactgcgcccccgcgtccctgcagccaggggtgcgcgccccgccgcccagtcctgggatggagctgggaaacgcccgctgcggggtgcctgggacccccgaaggcgtcgggagttgggggcaaacggccgccgccggcccgcgtcaggcgcc

SEQ ID NO: 100744 - DNA, 186 bp, Homo sapiens
  misc_feature 1..186: note = chr9:139024749-139024935
  misc_feature 1..186: note = hyper
  source 1..186: mol_type = genomic DNA
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgcgccccagagcctgccccgcccctacgccggt

SEQ ID NO: 100745 - DNA, 175 bp, Homo sapiens
  misc_feature 1..175: note = chr9:139025288-139025463
  misc_feature 1..175: note = hyper
  source 1..175: mol_type = genomic DNA
accgcccggcagcaccgcccccagccccgcgcccggactcctgtgccccttcccttcctcctgagacgggaagagcggccccgcggcctgggcgcgggcttttcttgcaggagcacaggcggggggtgggggacccaggccagggcgcgtgcgtgctcggcgcccactccagacg

SEQ ID NO: 100746 - DNA, 62 bp, Homo sapiens
  misc_feature 1..62: note = chr9:139025663-139025725
  misc_feature 1..62: note = hyper
  source 1..62: mol_type = genomic DNA
gagccaggctggcaccggacgcctcccgtggagacagcgcggggtcccggttccaccaggat

SEQ ID NO: 100747 - DNA, 113 bp, Homo sapiens
  misc_feature 1..113: note = chr9:139030628-139030741
  misc_feature 1..113: note = hyper
  source 1..113: mol_type = genomic DNA
cctgtctcccaggaacgccagcgccctctgcaggacatgtgagcctccaagtcacctcgagattaaagccccccaagcatctggaacagcagctccggcgacagcccttcatt

SEQ ID NO: 100748 - DNA, 241 bp, Homo sapiens
  misc_feature 1..241: note = chr9:139045484-139045725
  misc_feature 1..241: note = hypo
  source 1..241: mol_type = genomic DNA
aaggggctgccagggcggggcaggctctgccacctgcgggcttcaggacctcacctctcctcctgcagtctgctcatcggtgaaatggacggaacagcagcccctgcccgaggtgtggcggtgaagcaagcagtcccatgtcggaggcttagagcggagcccagcacacaaggaagggcctgcacgggtggctaggtctggtgaggaatgaggtctccatgcaccacgtgtgttaggagag

SEQ ID NO: 100749 - DNA, 173 bp, Homo sapiens
  misc_feature 1..173: note = chr9:139047509-139047682
  misc_feature 1..173: note = hypo
  source 1..173: mol_type = genomic DNA
agcccaggtgtcctccggcagacgggtggattaacaagcggtctaactgcgccatggggtataatttaggcttaaaaaggacgcagcgctgacacacgggaaaacacggcgagcctgggagcgtcaggccgagggcaagaagccaggcacaaagaccacgttatgggattcca

SEQ ID NO: 100750 - DNA, 30 bp, Homo sapiens
  misc_feature 1..30: note = chr9:139068966-139068996
  misc_feature 1..30: note = hypo
  source 1..30: mol_type = genomic DNA
aggcagccccacaggcggggcctggatagt

SEQ ID NO: 100751 - DNA, 39 bp, Homo sapiens
  misc_feature 1..39: note = chr9:139069965-139070004
  misc_feature 1..39: note = hypo
  source 1..39: mol_type = genomic DNA
gggaactgggatcagcgtggccttcgtgggcttcacaat

SEQ ID NO: 100752 - DNA, 147 bp, Homo sapiens
  misc_feature 1..147: note = chr9:139077555-139077702
  misc_feature 1..147: note = hypo
  source 1..147: mol_type = genomic DNA
agggcctgccttcttcgcagtggccggccacgtccctgggccacccaggcggcacctgcccctcaggtgactgagccccacctccggagccagctccccaggcccactgggtgccctccctggcccgctgcccgagggtgccacagg

SEQ ID NO: 100753 - DNA, 156 bp, Homo sapiens
  misc_feature 1..156: note = chr9:139078945-139079101
  misc_feature 1..156: note = hypo
  source 1..156: mol_type = genomic DNA
gcaggtgaacatccccgggcctgtggccttcggtaatgataaaatcaaaacagctttggctaaaattcagaacactgcattccaactaaccgttcatttcagtgacaagaaggctccttcctccgtcaaccgtgtcattgccgcacccaagaagtc

SEQ ID NO: 100754 - DNA, 805 bp, Homo sapiens
  misc_feature 1..805: note = chr9:139084546-139085351
  misc_feature 1..805: note = hyper
  source 1..805: mol_type = genomic DNA
tgccacccccagccccgcccccgctgcaagggggatggggtcctgggcaagggtcggtcctctctggtcagcgaccccgctgcctctcgggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggta

SEQ ID NO: 100755 - DNA, 456 bp, Homo sapiens
  misc_feature 1..456: note = chr9:139085372-139085828
  misc_feature 1..456: note = hyper
  source 1..456: mol_type = genomic DNA
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggcactttattaacctgtcagcgcctaaaaggtcccgggcggcctgggggaggggccggaggccggggcggggtgggggcgcggctgggggatttgcgccccctcctcggggctgccccccgccagcccgcgctgcaccccggcggccgcgccccctccctaaattccgccttcgacctgggcccggagccgctttccccgcgggctgcccgttgcccccggagagttcggggtcgtccctccagcgcc

SEQ ID NO: 100756 - DNA, 174 bp, Homo sapiens; identical to SEQ ID NO: 32814
  misc_feature 1..174: note = chr9:139085985-139086159
  misc_feature 1..174: note = hyper
  source 1..174: mol_type = genomic DNA

SEQ ID NO: 100757 - DNA, 531 bp, Homo sapiens
  misc_feature 1..531: note = chr9:139089100-139089631
  misc_feature 1..531: note = hyper
  source 1..531: mol_type = genomic DNA
ccagcagccccgagccgcccacccaggggcagctccctcgtgtgaggtgcagggtggagccgggcctgggtcagaactgagcgtggtctacctcatccagccaggaggcggggctggcagggaagtcggggtaacccccgctgctccccgtggataggtcagaactgggtccgttccctgccagcaccctcatgggtgggggcccgccgggggctcccgagggcacaaggcccaagctggtgtctgggtacaccaggctggagaggaggggctgggggccagggaggctctgcggggcggcgggggatggggggacaccgtaggggctgccgggacgcagctctcggtactgctctgggcctgccaggcctccatgctccagggagaagttgcccagggctcccgagggccggcccaaggcctgggtgggttcccccaagctcccgtagaggccattggccgggcccatttccgccaaggaaggctcatctgcaacagaagcagaggctcagtcagcgcctgccctccacc

SEQ ID NO: 100758 - DNA, 147 bp, Homo sapiens; identical to SEQ ID NO: 32816
  misc_feature 1..147: note = chr9:139090405-139090552
  misc_feature 1..147: note = hyper
  source 1..147: mol_type = genomic DNA

SEQ ID NO: 100759 - DNA, 156 bp, Homo sapiens; identical to SEQ ID NO: 10130
  misc_feature 1..156: note = chr9:139090586-139090742
  misc_feature 1..156: note = hyper
  source 1..156: mol_type = genomic DNA

SEQ ID NO: 100760 - DNA, 454 bp, Homo sapiens; identical to SEQ ID NO: 10131
  misc_feature 1..454: note = chr9:139091071-139091525
  misc_feature 1..454: note = hyper
  source 1..454: mol_type = genomic DNA

SEQ ID NO: 100761 - DNA, 151 bp, Homo sapiens; identical to SEQ ID NO: 32819
  misc_feature 1..151: note = chr9:139093772-139093923
  misc_feature 1..151: note = hyper
  source 1..151: mol_type = genomic DNA

SEQ ID NO: 100762 - DNA, 178 bp, Homo sapiens; identical to SEQ ID NO: 32820
  misc_feature 1..178: note = chr9:139094021-139094199
  misc_feature 1..178: note = hyper
  source 1..178: mol_type = genomic DNA

SEQ ID NO: 100763 - DNA, 98 bp, Homo sapiens; identical to SEQ ID NO: 32821
  misc_feature 1..98: note = chr9:139094635-139094733
  misc_feature 1..98: note = hyper
  source 1..98: mol_type = genomic DNA

SEQ ID NO: 100764 - DNA, 117 bp, Homo sapiens; identical to SEQ ID NO: 32822
  misc_feature 1..117: note = chr9:139095014-139095131
  misc_feature 1..117: note = hyper
  source 1..117: mol_type = genomic DNA

SEQ ID NO: 100765 - DNA, 320 bp, Homo sapiens; identical to SEQ ID NO: 32823
  misc_feature 1..320: note = chr9:139095165-139095485
  misc_feature 1..320: note = hyper
  source 1..320: mol_type = genomic DNA

SEQ ID NO: 100766 - DNA, 637 bp, Homo sapiens
  misc_feature 1..637: note = chr9:139096558-139097195
  misc_feature 1..637: note = hyper
  source 1..637: mol_type = genomic DNA
ggcctccactccaaccgctgtcccgcactcttgcaggccagcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacctcccggggcccctctcgtcgccccggtccccacccccgcctctgccccgtgtcgggcgcgcctccctccctggctgggttgggccgcactcaaggcagcccccgccctcacccctctgagacccagggtggccgtgcccgctcctccctaagc

SEQ ID NO: 100767 - DNA, 249 bp, Homo sapiens
  misc_feature 1..249: note = chr9:139100373-139100622
  misc_feature 1..249: note = hypo
  source 1..249: mol_type = genomic DNA
cccacaaaattaccccgtgttcttcccttgttagaagagcgtttgtaaaaccaggactttgaagccaaaaggtgccatccgatgtgaaaccaggcccgcatgtttataaaatccctgatcataaatattaaagctgcaggtggcacggggcagggctgcctccaagggagcttccgccgtggctggcagcacccgggcactcacacggccgggtggtggtgcttgaccttccaccgcctggacctcacc

SEQ ID NO: 100768 - DNA, 113 bp, Homo sapiens
  misc_feature 1..113: note = chr9:139103518-139103631
  misc_feature 1..113: note = hypo
  source 1..113: mol_type = genomic DNA
ggacagcccagagggcggacatgctccccagatgccctggtgccaggaggatgagccacggactcggccgccagggcccaaaggagcccttccaggggcgcctcccacctccc

SEQ ID NO: 100769 - DNA, 223 bp, Homo sapiens
  misc_feature 1..223: note = chr9:139111161-139111384
  misc_feature 1..223: note = hypo
  source 1..223: mol_type = genomic DNA
cctgggctccggctgcgcttccacctgggggataagaggagacacaccaaatccacagatttacaaccagttccagttgtaataagtactatgactcatttatgtttgtggggaccttaaggcgttttgtaaagctgggttgagcatctgccaagatgagctttattctgactgcgatttccaacacgcctaagagccttcaccgacgcgcccacaatctgcc

SEQ ID NO: 100770 - DNA, 30 bp, Homo sapiens
  misc_feature 1..30: note = chr9:139114451-139114481
  misc_feature 1..30: note = hypo
  source 1..30: mol_type = genomic DNA
ctgcgaagagctgatcgctactctggggcc

SEQ ID NO: 100771 - DNA, 55 bp, Homo sapiens
  misc_feature 1..55: note = chr9:139133128-139133183
  misc_feature 1..55: note = hypo
  source 1..55: mol_type = genomic DNA
acctggcagctctcacgggccgtcagccccgccaaatgcccgctgacacctgcat

SEQ ID NO: 100772 - DNA, 161 bp, Homo sapiens
  misc_feature 1..161: note = chr9:139265268-139265429
  misc_feature 1..161: note = hypo
  source 1..161: mol_type = genomic DNA
gtttcccgggggcagcgggcgcacctccagctgcaggtcacggttccgcatgagcgcggcgcccttctcctcactctggtgcgccaggcgcatggccaggtcgtagttctcctccttgcagcgcttgagctcgcggctgccggcctcgcactcctccttga

SEQ ID NO: 100773 - DNA, 90 bp, Homo sapiens
  misc_feature 1..90: note = chr9:139268822-139268912
  misc_feature 1..90: note = hypo
  source 1..90: mol_type = genomic DNA
aactgtgcacttcagcgtgtgggctgccagagcctcatccctgcaggcttgggaacccccaggccccgcctcacccggtaaagctggttg

SEQ ID NO: 100774 - DNA, 212 bp, Homo sapiens
  misc_feature 1..212: note = chr9:139317654-139317866
  misc_feature 1..212: note = hypo
  source 1..212: mol_type = genomic DNA
tccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattct

SEQ ID NO: 100775 - DNA, 40 bp, Homo sapiens
  misc_feature 1..40: note = chr9:139367918-139367958
  misc_feature 1..40: note = hypo
  source 1..40: mol_type = genomic DNA
gaagaatcttctgcacgagcacagccggtccccgagccgc

SEQ ID NO: 100776 - DNA, 31 bp, Homo sapiens
  misc_feature 1..31: note = chr9:139375341-139375372
  misc_feature 1..31: note = hypo
  source 1..31: mol_type = genomic DNA
aaaaaaaaaattattccgcagctctcctaga

SEQ ID NO: 100777 - DNA, 28 bp, Homo sapiens
  misc_feature 1..28: note = chr9:139375871-139375899
  misc_feature 1..28: note = hypo
  source 1..28: mol_type = genomic DNA
gagccaccgcgcccggcccagggaattt

SEQ ID NO: 100778 - DNA, 57 bp, Homo sapiens
  misc_feature 1..57: note = chr9:139403416-139403473
  misc_feature 1..57: note = hypo
  source 1..57: mol_type = genomic DNA
cgcactcattgacatcgtgctggcagtagctgcccgtgaagccgggtggacacaggc

SEQ ID NO: 100779 - DNA, 30 bp, Homo sapiens; identical to SEQ ID NO: 42346
  misc_feature 1..30: note = chr9:139412504-139412534
  misc_feature 1..30: note = hypo
  source 1..30: mol_type = genomic DNA

SEQ ID NO: 100780 - DNA, 30 bp, Homo sapiens; identical to SEQ ID NO: 42347
  misc_feature 1..30: note = chr9:139419942-139419972
  misc_feature 1..30: note = hypo
  source 1..30: mol_type = genomic DNA

SEQ ID NO: 100781 - DNA, 229 bp, Homo sapiens
  misc_feature 1..229: note = chr9:139421894-139422123
  misc_feature 1..229: note = hypo
  source 1..229: mol_type = genomic DNA
gcacccaacagctgccgcgcccacggggatcctcagggcttccatgagtgacccgcaccccaccttccaccgtccccgcatctcctcctatcaggggcggtggggagacccctctggggctaaaaagtgaggcttgagatagggaacgccagtctcccccgactggacgagagagctgccctgtccaccaagccacccagctctcgggctcccacggaggagacccaac

SEQ ID NO: 100782 - DNA, 127 bp, Homo sapiens
  misc_feature 1..127: note = chr9:139471982-139472109
  misc_feature 1..127: note = hypo
  source 1..127: mol_type = genomic DNA
ggacacaaaaagaggcgagactggatcagagatcccagcgagcagcgcccaggctccagggccggaggagctgcggggctcggacaaaccccaggtgctggcggcatcaccgcgggctcctttgact

SEQ ID NO: 100783 - DNA, 40 bp, Homo sapiens; identical to SEQ ID NO: 15284
  misc_feature 1..40: note = chr9:139472499-139472539
  misc_feature 1..40: note = hypo
  source 1..40: mol_type = genomic DNA

SEQ ID NO: 100784 - DNA, 15 bp, Homo sapiens
  misc_feature 1..15: note = chr9:139482817-139482832
  misc_feature 1..15: note = hyper
  source 1..15: mol_type = genomic DNA
cggaggagcccaggc

SEQ ID NO: 100785 - DNA, 30 bp, Homo sapiens; identical to SEQ ID NO: 42350
  misc_feature 1..30: note = chr9:139487465-139487495
  misc_feature 1..30: note = hypo
  source 1..30: mol_type = genomic DNA

SEQ ID NO: 100786 - skipped

SEQ ID NO: 100787 - DNA, 54 bp, Homo sapiens
  misc_feature 1..54: note = chr9:139491107-139491161
  misc_feature 1..54: note = hypo
  source 1..54: mol_type = genomic DNA
cggttatgagaaacactccccgttacagcattttacgttcgcagggaaaatgcc

SEQ ID NO: 100788 - DNA, 51 bp, Homo sapiens
  misc_feature 1..51: note = chr9:139501991-139502042
  misc_feature 1..51: note = hypo
  source 1..51: mol_type = genomic DNA
accagggaggctgtgcggggagggcccggacagtgacgcccccacggctgt

SEQ ID NO: 100789 - DNA, 30 bp, Homo sapiens; identical to SEQ ID NO: 42351
  misc_feature 1..30: note = chr9:139504374-139504404
  misc_feature 1..30: note = hypo
  source 1..30: mol_type = genomic DNA

SEQ ID NO: 100790 - DNA, 170 bp, Homo sapiens
  misc_feature 1..170: note = chr9:139504817-139504987
  misc_feature 1..170: note = hypo
  source 1..170: mol_type = genomic DNA
gggcggaggggagggcgacttcggtgttttccagcattattctagtggccacagcccccaggcctgtttcctctgtaaatggagatggcagcccaccccacgggcgctggaggggagctgaccctcaggccagtcaggagccctgtgacgggactcgctggagggcaccc

SEQ ID NO: 100791 - DNA, 101 bp, Homo sapiens; identical to SEQ ID NO: 42353
  misc_feature 1..101: note = chr9:139505621-139505722
  misc_feature 1..101: note = hypo
  source 1..101: mol_type = genomic DNA

SEQ ID NO: 100792 - DNA, 76 bp, Homo sapiens; identical to SEQ ID NO: 42354
  misc_feature 1..76: note = chr9:139506440-139506516
  misc_feature 1..76: note = hypo
  source 1..76: mol_type = genomic DNA

SEQ ID NO: 100793 - DNA, 30 bp, Homo sapiens; identical to SEQ ID NO: 42355
  misc_feature 1..30: note = chr9:139517238-139517268
  misc_feature 1..30: note = hypo
  source 1..30: mol_type = genomic DNA

SEQ ID NO: 100794 - DNA, 33 bp, Homo sapiens
  misc_feature 1..33: note = chr9:139535581-139535614
  misc_feature 1..33: note = hypo
  source 1..33: mol_type = genomic DNA
tgacctcatgcaatccggcgactctgctgcaga

SEQ ID NO: 100795 - DNA, 151 bp, Homo sapiens
  misc_feature 1..151: note = chr9:139546454-139546605
  misc_feature 1..151: note = hypo
  source 1..151: mol_type = genomic DNA
ttcattcctctttacggctcagcagtgtctcactgtacggatgggccttggcttgtcaatgcactcatccgtggatgcgcatccgggtctatccacctctcggctcctgtgagcacaacgctgtgtgtacattgcgcgtctgtttgaatcc

SEQ ID NO: 100796 - DNA, 52 bp, Homo sapiens
  misc_feature 1..52: note = chr9:139560006-139560058
  misc_feature 1..52: note = hyper
  source 1..52: mol_type = genomic DNA
gggccccaggattcccggagggggtgctggcgggccgcggctcagaggcgcg

SEQ ID NO: 100797 - DNA, 429 bp, Homo sapiens
  misc_feature 1..429: note = chr9:139606291-139606720
  misc_feature 1..429: note = hyper
  source 1..429: mol_type = genomic DNA
agctggaagcgccggcggccgcggggagggagcgagtcttggcagctgctggctgcgccccacatccctcaccgtccaactcagcccccccaggtgtttaccgaagtgcaatgaaagcttctgttcacacggaacctgcctatggaggcggcaacggctcatccccgagcaccccacgcggaggcgaaggaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagccctgaaccccgcagcctgcgtagcgcacggggcctctctccagcgtgggaagagcccc

SEQ ID NO: 100798 - DNA, 336 bp, Homo sapiens
  misc_feature 1..336: note = chr9:139606963-139607299
  misc_feature 1..336: note = hyper
  source 1..336: mol_type = genomic DNA
cggccgacagaaaggcgcgcgccctcgcctttaacgcgggcccgggggcgcgcggcccgcatggcgagggagcggcggccgctgcgggccgggccgggccggggctgaggccgagcgagccgcggggcccgcgcagccccggccggagcccaccatgcggcggctgcggcgcctggcgcacctggtgctcttctgccccttctccaagcgcctgcaggtaagcgcggtgcgcgcccgccgcccccggccgcctctgcctggggaggccgagctccagccccggagtgggccgagtacggagcggggccccgggttcggacacgaagggttcatgag

SEQ ID NO: 100799 - DNA, 180 bp, Homo sapiens
  misc_feature 1..180: note = chr9:139634047-139634227
  misc_feature 1..180: note = hypo
  source 1..180: mol_type = genomic DNA
aggagacacatgagccgtgaacacgtctcccccggccgctccctggttccatgcgtgctcgtcttgggcaccacgagaacacagccatgcagcccccgatcctgcagccacagccacggcatcgcctggtcggatgcagcatctgctccggacgcctctcgctgtcggtgccaggcctgc

SEQ ID NO: 100800 - DNA, 30 bp, Homo sapiens
  misc_feature 1..30: note = chr9:139634437-139634467
  misc_feature 1..30: note = hypo
  source 1..30: mol_type = genomic DNA
ccagaatgtcacaagcgtccatgaattcct

SEQ ID NO: 100801 - DNA, 195 bp, Homo sapiens
  misc_feature 1..195: note = chr9:139638343-139638538
  misc_feature 1..195: note = hypo
  source 1..195: mol_type = genomic DNA
ggactgggttgggcacgcgtcttctttgcagctggctctatggttctgtggcttggcccttggtgacgacccccgccatcctccccgcaattccccggctggcccccagtcaaaagcatccttggtttgctgtggaatcgctttattctgagctggtgctgggccccgggagccgctgagcgaggtgggtggaca

SEQ ID NO: 100802 - DNA, 138 bp, Homo sapiens; identical to SEQ ID NO: 42359
  misc_feature 1..138: note = chr9:139654706-139654844
  misc_feature 1..138: note = hypo
  source 1..138: mol_type = genomic DNA

SEQ ID NO: 100803 - DNA, 179 bp, Homo sapiens
  misc_feature 1..179: note = chr9:139662229-139662408
  misc_feature 1..179: note = hypo
  source 1..179: mol_type = genomic DNA
tgggagatgagaacacgctcagcatcagtccatgggaagatgcaacctggaagctttttgagacccctctgtgcacctcgcagaccatggaaggcgttccacagaaacaggctcaatccctagagcctgtgagggctgggagtcagcagagctatcaccctctgcgggaagaacaagac

SEQ ID NO: 100804 - DNA, 595 bp, Homo sapiens; identical to SEQ ID NO: 42361
  misc_feature 1..595: note = chr9:139698658-139699253
  misc_feature 1..595: note = hypo
  source 1..595: mol_type = genomic DNA

SEQ ID NO: 100805 - DNA, 30 bp, Homo sapiens
  misc_feature 1..30: note = chr9:139701246-139701276
  misc_feature 1..30: note = hypo
  source 1..30: mol_type = genomic DNA
caagctggcgtactgcgaggggaagctcac

SEQ ID NO: 100806 - DNA, 87 bp, Homo sapiens
  misc_feature 1..87: note = chr9:139703836-139703923
  misc_feature 1..87: note = hypo
  source 1..87: mol_type = genomic DNA
aagctgcagaccactcgggccaccctcacccagacacctttagcagtaagcaagataaaacaacttcttaaagataagtctgagcat

SEQ ID NO: 100807 - DNA, 387 bp, Homo sapiens
  misc_feature 1..387: note = chr9:139704043-139704430
  misc_feature 1..387: note = hypo
  source 1..387: mol_type = genomic DNA
tagtgaaacaccgtctctactaaaaatacgaaaaaaaaatttaaaagaaagttgatgtccgaaccaagggccgtattggcttttcttatactctagaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 100808 - DNA, 99 bp, Homo sapiens; identical to SEQ ID NO: 42364
  misc_feature 1..99: note = chr9:139705312-139705411
  misc_feature 1..99: note = hypo
  source 1..99: mol_type = genomic DNA

SEQ ID NO: 100809 - DNA, 98 bp, Homo sapiens; identical to SEQ ID NO: 42365
  misc_feature 1..98: note = chr9:139714085-139714183
  misc_feature 1..98: note = hypo
  source 1..98: mol_type = genomic DNA

SEQ ID NO: 100810 - DNA, 333 bp, Homo sapiens
  misc_feature 1..333: note = chr9:139717731-139718064
  misc_feature 1..333: note = hypo
  source 1..333: mol_type = genomic DNA
gctgccccctgggcccggttcgccgttgatgctctgtgtgctgccaggtgtcctcctgatgggagaggttgccatggtacccacccatcgtcttcctcccctgcctgccggtcacctggtctgattctagcaagaaagatgaaacaggtggcagcagaaccggctctccttgtagttgctcttaaagctgcagcttgggttcggttcgtttaatttgccttttctttttctcttcccgtccccagtgaagatagtgatccggggagacaggaacacgggcaagacagcgctgtggcaccgcctgcagggccggccgttcgtggaggagtacat

SEQ ID NO: 100811 - DNA, 34 bp, Homo sapiens
  misc_feature 1..34: note = chr9:139721948-139721982
  misc_feature 1..34: note = hypo
  source 1..34: mol_type = genomic DNA
ccagtctcaatggctcgcccggggggtgctggtt

SEQ ID NO: 100812 - DNA, 191 bp, Homo sapiens
  misc_feature 1..191: note = chr9:139734907-139735098
  misc_feature 1..191: note = hypo
  source 1..191: mol_type = genomic DNA
ggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctgga

SEQ ID NO: 100813 - DNA, 36 bp, Homo sapiens
  misc_feature 1..36: note = chr9:139735532-139735568
  misc_feature 1..36: note = hypo
  source 1..36: mol_type = genomic DNA
cagtggcctcagctgcgcccccgctcaggtgagccc

SEQ ID NO: 100814 - DNA, 80 bp, Homo sapiens; identical to SEQ ID NO: 32827
  misc_feature 1..80: note = chr9:139739053-139739133
  misc_feature 1..80: note = hyper
  source 1..80: mol_type = genomic DNA

SEQ ID NO: 100815 - DNA, 54 bp, Homo sapiens; identical to SEQ ID NO: 32828
  misc_feature 1..54: note = chr9:139739447-139739501
  misc_feature 1..54: note = hyper
  source 1..54: mol_type = genomic DNA

SEQ ID NO: 100816 - DNA, 83 bp, Homo sapiens
  misc_feature 1..83: note = chr9:139740567-139740650
  misc_feature 1..83: note = hyper
  source 1..83: mol_type = genomic DNA
ggccccacctctggccgccagcggagcctagagcagctggacgagctcatcacggacctggtcatcgactcgcgacccaccgc

SEQ ID NO: 100817 - DNA, 212 bp, Homo sapiens
  misc_feature 1..212: note = chr9:139741076-139741288
  misc_feature 1..212: note = hyper
  source 1..212: mol_type = genomic DNA
gcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaac

SEQ ID NO: 100818 - DNA, 96 bp, Homo sapiens
  misc_feature 1..96: note = chr9:139741718-139741814
  misc_feature 1..96: note = hyper
  source 1..96: mol_type = genomic DNA
gtgcatgatcatggccgcctccgagccgcgcgcgctcgactgggtggccagcgccaacctgctggacgacatcatgtgaggcgccgggcccaccag

SEQ ID NO: 100819 - DNA, 30 bp, Homo sapiens
  misc_feature 1..30: note = chr9:139752642-139752672
  misc_feature 1..30: note = hypo
  source 1..30: mol_type = genomic DNA
gtttgaggcagtggccgcaggcgtggcaca

SEQ ID NO: 100820 - DNA, 24 bp, Homo sapiens
  misc_feature 1..24: note = chr9:139761759-139761783
  misc_feature 1..24: note = hypo
  source 1..24: mol_type = genomic DNA
atgaaactgcgtttcaaaaaaaaa

SEQ ID NO: 100821 - DNA, 40 bp, Homo sapiens
  misc_feature 1..40: note = chr9:139779368-139779408
  misc_feature 1..40: note = hypo
  source 1..40: mol_type = genomic DNA
gcagccaggaggagacgccttcttacgtttgagagctcag

SEQ ID NO: 100822 - DNA, 30 bp, Homo sapiens
  misc_feature 1..30: note = chr9:139779692-139779722
  misc_feature 1..30: note = hypo
  source 1..30: mol_type = genomic DNA
atccttgaggagtcccgtggtctcagggtc

SEQ ID NO: 100823 - DNA, 120 bp, Homo sapiens
  misc_feature 1..120: note = chr9:139782635-139782755
  misc_feature 1..120: note = hypo
  source 1..120: mol_type = genomic DNA
tttaaagttaacttctagtatttggagggcctcatattcatggctgcatgcagatcagtgttcctgaatattactcagatgagcttttatagaagtgggttagaatcaggtgccattgac

SEQ ID NO: 100824 - DNA, 63 bp, Homo sapiens
  misc_feature 1..63: note = chr9:139793127-139793190
  misc_feature 1..63: note = hypo
  source 1..63: mol_type = genomic DNA
ggaattgaggtgtaacgtgctgtgtgttcttccttagggctttgttcgcgggggtcacagctc

SEQ ID NO: 100825 - DNA, 104 bp, Homo sapiens; identical to SEQ ID NO: 42369
  misc_feature 1..104: note = chr9:139794879-139794983
  misc_feature 1..104: note = hypo
  source 1..104: mol_type = genomic DNA

SEQ ID NO: 100826 - DNA, 444 bp, Homo sapiens
  misc_feature 1..444: note = chr9:139809719-139810163
  misc_feature 1..444: note = hypo
  source 1..444: mol_type = genomic DNA
atgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggtttcagggaccctgagaccaacctcctatgggtggcaagggacagcagagcctcgaggcggttctgacgggcg

SEQ ID NO: 100827 - DNA, 282 bp, Homo sapiens; identical to SEQ ID NO: 42371
  misc_feature 1..282: note = chr9:139818340-139818622
  misc_feature 1..282: note = hypo
  source 1..282: mol_type = genomic DNA

SEQ ID NO: 100828 - DNA, 206 bp, Homo sapiens
  misc_feature 1..206: note = chr9:139836762-139836968
  misc_feature 1..206: note = hypo
  source 1..206: mol_type = genomic DNA
gcagggggacgtggccgggtcaccggcttccagcagcaggtcagggctgtcgaagcggctgcagtcggccaccatcaccgtgcggacggtgctggcattgaggttctggatcttgaacagccgcttcaccacgttgacgttctctgactccacatcctgggggcgggggcacgtgccaggtgggcgccgggcgccaggccccagga

SEQ ID NO: 100829 - DNA, 88 bp, Homo sapiens
  misc_feature 1..88: note = chr9:139856294-139856382
  misc_feature 1..88: note = hypo
  source 1..88: mol_type = genomic DNA
tgagaaacttggccccggctcgccgattccccgagactcaccccacgtgccccatacatacaatgcggggactcggggctcctggcag

SEQ ID NO: 100830 - DNA, 30 bp, Homo sapiens
  misc_feature 1..30: note = chr9:139858592-139858622
  misc_feature 1..30: note = hypo
  source 1..30: mol_type = genomic DNA
ggggagagggagcaccgtgcccaccctggc

SEQ ID NO: 100831 - DNA, 227 bp, Homo sapiens; identical to SEQ ID NO: 15294
  misc_feature 1..227: note = chr9:139859041-139859268
  misc_feature 1..227: note = hypo
  source 1..227: mol_type = genomic DNA

SEQ ID NO: 100832 - DNA, 311 bp, Homo sapiens
  misc_feature 1..311: note = chr9:139872509-139872820
  misc_feature 1..311: note = hyper
  source 1..311: mol_type = genomic DNA
gacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagg

SEQ ID NO: 100833 - DNA, 64 bp, Homo sapiens
  misc_feature 1..64: note = chr9:139879955-139880019
  misc_feature 1..64: note = hyper
  source 1..64: mol_type = genomic DNA
cggggcagctagggacgacagcgggggtgatggggcacccgggcggatccgagccgcagcagcc

SEQ ID NO: 100834 - DNA, 15 bp, Homo sapiens
  misc_feature 1..15: note = chr9:139880323-139880338
  misc_feature 1..15: note = hyper
  source 1..15: mol_type = genomic DNA
tagcccaggagggac

SEQ ID NO: 100835 - DNA, 55 bp, Homo sapiens
  misc_feature 1..55: note = chr9:139885973-139886028
  misc_feature 1..55: note = hypo
  source 1..55: mol_type = genomic DNA
gcgcgggacagagagcgcagaagccttcttccctggagatcgctctgtactgtga

SEQ ID NO: 100836 - DNA, 30 bp, Homo sapiens
  misc_feature 1..30: note = chr9:139886617-139886647
  misc_feature 1..30: note = hyper
  source 1..30: mol_type = genomic DNA
cgcctgaagcccgcgcgggtaccgggtccg

SEQ ID NO: 100837 - DNA, 340 bp, Homo sapiens
  misc_feature 1..340: note = chr9:139888764-139889104
  misc_feature 1..340: note = hypo
  source 1..340: mol_type = genomic DNA
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggcccttcagatgtcaggacaccctcactcccgacaaagatgcctt

SEQ ID NO: 100838 - DNA, 61 bp, Homo sapiens
  misc_feature 1..61: note = chr9:139902974-139903035
  misc_feature 1..61: note = hypo
  source 1..61: mol_type = genomic DNA
ggctgagcaagcagccgagaggggactgcagtgcggatggcggctccgtctcctgctgctc

SEQ ID NO: 100839 - DNA, 295 bp, Homo sapiens
  misc_feature 1..295: note = chr9:139904237-139904532
  misc_feature 1..295: note = hypo
  source 1..295: mol_type = genomic DNA
ggtacccaatgagggcgatggccgtggagagcttccgcttgttgccgccgctgtaggtgccagccggcttgtctgcgtacttggtcagctccagcttctccagagcccacttcaccacctggccagggaacgcaggtgtcagtggaggcagggccacccagcgtgctgactccctgccccgccccacagatcctcacccgggcctcgtccttccaggagatcccacgcagccgcgtgtacagctgcaggtgctcccgggccgtgagctcgtcgaacagcgcgtcacactgcgggc

SEQ ID NO: 100840 - DNA, 39 bp, Homo sapiens
  misc_feature 1..39: note = chr9:139913362-139913401
  misc_feature 1..39: note = hypo
  source 1..39: mol_type = genomic DNA
tgaactggatccagccgcaggccgcgttgtcaatggtat

SEQ ID NO: 100841 - DNA, 345 bp, Homo sapiens
  misc_feature 1..345: note = chr9:139915848-139916193
  misc_feature 1..345: note = hypo
  source 1..345: mol_type = genomic DNA
gggagaccttggccacgtccagctggttccggagctcagcagacagcccagagaagcgcctggcacgcgcagcagcctgcccactgcagacagcatcccggtagccctgcagggctcccttctgactctcaggcacagtgaggatccggcccagctcccccgagcccggcgtgcaggtgagctgctccaggagggcaggagccagcagcagctcctgggatgggcacaggggtccgtggagccacggcaaggactttgtccccaaccactagggcctcaggcctcaccctgccccacccactggctggctctggggctgcctgggtcccacgacatgcctctacc

SEQ ID NO: 100842 - DNA, 154 bp, Homo sapiens
  misc_feature 1..154: note = chr9:139943348-139943502
  misc_feature 1..154: note = hyper
  source 1..154: mol_type = genomic DNA
cccgccccgcaaggtcggccccgccccgccccgccccagcccaccttcttctggaagatcacgccgccgaaggcgcgctcgtcgaagccgtagccgcgactcagcagctgctgcacgaacatggccccggcgcagtagtcggccaggcgggccc

SEQ ID NO: 100843 - DNA, 230 bp, Homo sapiens
  misc_feature 1..230: note = chr9:139948020-139948250
  misc_feature 1..230: note = hyper
  source 1..230: mol_type = genomic DNA
atcgctgggctatcccgggagcggggacacagcccctgggctgcgttgacggactcggcggcgggcgcggaactcccgggacttgttccttcagcaccgcgtcgccctggaagcgccaccgccccccgccccctccgcgtacccggtcggggagcgcagagcgcggaacccgggaccccacccagcccgccaggagcagagcacggtgggggtcccgggctgatcctgct

SEQ ID NO: 100844 - DNA, 124 bp, Homo sapiens
  misc_feature 1..124: note = chr9:139971509-139971633
  misc_feature 1..124: note = hyper
  source 1..124: mol_type = genomic DNA
gcccacgccagctggcgcgacccagagggtcctgggatctctcggggcggggcgcggagtggacagggcgggcatgggcccggggcctggagaagagcaggaacggggacgggagctcgaggga

SEQ ID NO: 100845 - DNA, 119 bp, Homo sapiens
  misc_feature 1..119: note = chr9:139972624-139972743
  misc_feature 1..119: note = hyper
  source 1..119: mol_type = genomic DNA
tgtaccagctgcaggcggagcggattcggcgggtggagcagctggccggtgagcgccacgggacccgctgcaccgtcccctggtgtgtcctgcctgccctacctcggcccggaggtacc

SEQ ID NO: 100846 - DNA, 105 bp, Homo sapiens
  misc_feature 1..105: note = chr9:139978936-139979041
  misc_feature 1..105: note = hypo
  source 1..105: mol_type = genomic DNA
tcttaatgttctgtaggtggaatatttccaataaacacaaggtgccgtaattgactgctactctggcaagtgcagtttttgggcagtgcacgggtgttgggaaca

SEQ ID NO: 100847 - DNA, 159 bp, Homo sapiens
  misc_feature 1..159: note = chr9:140024612-140024771
  misc_feature 1..159: note = hyper
  source 1..159: mol_type = genomic DNA
gcccagggcctcacccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctg

SEQ ID NO: 100848 - DNA, 133 bp, Homo sapiens; identical to SEQ ID NO: 32835
  misc_feature 1..133: note = chr9:140024786-140024919
  misc_feature 1..133: note = hyper
  source 1..133: mol_type = genomic DNA

SEQ ID NO: 100849 - DNA, 134 bp, Homo sapiens; identical to SEQ ID NO: 32836
  misc_feature 1..134: note = chr9:140024956-140025090
  misc_feature 1..134: note = hyper
  source 1..134: mol_type = genomic DNA

SEQ ID NO: 100850 - DNA, 327 bp, Homo sapiens
  misc_feature 1..327: note = chr9:140030248-140030575
  misc_feature 1..327: note = hypo
  source 1..327: mol_type = genomic DNA
ctcacctgggagtcacgcaccattacctctaccacgttccatttgtaagtgcaggccatgtatgcctggagggaaatcaatcttctgccgaacagggtggtgttcaaagcaccaccggctccaccacactctgccttttattctgcattctgtttcttgagaccacgcgccgctacgtggaatggtctcaggagctcatgtgtttgtgctccatgaagtcagaaagtccagcctttgcactgccacatacccacccttagaacagcgtctggtacacggtaggtgctcagtgaatgtgcctagtggagtaaacgtgcggtgcggtgc

SEQ ID NO: 100851 - DNA, 103 bp, Homo sapiens
  misc_feature 1..103: note = chr9:140032848-140032951
  misc_feature 1..103: note = hyper
  source 1..103: mol_type = genomic DNA
ctctggaaaagggggcgctgggagcgcattgcgagggggctggagagggagagaggagcggaagctgagggtgtgaaacggctggccccgaacacacctcgcg

SEQ ID NO: 100852 - DNA, 212 bp, Homo sapiens
  misc_feature 1..212: note = chr9:140033279-140033491
  misc_feature 1..212: note = hyper
  source 1..212: mol_type = genomic DNA
acatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacg

SEQ ID NO: 100853 - skipped

SEQ ID NO: 100854 - DNA, 420 bp, Homo sapiens
  misc_feature 1..420: note = chr9:140033762-140034182
  misc_feature 1..420: note = hyper
  source 1..420: mol_type = genomic DNA
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacc

SEQ ID NO: 100855 - DNA, 98 bp, Homo sapiens
  misc_feature 1..98: note = chr9:140041751-140041849
  misc_feature 1..98: note = hypo
  source 1..98: mol_type = genomic DNA
ggacacgcacaggtgcgctcctcacacacacacctggacacacgctcaggtgcgctcctcatgtgcatgctcacccttacttgcgccagccagcacag

SEQ ID NO: 100856 - DNA, 132 bp, Homo sapiens
  misc_feature 1..132: note = chr9:140043219-140043351
  misc_feature 1..132: note = hypo
  source 1..132: mol_type = genomic DNA
agagagagcacagaacgagcacaggtgagcgcgcaggctgaagacaggacaggaccggagaggcgaggccaggccaggcaaggactgaggaaggcaggcggaggcgcaggtggcaggcgcagaccatggcag

SEQ ID NO: 100857 - DNA, 23 bp, Homo sapiens
  misc_feature 1..23: note = chr9:140046638-140046661
  misc_feature 1..23: note = hypo
  source 1..23: mol_type = genomic DNA
tgagccaccgtgcccagccactt

SEQ ID NO: 100858 - DNA, 172 bp, Homo sapiens
  misc_feature 1..172: note = chr9:140050925-140051097
  misc_feature 1..172: note = hyper
  source 1..172: mol_type = genomic DNA
ggtaagagccagcaacggaggcctgggaggctcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcc

SEQ ID NO: 100859 - DNA, 290 bp, Homo sapiens
  misc_feature 1..290: note = chr9:140051219-140051509
  misc_feature 1..290: note = hyper
  source 1..290: mol_type = genomic DNA
cgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggtgggcggggcctccccgga

SEQ ID NO: 100860 - DNA, 62 bp, Homo sapiens
  misc_feature 1..62: note = chr9:140052371-140052433
  misc_feature 1..62: note = hypo
  source 1..62: mol_type = genomic DNA
ttcactgatgtggcccgatgggtacaatgcacacgtgcacacacagccggacaggacagcct

SEQ ID NO: 100861 - DNA, 30 bp, Homo sapiens
  misc_feature 1..30: note = chr9:140081822-140081852
  misc_feature 1..30: note = hypo
  source 1..30: mol_type = genomic DNA
tcctggttatcaggacggctcaccagcttt

SEQ ID NO: 100862 - DNA, 30 bp, Homo sapiens
  misc_feature 1..30: note = chr9:140089410-140089440
  misc_feature 1..30: note = hypo
  source 1..30: mol_type = genomic DNA
cccagcagagcctcccggcttctcaggacc

SEQ ID NO: 100863 - DNA, 30 bp, Homo sapiens
  misc_feature 1..30: note = chr9:140090122-140090152
  misc_feature 1..30: note = hypo
  source 1..30: mol_type = genomic DNA
ctggggacactgacacgctccagctgggca

SEQ ID NO: 100864 - DNA, 143 bp, Homo sapiens
  misc_feature 1..143: note = chr9:140090372-140090515
  misc_feature 1..143: note = hypo
  source 1..143: mol_type = genomic DNA
agacggggcacctgccgcttctgccaatggataacttaagtgggcctgtgcctgccaggcaggcccccaccccggcacacaggccagcagctccccactgcccagagcagggctgcacccctcggaggcgggcaagggtatca

SEQ ID NO: 100865 - DNA, 627 bp, Homo sapiens
  misc_feature 1..627: note = chr9:140107109-140107736
  misc_feature 1..627: note = hypo
  source 1..627: mol_type = genomic DNA
gtgctggcagaggaccgagaccagcttccagggtcggcccctgcgcgcctcagggccctcgcagtggtactggcttctccacaacgctccctggtgggcaccccaggcttcacgctgcggggagggcacagaggggagcaggcagggtggcaaagggctgggctccagccacgctgacgtcacacaggcctacctggcgccggtccccacttttacaaaaaggcgtgctgtgaagtgttgacgactttgagcctggaggaggaccccgtatgctcctgccaccccagaggccacctctgccttttctcctgggcattttcacagtgctcctctgcaccctaagcaaggagtggcatgttcagtgtgcaaatggcatctttagaccccacaacggtgaaaaccccgactgtccacgtagggcccaggtccgctgagcaccgagcatcaaaagccgtttgcatagccaggtgtcagtcatttcagatgaaaaagaacgggaagatcggagacagctccccccggttctgccgggaggttttgttccgtgcgtgacgtaggtccgtgcatgacgttgtttcctgcgtgacgttgttctgtgtgggacacagtgttcgttcaagagaggga

SEQ ID NO: 100866 - DNA, 423 bp, Homo sapiens
  misc_feature 1..423: note = chr9:140108038-140108461
  misc_feature 1..423: note = hypo
  source 1..423: mol_type = genomic DNA
ctcggcagcccctggcgtgtggaggccctgccccctcctagggtgcggccagcgtggagtgtgttttccacccgagggaggccctccccaggctccactcttcgcccgggctccactctcccgggttccactctgcctgggcaccactctccgcccgggctccagcccaggaccagcctcactgtctccacaggttcaacttcgtggccaagaagctgcaccgacggctactgcagcttgggggcagcgccctcctgcccgtgtgcctgggcgatgaccagcatgagctggggtgagtctgcgggcgtggtacccgcctccacagtctggtctggccacacgcagggtccgctcaggccagcgcacgtgctccctcccaggcccgacgctgctgtggacccctggctgcgagacttgtgggac

SEQ ID NO: 100867 - DNA, 30 bp, Homo sapiens; identical to SEQ ID NO: 42385
  misc_feature 1..30: note = chr9:140115123-140115153
  misc_feature 1..30: note = hypo
  source 1..30: mol_type = genomic DNA

SEQ ID NO: 100868 - DNA, 186 bp, Homo sapiens
  misc_feature 1..186: note = chr9:140121048-140121234
  misc_feature 1..186: note = hypo
  source 1..186: mol_type = genomic DNA
ggtcagtccatgggtcggacagcaggaggatacagcgcatggaactggggggaccccaggaaaggcctccaagagaaggagcgtgtcgacaagagggtggtgggtgcagcaggtgctgcaggtttcagggagtggaaggttgggacaggagagcccagacagccaggaccacgccctgcccactgg

SEQ ID NO: 100869 - DNA, 551 bp, Homo sapiens
  misc_feature 1..551: note = chr9:140127636-140128187
  misc_feature 1..551: note = hypo
  source 1..551: mol_type = genomic DNA
cctgcccactctctgcggccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggcccccagttggactccgacatgatcatgagcagtgccacaggcaacgccactaacagcagtctcattaagcactggtgcggcaccacggggcagccggtgaggcacccaa

SEQ ID NO: 100870 - DNA, 104 bp, Homo sapiens
  misc_feature 1..104: note = chr9:140137230-140137334
  misc_feature 1..104: note = hypo
  source 1..104: mol_type = genomic DNA
ctcagtccaccagctcgtagaaaacacagacgagacctactgcattgataacgaagctctctacgacatttgcttcagaaccctaaagctgaccacgcccacct

SEQ ID NO: 100871 - DNA, 120 bp, Homo sapiens
  misc_feature 1..120: note = chr9:140137634-140137754
  misc_feature 1..120: note = hypo
  source 1..120: mol_type = genomic DNA
ccatgaaggaggtggatgagcaaatgcttaatgtccaaaacaaaaacagcagctattttgttgagtggatccccaacaatgtgaaaacggctgtctgtgacatcccacctcgggggctaa

SEQ ID NO: 100872 - DNA, 37 bp, Homo sapiens
  misc_feature 1..37: note = chr9:140140229-140140266
  misc_feature 1..37: note = hypo
  source 1..37: mol_type = genomic DNA
tgtgagcagctgccccgtggtacgcccataggtgttc

SEQ ID NO: 100873 - DNA, 89 bp, Homo sapiens
  misc_feature 1..89: note = chr9:140140759-140140848
  misc_feature 1..89: note = hypo
  source 1..89: mol_type = genomic DNA
cagtagcctcctgcacgggaagagaactgggaggcaggtggagggctgggcttttccgggccctcattcaacctcgaggggcatggtgc

SEQ ID NO: 100874 - DNA, 124 bp, Homo sapiens
  misc_feature 1..124: note = chr9:140144101-140144225
  misc_feature 1..124: note = hypo
  source 1..124: mol_type = genomic DNA
acatcaggaagcttccgtaaaatcccaagaggactgaggctcagggaacttctggacaggggaacacctggaggttcccagagggcggcaactagcgaggacatggaagcgccagcccctcccc

SEQ ID NO: 100875 - DNA, 123 bp, Homo sapiens
  misc_feature 1..123: note = chr9:140147052-140147175
  misc_feature 1..123: note = hypo
  source 1..123: mol_type = genomic DNA
ggctggctgagggtccgtggggagcaccctgccctgcagcccgtctcctaccccctcgcagtggccctcgccagcccactaccagctgctcagccggcccgccttccccgccttcagcttcag

SEQ ID NO: 100876 - DNA, 71 bp, Homo sapiens
  misc_feature 1..71: note = chr9:140167020-140167091
  misc_feature 1..71: note = hypo
  source 1..71: mol_type = genomic DNA
cgtctaagctggaggcgttgcagaaggccctggagcctacaggccaggtgggtgcccgggggggctgcatc

SEQ ID NO: 100877 - DNA, 30 bp, Homo sapiens
  misc_feature 1..30: note = chr9:140167383-140167413
  misc_feature 1..30: note = hypo
  source 1..30: mol_type = genomic DNA
ccctccagacctgctcgggtgctggggcca

SEQ ID NO: 100878 - DNA, 30 bp, Homo sapiens
  misc_feature 1..30: note = chr9:140196166-140196196
  misc_feature 1..30: note = hyper
  source 1..30: mol_type = genomic DNA
tgaccagcagcttcacgagctccaggttgc

SEQ ID NO: 100879 - DNA, 109 bp, Homo sapiens
  misc_feature 1..109: note = chr9:140198590-140198699
  misc_feature 1..109: note = hypo
  source 1..109: mol_type = genomic DNA
caggtgggctcaagccgggcctggagaaggcatttggctatgctgtgggccaggagcagggcctgggagaaagtgccgtcggcatccgtggcggcggcaaacaaagggg

SEQ ID NO: 100880 - DNA, 193 bp, Homo sapiens
  misc_feature 1..193: note = chr9:140205428-140205621
  misc_feature 1..193: note = hypo
  source 1..193: mol_type = genomic DNA
ggcccctggagcctccgggtgtggccatgttgggggcaccggccctgccccacacgctgtcttcccctgagcctttcgaaactaagaggctgcactacctgcctccagcattgcagcccccaccagttcagggccctggggctggaggtgttggacaggtggggctcttctactaggacgccaggctgggcta

SEQ ID NO: 100881 - DNA, 38 bp, Homo sapiens
  misc_feature 1..38: note = chr9:140208526-140208564
  misc_feature 1..38: note = hypo
  source 1..38: mol_type = genomic DNA
gacctcccctagagccgcccaaccgatggtggggactg

SEQ ID NO: 100882 - DNA, 60 bp, Homo sapiens
  misc_feature 1..60: note = chr9:140211623-140211683
  misc_feature 1..60: note = hypo
  source 1..60: mol_type = genomic DNA
tgcgggcaggggaggcggccccaggcgcgcacctgccagcccacgcggggcctctcctgt

SEQ ID NO: 100883 - DNA, 30 bp, Homo sapiens
  misc_feature 1..30: note = chr9:140216230-140216260
  misc_feature 1..30: note = hypo
  source 1..30: mol_type = genomic DNA
gttctggaagcagcccgtaccctccaccgg

SEQ ID NO: 100884 - DNA, 95 bp, Homo sapiens
  misc_feature 1..95: note = chr9:140243648-140243743
  misc_feature 1..95: note = hypo
  source 1..95: mol_type = genomic DNA
cccagccaggtcctccgacaggtggaagcgggcgggctctctgcacagggcttggtgcacctccagcaggcagtaggcgtcggcagctgtgtggg

SEQ ID NO: 100885 - DNA, 369 bp, Homo sapiens
  misc_feature 1..369: note = chr9:140245629-140245998
  misc_feature 1..369: note = hypo
  source 1..369: mol_type = genomic DNA
cctgcaggcagggaccgcactgtcccctgaccccagggtgcacccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaaggaacacgtggccctccacggccacctgcaggagtgacggccgaggccggcccccagcaacaaacacaggtgtccactccacgtctacaccaaccacttggtggcactgcgggcagagaggggc

SEQ ID NO: 100886 - DNA, 30 bp, Homo sapiens
  misc_feature 1..30: note = chr9:140246519-140246549
  misc_feature 1..30: note = hypo
  source 1..30: mol_type = genomic DNA
gcaggagtgcaccctcgtgtctggtcaggt

SEQ ID NO: 100887 - DNA, 168 bp, Homo sapiens
  misc_feature 1..168: note = chr9:140265734-140265902
  misc_feature 1..168: note = hypo
  source 1..168: mol_type = genomic DNA
tgcattgtcctgtgccgggacatggtggcttctcagcgccatgcacccgccgcgagacgacggccccgggcgtggcaggtgacagcgccaggggtggggcccgcgcggcccacacaggggacactcctgtgagggcccggccagggcagcccccgatgcccgtgccca

SEQ ID NO: 100888 - DNA, 186 bp, Homo sapiens
  misc_feature 1..186: note = chr9:140266430-140266616
  misc_feature 1..186: note = hypo
  source 1..186: mol_type = genomic DNA
tggccaggctcaggacgacggggctgtgatgctagacctggtcttcctcttggaaccttctgggcttaaaaatcagccttgttcacaaaggagactcagcaaaccactgtgattccaacagctccaccaattctcatccagacacctttagctgccaagcccacacttctgcgacaccacttaaga

SEQ ID NO: 100889 - DNA, 73 bp, Homo sapiens
  misc_feature 1..73: note = chr9:140267262-140267335
  misc_feature 1..73: note = hypo
  source 1..73: mol_type = genomic DNA
gcccccacacagaggcggccctgagccaggcgcgtccttgccccaccgcccgagaagccgtttccccatgagc

SEQ ID NO: 100890 - DNA, 30 bp, Homo sapiens
  misc_feature 1..30: note = chr9:140267796-140267826
  misc_feature 1..30: note = hypo
  source 1..30: mol_type = genomic DNA
tgggcaggtggatgccgggtccactatgct

SEQ ID NO: 100891 - DNA, 198 bp, Homo sapiens
  misc_feature 1..198: note = chr9:140274064-140274262
  misc_feature 1..198: note = hypo
  source 1..198: mol_type = genomic DNA
aagattcacgaagcacgactgggcgctccaggccattgagtcactcattgtgaaacggctggttttatatgtcgtgcatcttaccccaataaagcattcgatgaagccgacgctccgtggctctgatttggggtgcgctctcgcccaggctggtttctgtcacccccggagttctgcagcacccgttctaaccacagc

SEQ ID NO: 100892 - DNA, 46 bp, Homo sapiens
  misc_feature 1..46: note = chr9:140274616-140274662
  misc_feature 1..46: note = hypo
  source 1..46: mol_type = genomic DNA
tcccacccaccctgccggtccctcctcccttcgagcccttcactgg

SEQ ID NO: 100893 - DNA, 182 bp, Homo sapiens
  misc_feature 1..182: note = chr9:140325463-140325645
  misc_feature 1..182: note = hypo
  source 1..182: mol_type = genomic DNA
caggaggagggagggcggcccccgacccttaaccagagcgaggttgttgctttgtgtccacagggaccaggagcgaaccatgatgccaggtaggaggggctgactgggccctgcgagcgcgtgcctttcctgctgggcagaggccctccacatggggccacgcgggccgggcacaggagggc

SEQ ID NO: 100894 - DNA, 30 bp, Homo sapiens; identical to SEQ ID NO: 42401
  misc_feature 1..30: note = chr9:140327964-140327994
  misc_feature 1..30: note = hypo
  source 1..30: mol_type = genomic DNA

SEQ ID NO: 100895 - DNA, 646 bp, Homo sapiens
  misc_feature 1..646: note = chr9:140332500-140333146
  misc_feature 1..646: note = hypo
  source 1..646: mol_type = genomic DNA
cgtgtgggaggagcccgcatcaaacacgatcccaaactggggagacagtgggatgagtgggaggcaacacctgtggacccggcccggcctcccctgccggcggggacgcaccttgatgtctgtgggcaggagcacgctggtggcctccaccaggaggagaatgagtgccgtgaggcctgagacccccgaggcccccagcagggccaagaagacctgctccttccgggacagccccatggtgcaggtggtactggttcctgtggggggacggccgtgggcacccaggctgcacttggtgtccccatcccgccctccagaggcagaggcttcgctccccgtctccctggagacgcacccctggacagccacttgccttagaggcatctccggggctcagacgcctcccgtggccatagaggcatccccggggctcagacggtctcccgtggccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggcatccccggggctcagacgcctcccgtggcca

SEQ ID NO: 100896 - DNA, 48 bp, Homo sapiens; identical to SEQ ID NO: 42404
  misc_feature 1..48: note = chr9:140352105-140352153
  misc_feature 1..48: note = hypo
  source 1..48: mol_type = genomic DNA

SEQ ID NO: 100897 - DNA, 36 bp, Homo sapiens
  misc_feature 1..36: note = chr9:140352383-140352419
  misc_feature 1..36: note = hypo
  source 1..36: mol_type = genomic DNA
cgcgtgtgggccccccgctgccggtttcatagcagg

SEQ ID NO: 100898 - DNA, 30 bp, Homo sapiens
  misc_feature 1..30: note = chr9:140357584-140357614
  misc_feature 1..30: note = hypo
  source 1..30: mol_type = genomic DNA
ttgctcccagttcctcgacttggcctttgt

SEQ ID NO: 100899 - DNA, 30 bp, Homo sapiens
  misc_feature 1..30: note = chr9:140379933-140379963
  misc_feature 1..30: note = hypo
  source 1..30: mol_type = genomic DNA
caggtgaggcctcatcggagtaaacaagac

SEQ ID NO: 100900 - DNA, 68 bp, Homo sapiens; identical to SEQ ID NO: 42405
  misc_feature 1..68: note = chr9:140382557-140382625
  misc_feature 1..68: note = hypo
  source 1..68: mol_type = genomic DNA

SEQ ID NO: 100901 - DNA, 30 bp, Homo sapiens
  misc_feature 1..30: note = chr9:140388971-140389001
  misc_feature 1..30: note = hypo
  source 1..30: mol_type = genomic DNA
tgtgccaccctcacccgcaccaccctcacc

SEQ ID NO: 100902 - DNA, 214 bp, Homo sapiens
  misc_feature 1..214: note = chr9:140389309-140389523
  misc_feature 1..214: note = hypo
  source 1..214: mol_type = genomic DNA
tgccctcacctgctccgtgacctcatccactccgcgccttcacctgctctgcgctctcacctgctccgcgccctcacctgctctgtgccctcacccgctccgccctcacctgttccatgccctcatccactccacaccctcatccgctccgcatcctcacccacgccatgctcacctgtgggtacctgcgcttgatggacgtgagggctcctgc

SEQ ID NO: 100903 - DNA, 481 bp, Homo sapiens
  misc_feature 1..481: note = chr9:140392377-140392858
  misc_feature 1..481: note = hypo
  source 1..481: mol_type = genomic DNA
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcctcttcaccacagtgtgcgccacacccaggacgacggtcggctgcttccgcatgattctgccgggcagcccagagtcaatcctgccccatccctccaaccctacccttcgcccagggccgcagtgctcgggaatggatgggacccacaacccccaccccacccggaaagtagagagaccactggcaggggctgggacggggcacgcaccagtcagctg

SEQ ID NO: 100904 - DNA, 88 bp, Homo sapiens
  misc_feature 1..88: note = chr9:140395491-140395579
  misc_feature 1..88: note = hypo
  source 1..88: mol_type = genomic DNA
gaaacatttcggcagcgtctacggtttcatgatttcacgagcagtcgtggaaaatctgggttctcaagggctccgtgcagcgagccgg

SEQ ID NO: 100905 - DNA, 182 bp, Homo sapiens
  misc_feature 1..182: note = chr9:140396560-140396742
  misc_feature 1..182: note = hypo
  source 1..182: mol_type = genomic DNA
atgccctccagggcacgaggactctggaatctgggagctcccagaggtgacccgggagtgcccaacacactggaacccagaaggcagaggttgcagtggacccggagcctgtggagaggccctggggcaaaccaagggtgagggagcgtctgcgggcaccacacccacgaaggtttgaaaca

SEQ ID NO: 100906 - DNA, 221 bp, Homo sapiens
  misc_feature 1..221: note = chr9:140396982-140397203
  misc_feature 1..221: note = hypo
  source 1..221: mol_type = genomic DNA
ctctcaggcagaggacggccgctgacggagaggccgcatcgccccagggcgcgttgtcagcccgaggaggagccgtgggaggttcttcaggagaagaaagcggcctccctgaggaaagcagctgcactaagaaagtcagagccttcgggagatgagggggacgggggggacgcgggggacgcgggggacgcgggggacgggggggacgagagggatgtggg

SEQ ID NO: 100907 - DNA, 261 bp, Homo sapiens
  misc_feature 1..261: note = chr9:140400208-140400469
  misc_feature 1..261: note = hypo
  source 1..261: mol_type = genomic DNA
tggactggagaagaacggagataccggcaattcgaagggatgtggttggggaacatcgcacaagggtgtggtcaggtctgaatcgcacagtgcggaaaggccggctgagcctcctgaagctgcaggtgccacatgacaccaaagccggcggcgcccccaatgcaccagcaagccacggagagggtggggccccaggcggagggtgagaatgacagccagggcctaccttgctggccacggagctcccggggtgctcgtccg

SEQ ID NO: 100908 - DNA, 30 bp, Homo sapiens
  misc_feature 1..30: note = chr9:140400875-140400905
  misc_feature 1..30: note = hypo
  source 1..30: mol_type = genomic DNA
cctgacggctcgctgcggccaaccctgggt

SEQ ID NO: 100909 - DNA, 169 bp, Homo sapiens
  misc_feature 1..169: note = chr9:140401421-140401590
  misc_feature 1..169: note = hypo
  source 1..169: mol_type = genomic DNA
atgccacacagatgccgcagccacatggcgctgcgggaaggaaccaggcccaggagcacagccatgtgcccctccctgggaagccagacacagagagccaggagcgctgggccttggaaaggggcgcatgtctccgaggcttacgctgagggtgcgctggtcgggtttc

SEQ ID NO: 100910 - DNA, 27 bp, Homo sapiens
  misc_feature 1..27: note = chr9:140498381-140498408
  misc_feature 1..27: note = hypo
  source 1..27: mol_type = genomic DNA
agccaccgcgcccggtgaaacaccttc

SEQ ID NO: 100911 - DNA, 127 bp, Homo sapiens
  misc_feature 1..127: note = chr9:140507292-140507419
  misc_feature 1..127: note = hypo
  source 1..127: mol_type = genomic DNA
agcaggggcctgggccgtcggctggctggggctcatgcagccatcccctttgcagccatccgggtgacctgcataggttcctgcggggtctccaacaaggctaatgacacagcgtgggtagtggagg

SEQ ID NO: 100912 - DNA, 74 bp, Homo sapiens
  misc_feature 1..74: note = chr9:140508476-140508550
  misc_feature 1..74: note = hypo
  source 1..74: mol_type = genomic DNA
ccccaagcaacccaacgtggcctctgccaccaagaagttctcctacaagctggtgaagacgggcagcgtggtcc

SEQ ID NO: 100913 - DNA, 23 bp, Homo sapiens
  misc_feature 1..23: note = chr9:140511850-140511873
  misc_feature 1..23: note = hypo
  source 1..23: mol_type = genomic DNA
accgcacccggcccagtcaacaa

SEQ ID NO: 100914 - DNA, 174 bp, Homo sapiens
  misc_feature 1..174: note = chr9:140512180-140512354
  misc_feature 1..174: note = hypo
  source 1..174: mol_type = genomic DNA
ggagggccatgaaggcgctcgtgtctcctgcgagggctcagggtgctcggcctgtcataaatggacttaggctttgacagagcagtttagctgccctaaagaaacctgggaaggttcccttggcacttgggattgtccgtttccttttctgtctatgtgcgctgtctatgctgg

SEQ ID NO: 100915 - DNA, 19 bp, Homo sapiens
  misc_feature 1..19: note = chr9:140539579-140539598
  misc_feature 1..19: note = hypo
  source 1..19: mol_type = genomic DNA
ctcccgaagtgctgggatt

SEQ ID NO: 100916 - DNA, 30 bp, Homo sapiens
  misc_feature 1..30: note = chr9:140582852-140582882
  misc_feature 1..30: note = hypo
  source 1..30: mol_type = genomic DNA
tctcataccttgccacgctgctggactctt

SEQ ID NO: 100917 - DNA, 48 bp, Homo sapiens
  misc_feature 1..48: note = chr9:140615444-140615492
  misc_feature 1..48: note = hypo
  source 1..48: mol_type = genomic DNA
cctttctcccctcctcgccggcgtcctcgccagcgttagctcttaccc

SEQ ID NO: 100918 - DNA, 285 bp, Homo sapiens
  misc_feature 1..285: note = chr9:140657710-140657995
  misc_feature 1..285: note = hypo
  source 1..285: mol_type = genomic DNA
tcagagggttcagcacgtcccgtctctgctgcctctgggacaggaggggggatcaggcagagcacagacggaattaatgttttctgagaatttctccagttctttttaacacgatttctttcagccctcagagcctcgtgaccatggctggccatggtgagggtctgagcaggaggcttgttggcaccaggccgagaggcaccacatgcagtcacactgctcaggtgtctggctgccccgggcttgcatttgctgtggccgaagtcagcacgtggccattagtgt

SEQ ID NO: 100919 - DNA, 30 bp, Homo sapiens
  misc_feature 1..30: note = chr9:140658538-140658568
  misc_feature 1..30: note = hypo
  source 1..30: mol_type = genomic DNA
tgagaaccactggttcgcctcctcttctcc

SEQ ID NO: 100920 - DNA, 100 bp, Homo sapiens
  misc_feature 1..100: note = chr9:140664560-140664660
  misc_feature 1..100: note = hypo
  source 1..100: mol_type = genomic DNA
ttacaggtgtgagtcactgtgcccggcccactttatttcttcagtcttgtgtttttttctttctttctgggattccttgtacacacgttagattgtttga

SEQ ID NO: 100921 - DNA, 161 bp, Homo sapiens
  misc_feature 1..161: note = chr9:140665866-140666027
  misc_feature 1..161: note = hypo
  source 1..161: mol_type = genomic DNA
ggtctcaaagtcctgacctcaggtgatcctcccacctcgggtttacagccgtgagccattgcgccctgctatctcccatgtctttgagcataatcgtgctagtgtctcccacaaacacttctctgtctgcacgtctctgtgctcctcggagtcctggtctt

SEQ ID NO: 100922 - DNA, 45 bp, Homo sapiens; identical to SEQ ID NO: 15313
  misc_feature 1..45: note = chr9:140680320-140680365
  misc_feature 1..45: note = hypo
  source 1..45: mol_type = genomic DNA

SEQ ID NO: 100923 - DNA, 127 bp, Homo sapiens
  misc_feature 1..127: note = chr9:140682795-140682922
  misc_feature 1..127: note = hypo
  source 1..127: mol_type = genomic DNA
aggctccacccgcaccgccttctgccagcgcctcagccggggtgacgctcacgcaggtgtaaggaggttgcaggtttagggatcttgtaggtgaaaggaggttgcaggcgtacggaggttgcaggtg

SEQ ID NO: 100924 - DNA, 30 bp, Homo sapiens; identical to SEQ ID NO: 42421
  misc_feature 1..30: note = chr9:140693933-140693963
  misc_feature 1..30: note = hypo
  source 1..30: mol_type = genomic DNA

SEQ ID NO: 100925 - DNA, 390 bp, Homo sapiens
  misc_feature 1..390: note = chr9:140707510-140707900
  misc_feature 1..390: note = hypo
  source 1..390: mol_type = genomic DNA
cgcccctgcagtgtgcgagcctcaactctcaggtgtggagcgctctgcagatgagcaaggctctgcaggactcggcccccgacaggcccagccccgtggagaggatagtgagcaggtgagcccagccccaggacggctttgtggcaaatcagcggtcagcagggctttgggaacttgcggtgaaagctgctcctgaagccgaaacatccccaggctgcagtccaaattgtcagggccaggtgtttgccagccgccccactgcacgctgtgccaccccctgggcagagcacgtcagccaccaggtgacacctgtcctttccatggcagggacatcgctcgaggctacgagcgcatccccatcccctgtgtcaacgccgtggacagcgagcc

SEQ ID NO: 100926 - DNA, 79 bp, Homo sapiens
  misc_feature 1..79: note = chr9:140708692-140708771
  misc_feature 1..79: note = hypo
  source 1..79: mol_type = genomic DNA
cctcccacaggcactcgacatgtttctgcctgcacagccttctccctaagaggccacacactcacgtggtgcctttgag

SEQ ID NO: 100927 - DNA, 188 bp, Homo sapiens
  misc_feature 1..188: note = chr9:140708986-140709174
  misc_feature 1..188: note = hypo
  source 1..188: mol_type = genomic DNA
tcaggtggtaagtgccgctggtccgggtctgcaaaaacagtgcaggcgtctgtgaccccagcgctgtcgtggcagcgtcgggaaggagttggaggtgagctgggtgtgacaggcaggggaggcacagcgggcaccagcacccgagtcagggtcgtgagccgaggacatggctgcggattccctggggc

SEQ ID NO: 100928 - DNA, 30 bp, Homo sapiens
  misc_feature 1..30: note = chr9:140723495-140723525
  misc_feature 1..30: note = hypo
  source 1..30: mol_type = genomic DNA
ggcatccaggcaccacggggaggcccccgc

SEQ ID NO: 100929 - DNA, 405 bp, Homo sapiens
  misc_feature 1..405: note = chr9:140727525-140727930
  misc_feature 1..405: note = hypo
  source 1..405: mol_type = genomic DNA
cgccgtgaaggttgacggagagctgctctcgtccacgcctttacccgcttgttggtttgggttttaacctcttgacctctgagcgtccctggctctctggttaatgttcatgctggggcaggttgtggaccaggtgtctctgccggcaggccccgccctctcggaactcggtcctggaaagccccaggtgcctccttccccgtctgcctggctgtcgtctgtggtgttgcctcttcccgtcgctgggtaacaaaccacgccacccacccgcagctcgccatggcggccacccactcggcccagtgtgcgcagcaggggttgggcgtgccgggcctcgggctgcacaggcagggtgctgctgagcccaggtccctgtggttgcgtgggcagcgtctaggttccttg

SEQ ID NO: 100930 - DNA, 97 bp, Homo sapiens
  misc_feature 1..97: note = chr9:140770013-140770110
  misc_feature 1..97: note = hypo
  source 1..97: mol_type = genomic DNA
ctaccacaatctgtgcgatctgtgcaaggcgcagggaagtcccaagggccaggattcaccatgcctgcgtgatgccatcccccgctggcaggaacaa

SEQ ID NO: 100931 - DNA, 278 bp, Homo sapiens
  misc_feature 1..278: note = chr9:140772069-140772347
  misc_feature 1..278: note = hyper
  source 1..278: mol_type = genomic DNA
gtgggaggcgcggggcgagggaggcgcagccggaggggccggggcggggcgggggcggccgcggggcggggccggcgcggcagggtgggcggggccggcgcggattggccgggccccgccacgtgaccggccccttatagggcgtggcgcggggccgcggagtcgggtgaggcggcggcggctgcggcggtggggccgggcgaggtccgctgcggtcccggcggctccgtggctgctccgctctgagcgcctggcgcgccccgcgccctccctgccgg

SEQ ID NO: 100932 - DNA, 37 bp, Homo sapiens
  misc_feature 1..37: note = chr9:140772557-140772594
  misc_feature 1..37: note = hyper
  source 1..37: mol_type = genomic DNA
tgtacaaccccatcccggtcaagcagaactgcttcac

SEQ ID NO: 100933 - DNA, 759 bp, Homo sapiens
  misc_feature 1..759: note = chr9:140772756-140773515
  misc_feature 1..759: note = hyper
  source 1..759: mol_type = genomic DNA
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgag

SEQ ID NO: 100934 - DNA, 18 bp, Homo sapiens
  misc_feature 1..18: note = chr9:140793805-140793823
  misc_feature 1..18: note = hypo
  source 1..18: mol_type = genomic DNA
aagcgctgggattgggat

SEQ ID NO: 100935 - DNA, 86 bp, Homo sapiens
  misc_feature 1..86: note = chr9:140969254-140969340
  misc_feature 1..86: note = hypo
  source 1..86: mol_type = genomic DNA
tggcttgcacagtggcggtcggttatcctgttagtctggcagccgcgctgaaggacaggcctgacccgcggcgggggttacatgct

SEQ ID NO: 100936 - DNA, 177 bp, Homo sapiens; identical to SEQ ID NO: 42427
  misc_feature 1..177: note = chr9:141022582-141022759
  misc_feature 1..177: note = hypo
  source 1..177: mol_type = genomic DNA

SEQ ID NO: 100937 - DNA, 107 bp, Homo sapiens
  misc_feature 1..107: note = chr9:141044732-141044839
  misc_feature 1..107: note = hyper
  source 1..107: mol_type = genomic DNA
cgggacacctggggccgccgaggcaaaggtgaggaaaaggcttcctgtctccgctgcgagtgcagcggagcgagcgcggccgcgtttcccgtcgggctgtttgtacc

SEQ ID NO: 100938 - DNA, 69 bp, Homo sapiens
  misc_feature 1..69: note = chr9:14313027-14313096
  misc_feature 1..69: note = hyper
  source 1..69: mol_type = genomic DNA
gtgctacagtcccctcgcccaagttcactggctgtttttaaaagcttagtcccccgtaaagtcctccaa

SEQ ID NO: 100939 - DNA, 30 bp, Homo sapiens
  misc_feature 1..30: note = chr9:14315920-14315950
  misc_feature 1..30: note = hyper
  source 1..30: mol_type = genomic DNA
agggcggggccgccccgcttccacgggtac

SEQ ID NO: 100940 - DNA, 248 bp, Homo sapiens
  misc_feature 1..248: note = chr9:14347425-14347673
  misc_feature 1..248: note = hyper
  source 1..248: mol_type = genomic DNA
ttctcctcctgccagcgccagctggggcaaacttgagctggcaaagcgcgagaaaacttttctttggaaagtttaggtagcgcagttagtggcggaggctcagggcaagctaacagtgctggggcgggtgtggagggagtgagctgggtgcgattgggagaggggagaagggagaagggaaggagtggccagctccctaggcggttgaagatccaagtctcttcggtcaggtccgcccaaggtcccag

SEQ ID NO: 100941 - DNA, 345 bp, Homo sapiens; identical to SEQ ID NO: 3394
  misc_feature 1..345: note = chr9:14348107-14348452
  misc_feature 1..345: note = hyper
  source 1..345: mol_type = genomic DNA

SEQ ID NO: 100942 - DNA, 30 bp, Homo sapiens
  misc_feature 1..30: note = chr9:14974087-14974117
  misc_feature 1..30: note = hypo
  source 1..30: mol_type = genomic DNA
tgtgtacacccactgcggtatggggagtaa

SEQ ID NO: 100943 - DNA, 17 bp, Homo sapiens
  misc_feature 1..17: note = chr9:15277136-15277153
  misc_feature 1..17: note = hypo
  source 1..17: mol_type = genomic DNA
aatttatgggctgggcg

SEQ ID NO: 100944 - DNA, 27 bp, Homo sapiens
  misc_feature 1..27: note = chr9:15488010-15488037
  misc_feature 1..27: note = hypo
  source 1..27: mol_type = genomic DNA
agaaataaaatttatcggtttaaaagt

SEQ ID NO: 100945 - DNA, 27 bp, Homo sapiens
  misc_feature 1..27: note = chr9:15513969-15513996
  misc_feature 1..27: note = hypo
  source 1..27: mol_type = genomic DNA
tactcaataaaaaagcgccggacgcgg

SEQ ID NO: 100946 - DNA, 29 bp, Homo sapiens
  misc_feature 1..29: note = chr9:15533122-15533151
  misc_feature 1..29: note = hypo
  source 1..29: mol_type = genomic DNA
cccggccagaaagacgtgtttactacaaa

SEQ ID NO: 100947 - DNA, 30 bp, Homo sapiens
  misc_feature 1..30: note = chr9:16133835-16133865
  misc_feature 1..30: note = hyper
  source 1..30: mol_type = genomic DNA
ggaggagttggtgggcgatccatgtccctg

SEQ ID NO: 100948 - skipped

SEQ ID NO: 100949 - DNA, 26 bp, Homo sapiens
  misc_feature 1..26: note = chr9:16154745-16154771
  misc_feature 1..26: note = hyper
  source 1..26: mol_type = genomic DNA
cggcccggggacggcagggggcggct

SEQ ID NO: 100950 - DNA, 58 bp, Homo sapiens
  misc_feature 1..58: note = chr9:16435989-16436047
  misc_feature 1..58: note = hypo
  source 1..58: mol_type = genomic DNA
gcccagtttgggctccgaagactcagactcgttctcatagtcccgctcaggttcttgg

SEQ ID NO: 100951 - DNA, 33 bp, Homo sapiens
  misc_feature 1..33: note = chr9:16726995-16727028
  misc_feature 1..33: note = hyper
  source 1..33: mol_type = genomic DNA
ggcctcgcgctaccacgtcggctttcccagcag

SEQ ID NO: 100952 - DNA, 30 bp, Homo sapiens
  misc_feature 1..30: note = chr9:16727304-16727334
  misc_feature 1..30: note = hyper
  source 1..30: mol_type = genomic DNA
cttctcaggtctgaacgaagctgcctccag

SEQ ID NO: 100953 - DNA, 120 bp, Homo sapiens
  misc_feature 1..120: note = chr9:16813180-16813300
  misc_feature 1..120: note = hypo
  source 1..120: mol_type = genomic DNA
gagactccgtctcaaaaagaagaaaaactcctaaaggtctatatacccacaacattaccataacggaagcaagcagaaaaaccattttttttttttgttttgagacggagtctggctctg

SEQ ID NO: 100954 - DNA, 349 bp, Homo sapiens
  misc_feature 1..349: note = chr9:16869976-16870325
  misc_feature 1..349: note = hyper
  source 1..349: mol_type = genomic DNA
cacttcgaaaagagccgtctctgcaaggttgattttcctgccctgcgttctgcaccttctccgtaaagcctgcgggagcatttcctcccatctccatttaccacgggaagattccgaatgtgaagacaaggggagaggaagagtcaacgtgccgggcccgggcggctgcgccccagcgcacccggcacccacgcccagccgccggtccctcactcggcggcaagttgtaaaagttcccgtaggtcccagccgccttcctctcttccccgagctcctgccagcgctccattcatcccccactcccctccacctcgtccccccagcccgtccccaacgccctggagcctcc

SEQ ID NO: 100955 - DNA, 566 bp, Homo sapiens
  misc_feature 1..566: note = chr9:16870633-16871199
  misc_feature 1..566: note = hyper
  source 1..566: mol_type = genomic DNA
aacttcttaccatctcggcatgctggttgtcaagtgcagcccccgcctcttggtctcctcttagcggccgcgcctggaccagcccctcggccgccgctggctccctccgtctcggcctttctctccctccccctccgagttcctccgggcctccgctctcgccgcctccgcctccccgcccgcccgcgcgcgccctcgccgcggcccctctgcgctcaggtgactgatttacactcgcgccggggtcgcgctcgcgccccgagtcccagccggcacggttccccggctcctcctcgggacaaaaaaaaaaaaaaagggaacggcttgtcccgggagggggctgccctgctcgcgggaggcgggggaccggcgggcgaggtgacctcggcggccgtgcaagccccacaagtttttcctctctctgcagaattgtcgtgactacaatgttgcttcccttttgcaaaataaaagtcggtcgttgtgttgtttgtcctcagaggtccaggggcttggggaaggaggatgtatgtttctccctccccccaccgccccgtgacttctttggg

SEQ ID NO: 100956 - DNA, 684 bp, Homo sapiens
  misc_feature 1..684: note = chr9:16871415-16872099
  misc_feature 1..684: note = hyper
  source 1..684: mol_type = genomic DNA
acgccgaggaaagggcgcgaactttattccgactgcagcaaaccgcggcagctctttccttttcgggcactcgggcgtctctgtcccctttgaccagttcctcctccccagccccgcacgccccctcctcccctgccccttccccagcgtcccagccgcggccgacccggctccccgcgaccctctcagcccagctcctccgcgcgccgctggggagaaggcgagtgaggcggaggaaaacccagcggacagaaacctgggacgcgaacgtgctgggagaaaaggccaaaagttgcgcgcagctgggggaaaaaagtttttctggtggcggagcgttttgtgccggcccagacgccggcttgcggcgagggcttccttccctttcccgtggtctgggccgcgggcctcgggctggagaggaaggaggctgtcgcgcccgcgggggaaagaacagtcacatctgtgggtgacactcagccgacccaagtcaccctgccctggagactcagaaacgccgactacagcctaagcgcgcacacgcctgcagctgaacgatatttcttaaatacaggcaaaacacactccccggccgcaagaatggggcgggggtggggggggagcttaatcatcatcatctaactaacgtacactttgtgccaaaaacatctccgagttatgcagatt

SEQ ID NO: 100957 - DNA, 30 bp, Homo sapiens
  misc_feature 1..30: note = chr9:16933048-16933078
  misc_feature 1..30: note = hypo
  source 1..30: mol_type = genomic DNA
tcattagaatttgtgcgtacttggcaagaa

SEQ ID NO: 100958 - DNA, 38 bp, Homo sapiens
  misc_feature 1..38: note = chr9:16964538-16964576
  misc_feature 1..38: note = hypo
  source 1..38: mol_type = genomic DNA
cagctgcatctaggccgggcacggtggctcacgcctgt

SEQ ID NO: 100959 - DNA, 739 bp, Homo sapiens
  misc_feature 1..739: note = chr9:17135031-17135770
  misc_feature 1..739: note = hyper
  source 1..739: mol_type = genomic DNA
acagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggtatcgaggagtctcgcagtccccctttccccaccacagcggggccgggacccgtggggaggcgcgcctttctccctctgccttgggacctaccccgcccagcgacgctccctggcagatgcacaccctgcttcgctcgcggccgggggctggagggacgcggctgcgcccggctccccaaacccgggcccctgcccctttccgaactgcggccagacaggcttcgcctccgcgcccgggtttggttttggtcacttggatactcgcagtcgcatcctctccgcttcccccccaagcccaagttcttggtggtgacggtagctgatacctgccgggggcccaggagt

SEQ ID NO: 100960 - DNA, 586 bp, Homo sapiens; identical to SEQ ID NO: 32391
  misc_feature 1..586: note = chr9:17578706-17579292
  misc_feature 1..586: note = hyper
  source 1..586: mol_type = genomic DNA

SEQ ID NO: 100961 - DNA, 346 bp, Homo sapiens
  misc_feature 1..346: note = chr9:17579402-17579748
  misc_feature 1..346: note = hyper
  source 1..346: mol_type = genomic DNA
ggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggatgtgttggcatgagcggtggccgcactgggggtggcggggcggaggccgg

SEQ ID NO: 100962 - DNA, 375 bp, Homo sapiens
  misc_feature 1..375: note = chr9:17906058-17906433
  misc_feature 1..375: note = hyper
  source 1..375: mol_type = genomic DNA
gaaaagctccatgagcgcccaggggacaagtccccacggacaaacatgtcataacgatttcagttttgtcccattacgtgaggttgtaagtttcttcatcattcccccctcccaacaagcacaaaatcgtccccagcccctggagcatcttgcggggctcccaggtcagcaacagcactcggagctccgagctccagggaaagcgctcagggaatggctcctaggactggttcctgggaaagcgccagcgtccagggagagatttccttctccaagggccggcagggtggcattccaagcgcgagcaaggtgggcagtgagcgatcctccctttaaaaaagaataaataaatagaagccagcgcgcagccccgct

SEQ ID NO: 100963 - DNA, 266 bp, Homo sapiens
  misc_feature 1..266: note = chr9:17906460-17906726
  misc_feature 1..266: note = hyper
  source 1..266: mol_type = genomic DNA
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgcagctctgtctcgtggggcgcacgcccgagccc

SEQ ID NO: 100964 - DNA, 388 bp, Homo sapiens
  misc_feature 1..388: note = chr9:17906983-17907371
  misc_feature 1..388: note = hyper
  source 1..388: mol_type = genomic DNA
cgaaaagcgctacagcgtgggaggtgctctcttccgcgaaggtccatcctggggctgcgctgccgcccaggctggggacaagtggcgcggggttggggctaaggcgtaccctggggtcgatcgggtcgatctctgcgtttaggcttgacccagcttcctgggaccctgtcctggcttttcgcccttacctgggtcctgcttccagccaggcagagccggggcgagaaggcggcgcctgagctggggagctgtcatccccaacagtcctctaccccccaccctttccgacagtccttcgcggagccccctctctcgttccaggctgaggcttgggcggcgccggggacactcgggtgctgggacactcctccacacttccgcccttctg

SEQ ID NO: 100965 - DNA, 111 bp, Homo sapiens
  misc_feature 1..111: note = chr9:17907450-17907561
  misc_feature 1..111: note = hyper
  source 1..111: mol_type = genomic DNA
cggacgccggaccaggtgggctccctggtgcctccgcggtctagaggtggctctggtgggtgggtgcccgaggattggccctgaccataccccctccgaatcctcccaggg

SEQ ID NO: 100966 - DNA, 130 bp, Homo sapiens; identical to SEQ ID NO: 32399
  misc_feature 1..130: note = chr9:19127231-19127361
  misc_feature 1..130: note = hyper
  source 1..130: mol_type = genomic DNA

SEQ ID NO: 100967 - DNA, 30 bp, Homo sapiens
  misc_feature 1..30: note = chr9:19374806-19374836
  misc_feature 1..30: note = hypo
  source 1..30: mol_type = genomic DNA
agccataccactgctcgccatccggggcgt

SEQ ID NO: 100968 - DNA, 30 bp, Homo sapiens
  misc_feature 1..30: note = chr9:19780077-19780107
  misc_feature 1..30: note = hypo
  source 1..30: mol_type = genomic DNA
ccaaaaacaaacaaacggacaaaaaacaca

SEQ ID NO: 100969 - DNA, 702 bp, Homo sapiens
  misc_feature 1..702: note = chr9:19788200-19788902
  misc_feature 1..702: note = hyper
  source 1..702: mol_type = genomic DNA
actcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacg

SEQ ID NO: 100970 - DNA, 367 bp, Homo sapiens; identical to SEQ ID NO: 32401
  misc_feature 1..367: note = chr9:19788934-19789301
  misc_feature 1..367: note = hyper
  source 1..367: mol_type = genomic DNA

SEQ ID NO: 100971 - DNA, 41 bp, Homo sapiens
  misc_feature 1..41: note = chr9:20620713-20620754
  misc_feature 1..41: note = hyper
  source 1..41: mol_type = genomic DNA
tatgttactgtgctccggaccgcgtacgaacaccatccagt

SEQ ID NO: 100972 - DNA, 424 bp, Homo sapiens; identical to SEQ ID NO: 32402
  misc_feature 1..424: note = chr9:21031412-21031836
  misc_feature 1..424: note = hyper
  source 1..424: mol_type = genomic DNA

SEQ ID NO: 100973 - DNA, 328 bp, Homo sapiens
  misc_feature 1..328: note = chr9:21395999-21396327
  misc_feature 1..328: note = hyper
  source 1..328: mol_type = genomic DNA
ctctaacactgactacggcacgatctgattttgagccgtcagtcccctcaatacactggcacattggtaaaacggtctcgctaaaatgttccatgagaaaaatgtctcgggggaggcggcggtagagctctccctctgtagtcagagccgtgaaaggcggcgtttactcgctgctcacgaggcctgcggaccctaatccccaagcgcccgggcctccactctgcggaccccaagcgcgggtctccttgaggaaggggcgaccgcgggttagggtcgctggtgggtccgttaccgctggtccggcgccctctgtcggctgtttgtaaca

SEQ ID NO: 100974 - DNA, 706 bp, Homo sapiens
  misc_feature 1..706: note = chr9:21402440-21403146
  misc_feature 1..706: note = hyper
  source 1..706: mol_type = genomic DNA
tttcagcgacactggcgtctgaagctgaaagcttagctcctggcacaccctggggcaggcacgggcgcctctctgctcctggcccggtgcgcggcgtccccagccccgggcgctcccaggacccgtccgctcgccccagggtccagcgtgtccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 100975 - DNA, 697 bp, Homo sapiens
  misc_feature 1..697: note = chr9:214651-215348
  misc_feature 1..697: note = hyper
  source 1..697: mol_type = genomic DNA
ccttcggccggaggtcggcggccccgggcagagcgcgccgtctgccccagtatcgggaggccagttccgcgctgggcccacgccctcctcgcccgccgctgcctgcgcgccaggccgggtggcggagccggccgtcgctgctccgagctcggaccctcccccggggtgatttcggcttagaaggtggaaatgcggaagtttccagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaaggg

SEQ ID NO: 100976 - DNA, 97 bp, Homo sapiens
  misc_feature 1..97: note = chr9:21559247-21559344
  misc_feature 1..97: note = hyper
  source 1..97: mol_type = genomic DNA
ttggacaagaggaggcggcggttccgcgaagagccaagggcggccggcgctccgggatgcgccggaccccgcggcgcatcctcgtttgggcgccaac

SEQ ID NO: 100977 - DNA, 343 bp, Homo sapiens
  misc_feature 1..343: note = chr9:21559775-21560118
  misc_feature 1..343: note = hyper
  source 1..343: mol_type = genomic DNA
cccgagaggggcgcgcgggagtggacgttcccgcaccttcgccccatccacacctgccgccgccgccggggccgccagcgccgtggctccgccccggctccgcccctcgccgcccccggctcccgctccagccgccgccgcgaccgccgcggaaaggagggggagggaagaggcgcctggacggggctgcgggagcggccgtgctgagcctcctcccttgggcccggacgggacccaggtttctccactgcaacgcagctcccgagtgacggaattttgtgggggaagcggcggccactacgctcgcttttggcacagtagccctttgcgggtgggagcttct

SEQ ID NO: 100978 - DNA, 143 bp, Homo sapiens
  misc_feature 1..143: note = chr9:2178015-2178158
  misc_feature 1..143: note = hypo
  source 1..143: mol_type = genomic DNA
gaggaaaaaaaaaaacggttcccagatgaagcataacaaattaaatctcagtagtgtgtgtatataagccatgcatacaaggagttcaaactaccacttgcacagtggtatgtggctcttttccatctcgtactctatggtct

SEQ ID NO: 100979 - DNA, 514 bp, Homo sapiens
  misc_feature 1..514: note = chr9:21964911-21965425
  misc_feature 1..514: note = hyper
  source 1..514: mol_type = genomic DNA
tttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacc

SEQ ID NO: 100980 - DNA, 217 bp, Homo sapiens
  misc_feature 1..217: note = chr9:21965569-21965786
  misc_feature 1..217: note = hyper
  source 1..217: mol_type = genomic DNA
cgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctccca

SEQ ID NO: 100981 - DNA, 42 bp, Homo sapiens
  misc_feature 1..42: note = chr9:21967367-21967409
  misc_feature 1..42: note = hyper
  source 1..42: mol_type = genomic DNA
gcggggactgggagccgagtcggattccgagactatgggcca

SEQ ID NO: 100982 - DNA, 275 bp, Homo sapiens
  misc_feature 1..275: note = chr9:21968159-21968434
  misc_feature 1..275: note = hyper
  source 1..275: mol_type = genomic DNA
gccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcc

SEQ ID NO: 100983 - DNA, 272 bp, Homo sapiens
  misc_feature 1..272: note = chr9:21968456-21968728
  misc_feature 1..272: note = hyper
  source 1..272: mol_type = genomic DNA
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacg

SEQ ID NO: 100984 - DNA, 92 bp, Homo sapiens; identical to SEQ ID NO: 32411
  misc_feature 1..92: note = chr9:21969169-21969261
  misc_feature 1..92: note = hyper
  source 1..92: mol_type = genomic DNA

SEQ ID NO: 100985 - DNA, 141 bp, Homo sapiens; identical to SEQ ID NO: 32412
  misc_feature 1..141: note = chr9:21969747-21969888
  misc_feature 1..141: note = hyper
  source 1..141: mol_type = genomic DNA

SEQ ID NO: 100986 - DNA, 215 bp, Homo sapiens
  misc_feature 1..215: note = chr9:21970940-21971155
  misc_feature 1..215: note = hyper
  source 1..215: mol_type = genomic DNA
gcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccg

SEQ ID NO: 100987 - DNA, 215 bp, Homo sapiens; identical to SEQ ID NO: 100986
  misc_feature 1..215: note = chr9:21970940-21971155
  misc_feature 1..215: note = hypo
  source 1..215: mol_type = genomic DNA

SEQ ID NO: 100988 - DNA, 19 bp, Homo sapiens
  misc_feature 1..19: note = chr9:21971184-21971203
  misc_feature 1..19: note = hyper
  source 1..19: mol_type = genomic DNA
cgggcgctgcccatcatca

SEQ ID NO: 100989 - DNA, 19 bp, Homo sapiens
  misc_feature 1..19: note = chr9:21971184-21971203
  misc_feature 1..19: note = hypo
  source 1..19: mol_type = genomic DNA
cgggcgctgcccatcatca

SEQ ID NO: 100990 - DNA, 936 bp, Homo sapiens; identical to SEQ ID NO: 32414
  misc_feature 1..936: note = chr9:21974181-21975117
  misc_feature 1..936: note = hyper
  source 1..936: mol_type = genomic DNA

SEQ ID NO: 100991 - DNA, 505 bp, Homo sapiens
  misc_feature 1..505: note = chr9:21975190-21975695
  misc_feature 1..505: note = hyper
  source 1..505: mol_type = genomic DNA
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctg

SEQ ID NO: 100992 - DNA, 94 bp, Homo sapiens
  misc_feature 1..94: note = chr9:22006059-22006153
  misc_feature 1..94: note = hyper
  source 1..94: mol_type = genomic DNA
gacgaccccaggcatcgcgcacgtccagccgcgccccggcccggtgcagcaccaccagcgtgtccaggaagccctcccgggcagcatcatgcac

SEQ ID NO: 100993 - DNA, 114 bp, Homo sapiens
  misc_feature 1..114: note = chr9:22010993-22011107
  misc_feature 1..114: note = hyper
  source 1..114: mol_type = genomic DNA
actgagaatcttgcacgaggcagatgtgtgagcttcgcgaagcaagttgactgaatgaaaaacaactttgggtagggaaaacgttgccgggggcattcgcgcttactagcacca

SEQ ID NO: 100994 - DNA, 351 bp, Homo sapiens; identical to SEQ ID NO: 32417
  misc_feature 1..351: note = chr9:22446925-22447276
  misc_feature 1..351: note = hyper
  source 1..351: mol_type = genomic DNA

SEQ ID NO: 100995 - DNA, 207 bp, Homo sapiens
  misc_feature 1..207: note = chr9:22447488-22447695
  misc_feature 1..207: note = hyper
  source 1..207: mol_type = genomic DNA
tgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcg

SEQ ID NO: 100996 - DNA, 611 bp, Homo sapiens
  misc_feature 1..611: note = chr9:23821051-23821662
  misc_feature 1..611: note = hyper
  source 1..611: mol_type = genomic DNA
cgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgc

SEQ ID NO: 100997 - DNA, 527 bp, Homo sapiens
  misc_feature 1..527: note = chr9:23822112-23822639
  misc_feature 1..527: note = hyper
  source 1..527: mol_type = genomic DNA
tcccgaggcccggggcgctaacggggagtcagagcagctaacgtgggggttactttatgtgttcataaatgtatttataaatatatataagtatacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtt

SEQ ID NO: 100998 - DNA, 579 bp, Homo sapiens; identical to SEQ ID NO: 32421
  misc_feature 1..579: note = chr9:23824012-23824591
  misc_feature 1..579: note = hyper
  source 1..579: mol_type = genomic DNA

SEQ ID NO: 100999 - DNA, 223 bp, Homo sapiens
  misc_feature 1..223: note = chr9:23824795-23825018
  misc_feature 1..223: note = hyper
  source 1..223: mol_type = genomic DNA
ccatctttctcctggcgtcaatttaacaatagctattcgaggaagtgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagca

SEQ ID NO: 101000 - DNA, 338 bp, Homo sapiens
  misc_feature 1..338: note = chr9:23825602-23825940
  misc_feature 1..338: note = hyper
  source 1..338: mol_type = genomic DNA
tacgaatattcagtacgctaagcatgcgtccaccgtcttttagtctagctctttaaaattaaaaaagcagaacagtagctttgaaatgagacaaacatgtgcaattaacttcatattctgtattccgctcacttacaggttttctgggtttgccagcgcatcgctgcaactaatgattaaagaaaccaaaccgaaacttacctttctcccttaaggtttttgtgtatgtgtgtttttaaagtaacggtgcagttctcccaataaggatgagcaagaagctgctggatagttctcttaagacagcacgaaacctaaactgtgctcggcttaaaagaagc

SEQ ID NO: 101001 - DNA, 182 bp, Homo sapiens
  misc_feature 1..182: note = chr9:23826293-23826475
  misc_feature 1..182: note = hyper
  source 1..182: mol_type = genomic DNA
ctgcctccgcactgccgtgtgtgcagctgctctgccaggctcctatcccgggcagcacgcgcggaagtatacgccgaatcgcgccacaacgtaacttgctcatcgccccaggatcctgattggtccacacgcttccattgaggccgcccaggcggggccgcgtgagacgattggctatgggc

SEQ ID NO: 101002 - DNA, 40 bp, Homo sapiens; identical to SEQ ID NO: 32423
  misc_feature 1..40: note = chr9:23829874-23829914
  misc_feature 1..40: note = hyper
  source 1..40: mol_type = genomic DNA

SEQ ID NO: 101003 - DNA, 30 bp, Homo sapiens; identical to SEQ ID NO: 32424
  misc_feature 1..30: note = chr9:23830739-23830769
  misc_feature 1..30: note = hyper
  source 1..30: mol_type = genomic DNA

SEQ ID NO: 101004 - DNA, 271 bp, Homo sapiens
  misc_feature 1..271: note = chr9:23831100-23831371
  misc_feature 1..271: note = hyper
  source 1..271: mol_type = genomic DNA
ctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcct

SEQ ID NO: 101005 - DNA, 34 bp, Homo sapiens
  misc_feature 1..34: note = chr9:23831450-23831484
  misc_feature 1..34: note = hyper
  source 1..34: mol_type = genomic DNA
cgggccacggtgacaaaggcggagtttgtatcag

SEQ ID NO: 101006 - DNA, 30 bp, Homo sapiens; identical to SEQ ID NO: 32427
  misc_feature 1..30: note = chr9:23831747-23831777
  misc_feature 1..30: note = hyper
  source 1..30: mol_type = genomic DNA

SEQ ID NO: 101007 - DNA, 58 bp, Homo sapiens
  misc_feature 1..58: note = chr9:23849841-23849899
  misc_feature 1..58: note = hyper
  source 1..58: mol_type = genomic DNA
aaaccacccacagaccgagcagacgagaagaaatggtaattttcggtttaaaagttca

SEQ ID NO: 101008 - DNA, 117 bp, Homo sapiens
  misc_feature 1..117: note = chr9:23850410-23850527
  misc_feature 1..117: note = hyper
  source 1..117: mol_type = genomic DNA
ggttggctgctgctgcgaggctgctgcagccgaggctcccgcgagcagctgctaggatccttgccgtctcgttcctgcctctttcgagctgcacaatagccccggctgggtgcacct

SEQ ID NO: 101009 - DNA, 384 bp, Homo sapiens
  misc_feature 1..384: note = chr9:23850798-23851182
  misc_feature 1..384: note = hyper
  source 1..384: mol_type = genomic DNA
ctctctcctatctctcgtctctgtcccctgtcactcgcgcgcacacacacacacacgcacacacactttcctccctcttcccccacctccctatgccattttctgcagtcagcgttcaaaaaaagtacgaaaaccatcgggtaatttccaactgaaccgattacggacggcgaatttatccaaacacttaagcaaggagaggatcctaaaatcgaaaaacgaaggcggaaggggcgagaagaacggggtggagttgggtggcggagcgagtgggacgttaactggccaatagtttgcaactgccggtcaacacgcgcagcctactcagcgctgctccggaggcgcgggacgccgcctccacgtgagccgcgctcctcccagtgc

SEQ ID NO: 101010 - DNA, 74 bp, Homo sapiens
  misc_feature 1..74: note = chr9:25678053-25678127
  misc_feature 1..74: note = hyper
  source 1..74: mol_type = genomic DNA
agccgcgcgttctgccggtcccactcgtcccgcgcacggatggcctccaagtggctcgccgccaggtcggcaaa

SEQ ID NO: 101011 - DNA, 24 bp, Homo sapiens
  misc_feature 1..24: note = chr9:258867-258891
  misc_feature 1..24: note = hypo
  source 1..24: mol_type = genomic DNA
gattacgggcgtgagccaccatat

SEQ ID NO: 101012 - DNA, 433 bp, Homo sapiens
  misc_feature 1..433: note = chr9:2621293-2621726
  misc_feature 1..433: note = hyper
  source 1..433: mol_type = genomic DNA
taccccccaggtgcacgccccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcacccgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcgcgtcgagggaaaggagggccgaagccgccgcgct

SEQ ID NO: 101013 - DNA, 60 bp, Homo sapiens
  misc_feature 1..60: note = chr9:2622196-2622256
  misc_feature 1..60: note = hyper
  source 1..60: mol_type = genomic DNA
cgtccgcgctctgggcgctctggctgctgctcgcgctgtgctgggcgccccgggagagcg

SEQ ID NO: 101014 - DNA, 80 bp, Homo sapiens
  misc_feature 1..80: note = chr9:2622942-2623022
  misc_feature 1..80: note = hyper
  source 1..80: mol_type = genomic DNA
cctctcccttttccccgcctcgggcggcgtttggaaaccgctcgggtctcccgtgtagctgaacgcggagggggagtgga

SEQ ID NO: 101015 - DNA, 43 bp, Homo sapiens
  misc_feature 1..43: note = chr9:2623460-2623503
  misc_feature 1..43: note = hyper
  source 1..43: mol_type = genomic DNA
cttcaggggccctgccggcctgcagtcacgtgctcctgaagtg

SEQ ID NO: 101016 - DNA, 19 bp, Homo sapiens
  misc_feature 1..19: note = chr9:26796964-26796983
  misc_feature 1..19: note = hypo
  source 1..19: mol_type = genomic DNA
aactatttttcaaatcgaa

SEQ ID NO: 101017 - DNA, 30 bp, Homo sapiens; identical to SEQ ID NO: 42109
  misc_feature 1..30: note = chr9:26958024-26958054
  misc_feature 1..30: note = hypo
  source 1..30: mol_type = genomic DNA

SEQ ID NO: 101018 - DNA, 259 bp, Homo sapiens
  misc_feature 1..259: note = chr9:26976028-26976287
  misc_feature 1..259: note = hypo
  source 1..259: mol_type = genomic DNA
ttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagctt

SEQ ID NO: 101019 - DNA, 18 bp, Homo sapiens
  misc_feature 1..18: note = chr9:26976347-26976365
  misc_feature 1..18: note = hypo
  source 1..18: mol_type = genomic DNA
ttgcgcagtagggtgctt

SEQ ID NO: 101020 - DNA, 30 bp, Homo sapiens
  misc_feature 1..30: note = chr9:27080231-27080261
  misc_feature 1..30: note = hypo
  source 1..30: mol_type = genomic DNA
agaagtgaccacggccgggtgctgtggctc

SEQ ID NO: 101021 - DNA, 35 bp, Homo sapiens; identical to SEQ ID NO: 42102
  misc_feature 1..35: note = chr9:2727012-2727047
  misc_feature 1..35: note = hypo
  source 1..35: mol_type = genomic DNA

SEQ ID NO: 101022 - DNA, 30 bp, Homo sapiens
  misc_feature 1..30: note = chr9:27282428-27282458
  misc_feature 1..30: note = hypo
  source 1..30: mol_type = genomic DNA
tacaaatgctggcaccgatccctggagctg

SEQ ID NO: 101023 - DNA, 36 bp, Homo sapiens
  misc_feature 1..36: note = chr9:27610868-27610904
  misc_feature 1..36: note = hypo
  source 1..36: mol_type = genomic DNA
ctgcggggcgagctgcggacacgggcaaccaaaggt

SEQ ID NO: 101024 - DNA, 101 bp, Homo sapiens
  misc_feature 1..101: note = chr9:284463-284564
  misc_feature 1..101: note = hypo
  source 1..101: mol_type = genomic DNA
agcacctgaaaaccccgggaaacgaggggaatgctttgctctcagctactgaggttgtcctgtcaccttctcttctgccctcctttgccatggcataggat

SEQ ID NO: 101025 - DNA, 31 bp, Homo sapiens; identical to SEQ ID NO: 42111
  misc_feature 1..31: note = chr9:28641312-28641343
  misc_feature 1..31: note = hypo
  source 1..31: mol_type = genomic DNA

SEQ ID NO: 101026 - DNA, 372 bp, Homo sapiens
  misc_feature 1..372: note = chr9:29211799-29212171
  misc_feature 1..372: note = hyper
  source 1..372: mol_type = genomic DNA
tcccctagctcacctcggagcagcctggcccagaccaaccacccagcgttctccgcaaaaaacttcccttaaagcagccaaatattcaagggaggcgggggaaattgggcattagttcgaatacacatacaacagagcaccacggagcaacactgaaaggcaccttttttagatacagaccctatagactctctctcacccttcactccctcccaccctgagtatctgactgagaatttacagagaaccaagaggcgaaaggagagtggaggagaaagagggcattacctcccggggctgccctcagggtgcgggtcaggatctcatccccgaagtggctccagttcaaggcacagctttccagagctcagc

SEQ ID NO: 101027 - DNA, 618 bp, Homo sapiens
  misc_feature 1..618: note = chr9:29212210-29212828
  misc_feature 1..618: note = hyper
  source 1..618: mol_type = genomic DNA
cggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgacttgccaggcgggtcgtgcgatcgcgtagcgacgcccggagagatcc

SEQ ID NO: 101028 - DNA, 2007 bp, Homo sapiens
  misc_feature 1..2007: note = chr9:29213127-29215134
  misc_feature 1..2007: note = hyper
  source 1..2007: mol_type = genomic DNA
caccttcccggcacccggaagcctcccagcccctcctgggccaacttggctgcctattcagttttcttccgtaaccccacagacacgtcagtcaattccctggcatcaggcaggatattctcagttgcggccgctcctcttgctttctctcgataatgcccctcccccctttctccccttaatttggaaaaatttctactccctgcccgaattaggtggggatgaggcggaaaggtgtaagaagagccactccaaggcacagcttcggaacaccgtctccctgggctgctgcagcgcgaaggtgtctacgctggggaaactttcaggggaggcagcgccggtgcggggctgggcgggcggcgggcggcggcgccaggtgaggaggctttgaggaggcggctgcaaggcgggacgcaggatagccggctggggcttggcagccgggctcagagctcgggctgcgcacacacacaggcgcgcacacccgcgcgcgcgcagctacacacgcacgcccagccctgcgcccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaatagaggagcctacacatcgcttcgtgaacataatcccctcgcatcccgtctttacctgcccactcccttcgtaacatttcccccaaggagctcccgaaagtcgcttagatgttttgaaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaacttctttttcttccctcgacggtcgggagggatcactgggtgctacaccgctggggcgtcccaggcaggagagacttcgctctcagaagcgcccccgtgtcatccacaactcccacgaaaggagcttcccaagaggagtttgttttacccggaatgggctgcaggaattaattgcttacagagagtaaacttttgcccgttgtttttttgttttttgtgctttttttaaccaaagcttgcatttgtgctccgcgtagtttctattgcaacagagcgctactctgccttttcaactgtgagacagaggattgctgaggatttctgccctctggggcttcgcgaatatctatggcttcggacctgctagcggaaaacgcaaagttgcccagcttggagatggcaccaggttcctttgctctggcgctggatgctccgctccgccacccaccgccgccgtctccatcgagaatctcctcaaaatcaagggagttcttgactgtccctctccaaattggaaggcggttgactttgccgggaaccgagttcctgagcggcaaacgtggagtcgcagagcgcagaagtgaagatttaatacaaaagatgaaacttgtaggatgacctctagcagcgctactcacagctctgaaatcgatccagagcattccacagtgagcgttgcggctcccaggggctccggaccggtaacttcaggcgcaagtctgaatttcagggatgaacctgctttggattctgtttgagccgactcagtgcagag

SEQ ID NO: 101029 - DNA, 30 bp, Homo sapiens
  misc_feature 1..30: note = chr9:2933843-2933873
  misc_feature 1..30: note = hypo
  source 1..30: mol_type = genomic DNA
cacccctgccccagtcgtaggcccgggccc

SEQ ID NO: 101030 - DNA, 54 bp, Homo sapiens
  misc_feature 1..54: note = chr9:29826623-29826677
  misc_feature 1..54: note = hypo
  source 1..54: mol_type = genomic DNA
gcctcctggagtccacgccaactcagactcgcactggcgcgggaggccccacac

SEQ ID NO: 101031 - DNA, 756 bp, Homo sapiens
  misc_feature 1..756: note = chr9:3181124-3181880
  misc_feature 1..756: note = hyper
  source 1..756: mol_type = genomic DNA
cactccatgcacgcgcgatgggcgcacacactcgcatccctacacgtgcacacacccgcgctccaattaccgcgctagcgcgcaaaagagccgcaacttccgagtgggactcggcatgcgggggcagtgcccggtacttcaccatcagtcaccttcgcgtccgcctcctcccctgctggttgcacctccagccgcagagatttccggctggggcaccagaactgtccaggccgaaagagctgctcctccgtcacaaagcgcagttgcacactgtactgcaggcgcgcggggacccgggccggagccggggtcgcagccatggtccaagcgcctctgctcctgagccctagcagtgcctcccccgcgctgctctgggcaccgagaaactgctggggcaagggggagggatttggaagcgcgcaccaccttccccagctcccgttgcaagttcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagcacacaagtttggagagcgcgcgaggcacctgaaagtggttggggtttggaagcaaaagggtgacacctgctgttcgctgggaccgctctgcgggtgtgggcgtcggtttggaaacgtcctttgcctgag

SEQ ID NO: 101032 - DNA, 20 bp, Homo sapiens
  misc_feature 1..20: note = chr9:32253117-32253137
  misc_feature 1..20: note = hypo
  source 1..20: mol_type = genomic DNA
gctggaggccgggcgcggtg

SEQ ID NO: 101033 - DNA, 75 bp, Homo sapiens
  misc_feature 1..75: note = chr9:32755910-32755985
  misc_feature 1..75: note = hypo
  source 1..75: mol_type = genomic DNA
cgttggatggcctgccgggtgccggcgtctgtcagtgtgctcttcccttcaacgtcctctcgctgtccagccgct

SEQ ID NO: 101034 - DNA, 344 bp, Homo sapiens
  misc_feature 1..344: note = chr9:32782592-32782936
  misc_feature 1..344: note = hyper
  source 1..344: mol_type = genomic DNA
gccagtcttgccccccggggccagaggaatccatctgcccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 101035 - DNA, 138 bp, Homo sapiens; identical to SEQ ID NO: 3402
  misc_feature 1..138: note = chr9:32783083-32783221
  misc_feature 1..138: note = hyper
  source 1..138: mol_type = genomic DNA

SEQ ID NO: 101036 - DNA, 161 bp, Homo sapiens; identical to SEQ ID NO: 3403
  misc_feature 1..161: note = chr9:32783259-32783420
  misc_feature 1..161: note = hyper
  source 1..161: mol_type = genomic DNA

SEQ ID NO: 101037 - DNA, 273 bp, Homo sapiens
  misc_feature 1..273: note = chr9:32783590-32783863
  misc_feature 1..273: note = hyper
  source 1..273: mol_type = genomic DNA
cgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcaggtacctcgttgaccccagccggagcgtgttgatatgagagagagacggaggttgcaatag

SEQ ID NO: 101038 - DNA, 24 bp, Homo sapiens
  misc_feature 1..24: note = chr9:32828442-32828466
  misc_feature 1..24: note = hypo
  source 1..24: mol_type = genomic DNA
cagaaaaaaagctctcggccaggc

SEQ ID NO: 101039 - DNA, 420 bp, Homo sapiens
  misc_feature 1..420: note = chr9:32999936-33000356
  misc_feature 1..420: note = hypo
  source 1..420: mol_type = genomic DNA
gacagagactccgtctcaaaaaaatataaaaataaaaataaaaggtaacaaagagtaggtgtctgggagcttaatggacagtcgaagaaaaacaatatagaacagtggcgaagatcaaggtctctgaagttggactgcctgaattcaaacattggttctaccacctactcgctgtgtgacttgaggcaagttatttaacctctccaagccttcattccctcaagtgtcaagcggtattaacaattgctctacaccatggggttgtcacaagagctaaaggacaaagtatgtaaagctcagtgtctgataaaaagcattcaacactattatcactcttgttaatagcgaaggtagggcaagcaggagctgtggacatataaaaagatcatttgaaagcaataactgcggctgggcacagtg

SEQ ID NO: 101040 - DNA, 33 bp, Homo sapiens
  misc_feature 1..33: note = chr9:33077261-33077294
  misc_feature 1..33: note = hypo
  source 1..33: mol_type = genomic DNA
cgcctgtactcccagcgcgcgagttcgagacca

SEQ ID NO: 101041 - DNA, 30 bp, Homo sapiens
  misc_feature 1..30: note = chr9:33136558-33136588
  misc_feature 1..30: note = hypo
  source 1..30: mol_type = genomic DNA
gcttctgcaaagtcacgacacacaccaaag

SEQ ID NO: 101042 - DNA, 30 bp, Homo sapiens
  misc_feature 1..30: note = chr9:33306864-33306894
  misc_feature 1..30: note = hypo
  source 1..30: mol_type = genomic DNA
aagtccagttatagacgacttgtcttatag

SEQ ID NO: 101043 - DNA, 157 bp, Homo sapiens
  misc_feature 1..157: note = chr9:33418331-33418488
  misc_feature 1..157: note = hypo
  source 1..157: mol_type = genomic DNA
ttccatcctgcgggccgacacgcccaacccagccagtgccctgtggtagaatgtctcactcaggtcagagagtacagcaggaagagggggcttgagggggcaccttccacccatccccatggctgacaccccttccgcaactcgggaaggtccctga

SEQ ID NO: 101044 - DNA, 111 bp, Homo sapiens
  misc_feature 1..111: note = chr9:33440312-33440423
  misc_feature 1..111: note = hypo
  source 1..111: mol_type = genomic DNA
gcgtgaacgcaactgcgggtcttggcacttaagacagctgactagaagttgctggaagagtgaggcagagcagggatggcttcccggaggaagaggcgttaaagcagatca

SEQ ID NO: 101045 - DNA, 96 bp, Homo sapiens
  misc_feature 1..96: note = chr9:33447388-33447484
  misc_feature 1..96: note = hyper
  source 1..96: mol_type = genomic DNA
agagaagggcttccccggctccctccactcaccaccaggatgagggtccccaggcactcggccagcgcctgtcggagcagccggtagcggatgtgg

SEQ ID NO: 101046 - DNA, 58 bp, Homo sapiens
  misc_feature 1..58: note = chr9:33511134-33511192
  misc_feature 1..58: note = hyper
  source 1..58: mol_type = genomic DNA
ggtcccagcgagcagcggctgggaaacaatggcgcgagcgtgacgtgggccggaggcg

SEQ ID NO: 101047 - DNA, 300 bp, Homo sapiens
  misc_feature 1..300: note = chr9:33523978-33524278
  misc_feature 1..300: note = hyper
  source 1..300: mol_type = genomic DNA
cggggcaggaaccgaccctcagccccatccccgcggacggtccctggagcggccccgatctctcttcggagaagaggggcgggagtcacggccaggcgggaagggatgcgcgcctgagattccggaacgtcccgcgccagcccaggagaacccgcaagccagcggcgcctgagcccgagctgcagtcaccctctgcgggccacgcgagctcgagggcgccttccggagtccgggctggcgctgagctgtaggcgcgcgcctaaccgctttactgggctcactctatcgagaggtcggagg

SEQ ID NO: 101048 - DNA, 503 bp, Homo sapiens
  misc_feature 1..503: note = chr9:33524338-33524841
  misc_feature 1..503: note = hyper
  source 1..503: mol_type = genomic DNA
atcgcgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 101049 - DNA, 24 bp, Homo sapiens
  misc_feature 1..24: note = chr9:33647199-33647223
  misc_feature 1..24: note = hypo
  source 1..24: mol_type = genomic DNA
gcgagactgcgtctcaaaaaaaaa

SEQ ID NO: 101050 - DNA, 692 bp, Homo sapiens
  misc_feature 1..692: note = chr9:33676745-33677437
  misc_feature 1..692: note = hyper
  source 1..692: mol_type = genomic DNA
gtagctgatgcccctcgctcagccgctgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggccgccgccgccgccgccgtctctgtctctcatctccctcgcctgagcccggcc

SEQ ID NO: 101051 - DNA, 30 bp, Homo sapiens; identical to SEQ ID NO: 42114
  misc_feature 1..30: note = chr9:33862299-33862329
  misc_feature 1..30: note = hypo
  source 1..30: mol_type = genomic DNA

SEQ ID NO: 101052 - DNA, 28 bp, Homo sapiens
  misc_feature 1..28: note = chr9:34036390-34036418
  misc_feature 1..28: note = hypo
  source 1..28: mol_type = genomic DNA
aggcgtgagccaccgtgcccagccttga

SEQ ID NO: 101053 - DNA, 36 bp, Homo sapiens
  misc_feature 1..36: note = chr9:34046353-34046389
  misc_feature 1..36: note = hypo
  source 1..36: mol_type = genomic DNA
gtaaaggcttcatgccgggcggggtggctcacgcct

SEQ ID NO: 101054 - DNA, 39 bp, Homo sapiens; identical to SEQ ID NO: 42116
  misc_feature 1..39: note = chr9:34062515-34062554
  misc_feature 1..39: note = hypo
  source 1..39: mol_type = genomic DNA

SEQ ID NO: 101055 - DNA, 99 bp, Homo sapiens; identical to SEQ ID NO: 42117
  misc_feature 1..99: note = chr9:34063196-34063295
  misc_feature 1..99: note = hypo
  source 1..99: mol_type = genomic DNA

SEQ ID NO: 101056 - DNA, 57 bp, Homo sapiens; identical to SEQ ID NO: 42118
  misc_feature 1..57: note = chr9:34224348-34224405
  misc_feature 1..57: note = hypo
  source 1..57: mol_type = genomic DNA

SEQ ID NO: 101057 - DNA, 30 bp, Homo sapiens
  misc_feature 1..30: note = chr9:34279911-34279941
  misc_feature 1..30: note = hypo
  source 1..30: mol_type = genomic DNA
tgagggtatcaatggcgataatatgttgac

SEQ ID NO: 101058 - DNA, 71 bp, Homo sapiens
  misc_feature 1..71: note = chr9:34372844-34372915
  misc_feature 1..71: note = hypo
  source 1..71: mol_type = genomic DNA
cggctgcgatggcctcggggttctgacgctatgcgtagcagccaggccggcggcggcgggggtaggcctgg

SEQ ID NO: 101059 - DNA, 139 bp, Homo sapiens
  misc_feature 1..139: note = chr9:34381074-34381213
  misc_feature 1..139: note = hyper
  source 1..139: mol_type = genomic DNA
ggcagctgctggttccgcgacagtgagttcagcatgttcaccatcacttcgcgctctgctcccgcgggtccccagcgcaggagacccaaagacagatgcacagggatgggaagaggccgagtcacggacagagtgaggc

SEQ ID NO: 101060 - DNA, 30 bp, Homo sapiens
  misc_feature 1..30: note = chr9:34494080-34494110
  misc_feature 1..30: note = hyper
  source 1..30: mol_type = genomic DNA
tttgacttgcagtggcgtgggagggacaat

SEQ ID NO: 101061 - DNA, 56 bp, Homo sapiens; identical to SEQ ID NO: 42119
  misc_feature 1..56: note = chr9:34574808-34574864
  misc_feature 1..56: note = hypo
  source 1..56: mol_type = genomic DNA

SEQ ID NO: 101062 - DNA, 30 bp, Homo sapiens
  misc_feature 1..30: note = chr9:34577915-34577945
  misc_feature 1..30: note = hyper
  source 1..30: mol_type = genomic DNA
ccgaggcgggctgggcgggctggcgggcgg

SEQ ID NO: 101063 - DNA, 603 bp, Homo sapiens
  misc_feature 1..603: note = chr9:34588995-34589598
  misc_feature 1..603: note = hyper
  source 1..603: mol_type = genomic DNA
ggagatacatccaggcggactgaagagaaaaccatggggacgccgaccgacacacacatgcacacacacacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccctctagtccacagtcggccccaccaccaccaccacgcccaacccccggagcgcccggacgtggggggccgctcctccagcgcccccgcccccgagtttgcaggcaaagtttctcgtgaactttcctgtcgcccccgtccgtgggcccacgggtgtcccctcactcttcccgcacgcatgagggccgccggtctgctggtcagcccgggctctgagggtccggccgcgcgcactccgccgcagggtactcaccgcgccctcgggccacccgggcttcgcgccgcgccttccgaccgcc

SEQ ID NO: 101064 - DNA, 356 bp, Homo sapiens
  misc_feature 1..356: note = chr9:34589889-34590245
  misc_feature 1..356: note = hyper
  source 1..356: mol_type = genomic DNA
gccacgacccctccccgccacgggccccgcgcgcccccgccttggcacgctctcgctcctggcacacgcggtccgctcgccctgcgcgggcctgtgagcccccactcccactcgcccagcactggcacgcgctctgcccccccgctggcacactcgtccgcactggcacgcgtggccccctcgcgttcaccctttctcgggcgcgccctcaagacggctgtggtccccgtgcttcacgcgcagccccggccgcgggtctcgcaaacgcgcgcgcgcacacacacacacacacacacccactcggcccgctcccctagggcggctgggcgcgcactcacccccgggatcgctccttc

SEQ ID NO: 101065 - DNA, 201 bp, Homo sapiens
  misc_feature 1..201: note = chr9:34591455-34591656
  misc_feature 1..201: note = hyper
  source 1..201: mol_type = genomic DNA
ccccagggggctgaccggcctcggcgctctaatccggccggggaggggcggacggggtgaaaattggcgagtggtttggggaacggacttgacctccagatgccctggtgtccctggctcagcctctttctgccaggttgggagcagtcgggaattctgtcccggtccaacgtccccctcggcccccggggacgcagaggc

SEQ ID NO: 101066 - DNA, 168 bp, Homo sapiens
  misc_feature 1..168: note = chr9:34665047-34665215
  misc_feature 1..168: note = hyper
  source 1..168: mol_type = genomic DNA
tggctggctgggcagcggcggtggggctgcggcgggggaagccacgacccgagcgctggggagtaggacccaggccgctggacagacagctcatcaggcctcgcagaggctccagcttctgctccccggggtgcgccgagctgtggggcgacccgacactggcatgag

SEQ ID NO: 101067 - DNA, 57 bp, Homo sapiens
  misc_feature 1..57: note = chr9:34666056-34666113
  misc_feature 1..57: note = hyper
  source 1..57: mol_type = genomic DNA
acgtcacagggatgccgttgcgcactaggtttgcctgtcccccggaaggggtggggt

SEQ ID NO: 101068 - DNA, 395 bp, Homo sapiens
  misc_feature 1..395: note = chr9:34701358-34701753
  misc_feature 1..395: note = hyper
  source 1..395: mol_type = genomic DNA
ctgtggggctctgggcgaccggggcatgtgtgcggatgtgtgtccgcgcccgtgagcgtgcccatgcatctcccttcctgggcctgcagggggcgccccgagcctgggaagggaggctctggagtggggcgcggctgcggcagaggggtgggcgcatgcggctgtgaccctgcgagctcctcagagaggctgcggtgagcgggcgtccgaagtccctgggcctggaacagcctctggcgccctcccggctccctggccccgccgtccctggggtccccgcgcgcgggccgggcgtatggaggggaggctcgggctgtgggtggtgcccgcgcatccgatgacctgggccgacagttaccccgggccaggacaccgccgtccggccaaacccctgc

SEQ ID NO: 101069 - DNA, 42 bp, Homo sapiens
  misc_feature 1..42: note = chr9:34702295-34702337
  misc_feature 1..42: note = hyper
  source 1..42: mol_type = genomic DNA
ctcctggtggccgagcggggcagtgagcgcctcccagcaggc

SEQ ID NO: 101070 - DNA, 44 bp, Homo sapiens
  misc_feature 1..44: note = chr9:34760663-34760707
  misc_feature 1..44: note = hyper
  source 1..44: mol_type = genomic DNA
atactcctagtcctgcgacgtctcggccccgccaggggtcctgg

SEQ ID NO: 101071 - DNA, 252 bp, Homo sapiens
  misc_feature 1..252: note = chr9:34957876-34958128
  misc_feature 1..252: note = hyper
  source 1..252: mol_type = genomic DNA
ccaaggcgccccctccgggccgcctcctccgggcgggcactgtccttgccgcagtcggccgctggcgcagtccccgcgccgcagtgccgggcgctcgtggggggcgcccacgggcacctgggccgtctgctcatcggagccgtccgccgtcctcccgcattcccacggcgccccacgcccgcgcgcccgtcgccggtcacccgccgcccgcggagccgcgagggcgtctcctggaggcgcaagaggactggg

SEQ ID NO: 101072 - DNA, 124 bp, Homo sapiens
  misc_feature 1..124: note = chr9:34971432-34971556
  misc_feature 1..124: note = hypo
  source 1..124: mol_type = genomic DNA
cactgtagagggctccgtccaggaggtacaggaggagaaggaagcagaagcaggaacctcggtggtccaggaagagagtagtgccggccgcgcagcctgggagcggctccgagatgggcgcggc

SEQ ID NO: 101073 - DNA, 38 bp, Homo sapiens
  misc_feature 1..38: note = chr9:35060862-35060900
  misc_feature 1..38: note = hypo
  source 1..38: mol_type = genomic DNA
gtggcacctctaccacggtttcccgcagtgctgatggg

SEQ ID NO: 101074 - DNA, 369 bp, Homo sapiens
  misc_feature 1..369: note = chr9:35162053-35162422
  misc_feature 1..369: note = hyper
  source 1..369: mol_type = genomic DNA
cagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccgtgctttgggggtc

SEQ ID NO: 101075 - DNA, 194 bp, Homo sapiens
  misc_feature 1..194: note = chr9:3534456-3534650
  misc_feature 1..194: note = hypo
  source 1..194: mol_type = genomic DNA
gacaggaacgttcctcgaatatccacaatcttaatctcatgtcaactataatgaagccatgtaaaggtgagaaaaggaagaaacattatcataatctaccgagatgattactatgatcttttttttttaaagtattgtggtctcatgggttgattggtttttgtttgttttttcgtttgcgtagaatgagccaa

SEQ ID NO: 101076 - DNA, 443 bp, Homo sapiens
  misc_feature 1..443: note = chr9:35616922-35617365
  misc_feature 1..443: note = hyper
  source 1..443: mol_type = genomic DNA
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgccccttctcctcctgcgcacccgcttcgccctcgccactgggaaactccagtctgccctacgttgcctgctagag

SEQ ID NO: 101077 - DNA, 154 bp, Homo sapiens; identical to SEQ ID NO: 9888
  misc_feature 1..154: note = chr9:35675494-35675648
  misc_feature 1..154: note = hyper
  source 1..154: mol_type = genomic DNA

SEQ ID NO: 101078 - DNA, 294 bp, Homo sapiens; identical to SEQ ID NO: 9889
  misc_feature 1..294: note = chr9:35675837-35676131
  misc_feature 1..294: note = hyper
  source 1..294: mol_type = genomic DNA

SEQ ID NO: 101079 - DNA, 30 bp, Homo sapiens; identical to SEQ ID NO: 42120
  misc_feature 1..30: note = chr9:35696547-35696577
  misc_feature 1..30: note = hypo
  source 1..30: mol_type = genomic DNA

SEQ ID NO: 101080 - DNA, 30 bp, Homo sapiens
  misc_feature 1..30: note = chr9:35712225-35712255
  misc_feature 1..30: note = hypo
  source 1..30: mol_type = genomic DNA
aaaaaagaaagggggcgttgtaggtgaaca

SEQ ID NO: 101081 - DNA, 65 bp, Homo sapiens; identical to SEQ ID NO: 9890
  misc_feature 1..65: note = chr9:35728859-35728924
  misc_feature 1..65: note = hyper
  source 1..65: mol_type = genomic DNA

SEQ ID NO: 101082 - DNA, 95 bp, Homo sapiens; identical to SEQ ID NO: 42121
  misc_feature 1..95: note = chr9:35816242-35816337
  misc_feature 1..95: note = hypo
  source 1..95: mol_type = genomic DNA

SEQ ID NO: 101083 - DNA, 22 bp, Homo sapiens
  misc_feature 1..22: note = chr9:36036080-36036102
  misc_feature 1..22: note = hypo
  source 1..22: mol_type = genomic DNA
aggcacagtggctcacgcctgc

SEQ ID NO: 101084 - DNA, 850 bp, Homo sapiens
  misc_feature 1..850: note = chr9:36036783-36037633
  misc_feature 1..850: note = hyper
  source 1..850: mol_type = genomic DNA
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacattaaaaatcagtaaaccctgtcccccgggggctggcaggc

SEQ ID NO: 101085 - DNA, 30 bp, Homo sapiens
  misc_feature 1..30: note = chr9:360368-360398
  misc_feature 1..30: note = hypo
  source 1..30: mol_type = genomic DNA
ttttatacccttccccgaatatccataccc

SEQ ID NO: 101086 - DNA, 30 bp, Homo sapiens
  misc_feature 1..30: note = chr9:36138930-36138960
  misc_feature 1..30: note = hypo
  source 1..30: mol_type = genomic DNA
ctgatctgaaagcagcgtaactagagcgtt

SEQ ID NO: 101087 - DNA, 30 bp, Homo sapiens
  misc_feature 1..30: note = chr9:36162445-36162475
  misc_feature 1..30: note = hypo
  source 1..30: mol_type = genomic DNA
ccagatacttcccagcggggaatgttgtca

SEQ ID NO: 101088 - DNA, 30 bp, Homo sapiens
  misc_feature 1..30: note = chr9:36162711-36162741
  misc_feature 1..30: note = hypo
  source 1..30: mol_type = genomic DNA
aggaagcatttaccccgatggttacctaga

SEQ ID NO: 101089 - DNA, 108 bp, Homo sapiens
  misc_feature 1..108: note = chr9:36166287-36166395
  misc_feature 1..108: note = hyper
  source 1..108: mol_type = genomic DNA
agccaggaatctgtccgagtctgcgggcaccctcctctctccccgcaaaggactcgcaggggtcaggaaacccccccagctgttactgggagtcggagacagtcttct

SEQ ID NO: 101090 - DNA, 28 bp, Homo sapiens
  misc_feature 1..28: note = chr9:36194299-36194327
  misc_feature 1..28: note = hypo
  source 1..28: mol_type = genomic DNA
aggtgtgaaccaccgcacccggtgacaa

SEQ ID NO: 101091 - DNA, 99 bp, Homo sapiens
  misc_feature 1..99: note = chr9:36257346-36257445
  misc_feature 1..99: note = hypo
  source 1..99: mol_type = genomic DNA
gtcagggccccattccgacgctataattcggtttggcttcaactgcggcgctcctacagttgggttaacgagttacctatactgcgaaactgtacccca

SEQ ID NO: 101092 - DNA, 791 bp, Homo sapiens
  misc_feature 1..791: note = chr9:36257855-36258646
  misc_feature 1..791: note = hyper
  source 1..791: mol_type = genomic DNA
aacgtttctcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcatcccccctgattggacagcactgttccaggggacaagtcaacctgggcctccctctacatcccctcccctgctcatcagggcccaccccgagccacacggcggagccctgaattgggccaaagaggtgccctatggtgaggcctgcaggacattgggcgagagccgggtccagtgtgggcctcggggcgcggtggggtggaaagcggccggggaggggaggcctggggcaggaggccgggggaggcggccctgggggtgggcaggatgctctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 101093 - DNA, 321 bp, Homo sapiens; identical to SEQ ID NO: 9893
  misc_feature 1..321: note = chr9:36258697-36259018
  misc_feature 1..321: note = hyper
  source 1..321: mol_type = genomic DNA

SEQ ID NO: 101094 - DNA, 24 bp, Homo sapiens
  misc_feature 1..24: note = chr9:36274726-36274750
  misc_feature 1..24: note = hypo
  source 1..24: mol_type = genomic DNA
ttttttctcttgagacggagtctc

SEQ ID NO: 101095 - DNA, 22 bp, Homo sapiens
  misc_feature 1..22: note = chr9:36318367-36318389
  misc_feature 1..22: note = hypo
  source 1..22: mol_type = genomic DNA
aggaagaaaaagttccgttggg

SEQ ID NO: 101096 - DNA, 151 bp, Homo sapiens
  misc_feature 1..151: note = chr9:36739447-36739598
  misc_feature 1..151: note = hyper
  source 1..151: mol_type = genomic DNA
tctcttgcgctacagcgaatccaagaaaataattaaagctttaatttatttatacgtcttctctatagatattatagatctcacaatcgccgcctcctaatttatgcacgcagagcctgcggcagctcggagccgccagggttggggggtc

SEQ ID NO: 101097 - DNA, 218 bp, Homo sapiens
  misc_feature 1..218: note = chr9:36739811-36740029
  misc_feature 1..218: note = hyper
  source 1..218: mol_type = genomic DNA
ggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtacacaggccaggccttccgtgcctggcctcgc

SEQ ID NO: 101098 - DNA, 123 bp, Homo sapiens
  misc_feature 1..123: note = chr9:36748460-36748583
  misc_feature 1..123: note = hyper
  source 1..123: mol_type = genomic DNA
cctgcctggtgaggacggcagcagctccggcccatacaaagcagcaccatggacagtggcagaccagcctgagaatgcctgccaccacgccagacacaaccgagctgccgacatccttcccca

SEQ ID NO: 101099 - DNA, 36 bp, Homo sapiens; identical to SEQ ID NO: 32459
  misc_feature 1..36: note = chr9:37002482-37002518
  misc_feature 1..36: note = hyper
  source 1..36: mol_type = genomic DNA

SEQ ID NO: 101100 - DNA, 295 bp, Homo sapiens
  misc_feature 1..295: note = chr9:37002818-37003113
  misc_feature 1..295: note = hyper
  source 1..295: mol_type = genomic DNA
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagga

SEQ ID NO: 101101 - DNA, 31 bp, Homo sapiens
  misc_feature 1..31: note = chr9:37003173-37003204
  misc_feature 1..31: note = hyper
  source 1..31: mol_type = genomic DNA
aaaaacctgaactactcgttaggcatttcac

SEQ ID NO: 101102 - DNA, 1046 bp, Homo sapiens; identical to SEQ ID NO: 3408
  misc_feature 1..1046: note = chr9:37025306-37026352
  misc_feature 1..1046: note = hyper
  source 1..1046: mol_type = genomic DNA

SEQ ID NO: 101103 - DNA, 839 bp, Homo sapiens; identical to SEQ ID NO: 3409
  misc_feature 1..839: note = chr9:37026433-37027272
  misc_feature 1..839: note = hyper
  source 1..839: mol_type = genomic DNA

SEQ ID NO: 101104 - DNA, 60 bp, Homo sapiens; identical to SEQ ID NO: 3410
  misc_feature 1..60: note = chr9:37027324-37027384
  misc_feature 1..60: note = hyper
  source 1..60: mol_type = genomic DNA

SEQ ID NO: 101105 - DNA, 681 bp, Homo sapiens
  misc_feature 1..681: note = chr9:37027385-37028066
  misc_feature 1..681: note = hyper
  source 1..681: mol_type = genomic DNA
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccccacagcgatgctgggatcctgggacgctctcaaggcttg

SEQ ID NO: 101106 - DNA, 40 bp, Homo sapiens; identical to SEQ ID NO: 32465
  misc_feature 1..40: note = chr9:37028470-37028510
  misc_feature 1..40: note = hyper
  source 1..40: mol_type = genomic DNA

SEQ ID NO: 101107 - DNA, 30 bp, Homo sapiens; identical to SEQ ID NO: 32466
  misc_feature 1..30: note = chr9:37028944-37028974
  misc_feature 1..30: note = hyper
  source 1..30: mol_type = genomic DNA

SEQ ID NO: 101108 - DNA, 1442 bp, Homo sapiens
  misc_feature 1..1442: note = chr9:37029348-37030790
  misc_feature 1..1442: note = hyper
  source 1..1442: mol_type = genomic DNA
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggccttggagcaggaagatcgcaacagcagagagggactgggatggaatagacttcctgcactggcttcacccgatggcgcccagtgggtcggaaataaccagaattcagatcctcggcccagactcaacatggcggcttgcacacctactggagaggcgggagtgcgggacgccctgagggatgcagccagtgacacccccacccccagcctctcttgctgagctcaggcctacaaacccaggttctctagattcttagagctaaaagggcctcgaagctatgctttctccatttcacgggtgcagaacccgaggcccagaggcaggatacgacttgtccaaagtcacacagcaagtctggggtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcactgcattaccgtggcttcaggatg

SEQ ID NO: 101109 - DNA, 750 bp, Homo sapiens; identical to SEQ ID NO: 32469
  misc_feature 1..750: note = chr9:37034197-37034947
  misc_feature 1..750: note = hyper
  source 1..750: mol_type = genomic DNA

SEQ ID NO: 101110 - DNA, 380 bp, Homo sapiens
  misc_feature 1..380: note = chr9:37035506-37035886
  misc_feature 1..380: note = hyper
  source 1..380: mol_type = genomic DNA
gtcacgaggctgggtcgcaacctagggggaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagccccagcccaggcttcccgccctcccgcctcgcccgcgccgggaggcagcgcctgggaggagcggcctgtccgcgcctggagatcaaaagccctcccggaattgacatttc

SEQ ID NO: 101111 - DNA, 2227 bp, Homo sapiens
  misc_feature 1..2227: note = chr9:37036127-37038354
  misc_feature 1..2227: note = hyper
  source 1..2227: mol_type = genomic DNA
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgctactccgttcctgcccgcacccatgaagggcagaggattaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccaggacagaataagccattccttctgtccacgttgccaggacttctccagctcaacacaccttggtttgtttaatgttacacgagggagaagatttagaggcagagacacatgctggctcaatcggcgaggaaatacgagcagagtctaaacagaaagaaatatggaacggggggagactagactgtggggaaggcaaattggaggcccagaaaaggggctggtgcggaagctcctccaggcccctgggcgctctggcattctgtgagaaggagaaagcagaagccgagaacagagagtgacaggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcactggggcaccatgtgccagcgactcgccacccggaaatacttgggttgcgctagaatacgcaatgggtctgtgttcgggtaacctggtgc

SEQ ID NO: 101112 - DNA, 215 bp, Homo sapiens
  misc_feature 1..215: note = chr9:37121892-37122107
  misc_feature 1..215: note = hypo
  source 1..215: mol_type = genomic DNA
attcagagtggccatcgcatttgaaaaatggacagacattttaaccctttagacaattgtgtttcaactgtcctgtcagggcagcttactaagagtaagaaaaattttactttgaaagtaaagtgtattcatcacattccaatgaaaattggactgaaaatgaggctgtggatttgatttaaatcggccggagatggatgcgtgtgtcatcaaga

SEQ ID NO: 101113 - DNA, 30 bp, Homo sapiens; identical to SEQ ID NO: 42125
  misc_feature 1..30: note = chr9:37134066-37134096
  misc_feature 1..30: note = hypo
  source 1..30: mol_type = genomic DNA

SEQ ID NO: 101114 - DNA, 30 bp, Homo sapiens; identical to SEQ ID NO: 5089
  misc_feature 1..30: note = chr9:37467610-37467640
  misc_feature 1..30: note = hypo
  source 1..30: mol_type = genomic DNA

SEQ ID NO: 101115 - DNA, 30 bp, Homo sapiens; identical to SEQ ID NO: 5090
  misc_feature 1..30: note = chr9:37467940-37467970
  misc_feature 1..30: note = hypo
  source 1..30: mol_type = genomic DNA

SEQ ID NO: 101116 - DNA, 41 bp, Homo sapiens
  misc_feature 1..41: note = chr9:37477115-37477156
  misc_feature 1..41: note = hypo
  source 1..41: mol_type = genomic DNA
gctcactcaggaacccgcgggggcagcgcaatgaggcgggt

SEQ ID NO: 101117 - DNA, 291 bp, Homo sapiens
  misc_feature 1..291: note = chr9:37576058-37576349
  misc_feature 1..291: note = hyper
  source 1..291: mol_type = genomic DNA
cagacccctgatgcccgaagcccgaccagacgctcagcctcggccaggactgagcggcgcctcctgggtcggtcgcctggggaagcgccccgggtcccctcccccggccgcccaagttcgcccgcagcctctgcgcaccggccgcttacctcacagggcgctcgcccaccgcggagtccgggccgcggccgccggtgccctggaagccacccgccgcccccgctggagccgcagcagccggtaggattgcggcgtgcggccagccccgcccgggggcggacagctgcctgg

SEQ ID NO: 101118 - DNA, 38 bp, Homo sapiens
  misc_feature 1..38: note = chr9:37651342-37651380
  misc_feature 1..38: note = hyper
  source 1..38: mol_type = genomic DNA
agtgagtggaaacagcggcaacgcgggagggggagaga

SEQ ID NO: 101119 - DNA, 30 bp, Homo sapiens
  misc_feature 1..30: note = chr9:377164-377194
  misc_feature 1..30: note = hypo
  source 1..30: mol_type = genomic DNA
gctcttccagctgtccgtgcagcccatggt

SEQ ID NO: 101120 - DNA, 30 bp, Homo sapiens
  misc_feature 1..30: note = chr9:37965461-37965491
  misc_feature 1..30: note = hypo
  source 1..30: mol_type = genomic DNA
gacatgaaaacacaccgactgtgtgtgggc

SEQ ID NO: 101121 - DNA, 30 bp, Homo sapiens
  misc_feature 1..30: note = chr9:38067678-38067708
  misc_feature 1..30: note = hyper
  source 1..30: mol_type = genomic DNA
tgggccgggcgctctcgctcagaggggacg

SEQ ID NO: 101122 - DNA, 37 bp, Homo sapiens
  misc_feature 1..37: note = chr9:38068121-38068158
  misc_feature 1..37: note = hyper
  source 1..37: mol_type = genomic DNA
gccggcgtggcgggccgccgctcgctgctgctgcggt

SEQ ID NO: 101123 - DNA, 161 bp, Homo sapiens
  misc_feature 1..161: note = chr9:38189469-38189630
  misc_feature 1..161: note = hypo
  source 1..161: mol_type = genomic DNA
gagccccacctcccatcagatcagctgaggcattagagtctcataggcgtgtgaatcttatcctgaacagggcatgcgagggatctaggttgcatgagaatctaatgcctgatgaggtggaacagtttcatcctgaaatgattccccgacaaccatggtct

SEQ ID NO: 101124 - DNA, 436 bp, Homo sapiens
  misc_feature 1..436: note = chr9:38424302-38424738
  misc_feature 1..436: note = hyper
  source 1..436: mol_type = genomic DNA
ggaccacacttggggcgccggccgcccacgtcgcggatcccaaggctcggggacagcggcggcagcagcggcagcagcagcagaagcagcagcggcaagagcagagacaagcgcggcatggcttgctccgggacagcggcggcgcctctgcttcgcgctccgctccgcgcccgccgagcagtcaccgctcccgccccgcggccgctgattggccgggcctgcaccgcggggcgcccgcagaccgctgctccagcccgggacccgcgcggtgcccgcggcccgggtctccgagctggagggtcgccccgagagcagctctccgacctccgattggactcttgagggaaccgagacccagtcggggcgacaacttgcccgaggtcgctatggcagagtcaggattggataaccgtacggtctccggatccaaggctgg

SEQ ID NO: 101125 - DNA, 350 bp, Homo sapiens
  misc_feature 1..350: note = chr9:38620053-38620403
  misc_feature 1..350: note = hyper
  source 1..350: mol_type = genomic DNA
cgcgggctgagtccccgagctacctgtcttttctgtcgcgggcgtccaagtcccggaacctgcgcgtcaggcagcgctccacctccgcggcgtcgcccttgatggcagccctgtggatcttccgcagttcccagtcccgaatgtcgtaacccggacccgcatactcttggtccatggagctcaggagcgcctggcccaggcgtctcccgaagctgaagagcttcctcatggtggcgacttctcagacgcccaccacccgctcctgagccgcggcggctcctcgtggcctttccacccccactccgccccaaatccgcgatctcccccgcaacccgcgatcccccccgcaa

SEQ ID NO: 101126 - DNA, 86 bp, Homo sapiens
  misc_feature 1..86: note = chr9:38620735-38620821
  misc_feature 1..86: note = hyper
  source 1..86: mol_type = genomic DNA
tcccgcgggacgtcccggaatcccaggagtgcatcccttcccgcctgagggcctgcctggccctgactcccgacccgctcctcctc

SEQ ID NO: 101127 - DNA, 360 bp, Homo sapiens
  misc_feature 1..360: note = chr9:38620881-38621241
  misc_feature 1..360: note = hyper
  source 1..360: mol_type = genomic DNA
ggtcggttcctgtcccggtgcagccgccgccgggtagaccgcctggcttggccgcagccagggcgacatgtagccccggttctgccaggctgggagcgccagccatcttgggagttgccaggcagctgtcgccagcaggtagagggcgcctgcagcttgggcgcccaggtggtggagcacggcctaggcggcctctggatcgcgagtgcacctggcctgagagcccgccaggccctgcccctgctcggctcctcgtctgctgaagctcgggacctctagccagtggccctctgcagccacggggaatggggctgagagccggttcccgctgcagggcagaccacctagctcagccgcagc

SEQ ID NO: 101128 - DNA, 565 bp, Homo sapiens
  misc_feature 1..565: note = chr9:38621421-38621986
  misc_feature 1..565: note = hyper
  source 1..565: mol_type = genomic DNA
gtgcctcccgcccattcctccaccggagggggatcggggtcgctggcatgggcacttggcagtcactccggatggggttgagcaggggttctcagttttcgcccctgtgcagccgccgccgggcagaatgcctggcttggccgcagccactgctacacctagcgggtcgggcgggccggggggtgaaagcgctgggaggcgggtgccttctcgccctgtggcgcctctgggccccacggcttgtcggcctccggcgcgcagggctccccagcatcctgggcgccggcccgctgcctgcacaaagtcaactcagacaggatgaacttcggttgccttgtctggctgggctgccaggcggggcagctgacctgctgatggggtgactttcttcatcttcttgcccacaggacagcgggctgggaagccaggggccgccgggacctggggctggaaaccacatctgcccacagccgcagcctcctgcacctgtcatcctggcggcgccctgacgtcggagaagcagcaggcgcggagctcctgcagcgggcaccgctgcagcaacccg

SEQ ID NO: 101129 - DNA, 85 bp, Homo sapiens
  misc_feature 1..85: note = chr9:38622559-38622644
  misc_feature 1..85: note = hyper
  source 1..85: mol_type = genomic DNA
gcccgagagacagcacgtcaccgtcaccgtcaccgcctagcgcccctgacccgctcccactccgctgcagcggagggtgtgtgag

SEQ ID NO: 101130 - DNA, 31 bp, Homo sapiens; identical to SEQ ID NO: 42128
  misc_feature 1..31: note = chr9:38646913-38646944
  misc_feature 1..31: note = hypo
  source 1..31: mol_type = genomic DNA

SEQ ID NO: 101131 - DNA, 121 bp, Homo sapiens
  misc_feature 1..121: note = chr9:40633719-40633840
  misc_feature 1..121: note = hyper
  source 1..121: mol_type = genomic DNA
ccggggcggggcggccgcggtgcacggactcgtgccaaagaccgcgccgtcagcctccgcctgcaggtggagaacgccaggctttatcactctgctgttcacccaacgcaggggctgcacc

SEQ ID NO: 101132 - DNA, 23 bp, Homo sapiens
  misc_feature 1..23: note = chr9:41242566-41242589
  misc_feature 1..23: note = hypo
  source 1..23: mol_type = genomic DNA
aagaatgaatatggccggtcttg

SEQ ID NO: 101133 - DNA, 30 bp, Homo sapiens
  misc_feature 1..30: note = chr9:415015-415045
  misc_feature 1..30: note = hypo
  source 1..30: mol_type = genomic DNA
gagatctctgtcattcgttccagtgctgat

SEQ ID NO: 101134 - DNA, 50 bp, Homo sapiens
  misc_feature 1..50: note = chr9:4298596-4298646
  misc_feature 1..50: note = hyper
  source 1..50: mol_type = genomic DNA
tatagggactggagccgcgcgcaggacaacgtctccgagactgagacatt

SEQ ID NO: 101135 - DNA, 1157 bp, Homo sapiens
  misc_feature 1..1157: note = chr9:4299009-4300166
  misc_feature 1..1157: note = hyper
  source 1..1157: mol_type = genomic DNA
gactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctgcgagggcagcggcggcagggggaggaggaggcagaggcggggtggctggaccctcggcatcagctcattctcccctgctacacacatacacacacaaataatgtttctaaaaagttcagttgcgactttgtgcctcgcctgtcctgttcatcctcgtcctgggccggggaatgcttctgggggccgaccccgggatgctggctaattgctgccggcgggttccgtcgccggtgtgaccctggacggcgcggacggcgtacagggggtcccgggaggggcagtggccgcggcactcgccgccggtgcccgtgcgcgccgcgctctgggctgcccgggcggcgcagtgtggacgcggctgcagggagaggggaagggggaagagggagggaggaaggcagccgggcgaggagtgtggatgtgtgtgcggccgcgagggccggcctgtagccagctgcttcctgagtgtgagcgccggagggggagggggaagagtgggggcgggctcgcgggtcactaggctg

SEQ ID NO: 101136 - DNA, 129 bp, Homo sapiens
  misc_feature 1..129: note = chr9:43684951-43685080
  misc_feature 1..129: note = hyper
  source 1..129: mol_type = genomic DNA
gctcgcttcttgactcgcgttggtgccggccgcctcccgcgcctagtgtccgggacgcgcctgaacctgccgcctccgtgcctggggcggcgccgcgcggcccccaggctcccgcggggccgacctcgg

SEQ ID NO: 101137 - DNA, 24 bp, Homo sapiens
  misc_feature 1..24: note = chr9:45356983-45357007
  misc_feature 1..24: note = hyper
  source 1..24: mol_type = genomic DNA
gcgtgcgctcgaggcctgagggac

SEQ ID NO: 101138 - DNA, 41 bp, Homo sapiens
  misc_feature 1..41: note = chr9:45371461-45371502
  misc_feature 1..41: note = hypo
  source 1..41: mol_type = genomic DNA
ggattacaggcgtgaaccacggcgcccggcccataattgga

SEQ ID NO: 101139 - DNA, 30 bp, Homo sapiens
  misc_feature 1..30: note = chr9:4864629-4864659
  misc_feature 1..30: note = hypo
  source 1..30: mol_type = genomic DNA
gtgtctctgagggctcgggacattctttat

SEQ ID NO: 101140 - DNA, 35 bp, Homo sapiens
  misc_feature 1..35: note = chr9:505604-505639
  misc_feature 1..35: note = hyper
  source 1..35: mol_type = genomic DNA
tcttgcgggtcagcacgagccgtgctgcacgagcg

SEQ ID NO: 101141 - DNA, 17 bp, Homo sapiens
  misc_feature 1..17: note = chr9:5230606-5230623
  misc_feature 1..17: note = hypo
  source 1..17: mol_type = genomic DNA
caaacctttttgaaacg

SEQ ID NO: 101142 - DNA, 169 bp, Homo sapiens
  misc_feature 1..169: note = chr9:5864501-5864670
  misc_feature 1..169: note = hypo
  source 1..169: mol_type = genomic DNA
atttaacctcacccccgtggggaggggggcgagcgggtatttgacccttctaaaagcctcaagtgaagggaacaaagctgtcaaaatgacaggctttcctcagggggtggtagagatgtttggggcaggtggaagaagccagcttttccagatccgcaagaattctggc

SEQ ID NO: 101143 - DNA, 30 bp, Homo sapiens
  misc_feature 1..30: note = chr9:592406-592436
  misc_feature 1..30: note = hypo
  source 1..30: mol_type = genomic DNA
tactgaataaatgcccgcagcactggcttg

SEQ ID NO: 101144 - DNA, 329 bp, Homo sapiens; identical to SEQ ID NO: 32367
  misc_feature 1..329: note = chr9:6412571-6412900
  misc_feature 1..329: note = hyper
  source 1..329: mol_type = genomic DNA

SEQ ID NO: 101145 - DNA, 71 bp, Homo sapiens
  misc_feature 1..71: note = chr9:6644297-6644368
  misc_feature 1..71: note = hyper
  source 1..71: mol_type = genomic DNA
tgagagcaccctggccggtgagagggtgcctgggaagtggggaatctgctacaaaacgcaggggaagctcg

SEQ ID NO: 101146 - DNA, 15 bp, Homo sapiens
  misc_feature 1..15: note = chr9:6644539-6644554
  misc_feature 1..15: note = hyper
  source 1..15: mol_type = genomic DNA
cgattttcagggaac

SEQ ID NO: 101147 - DNA, 1305 bp, Homo sapiens
  misc_feature 1..1305: note = chr9:6644869-6646174
  misc_feature 1..1305: note = hyper
  source 1..1305: mol_type = genomic DNA
gtggggtggagattccgccactcggggttggatttcagttgcaaccggagctaaccggtaagcccactcttaatcagggggtcttcctcctcttgcaaagtttaggtccatccacagggccacttgggctgggggtggtttaaaaatgtacacttttgaggcacgaagactgggtgcaggagaaagtaagctgttaagaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctttgcgggagcgtgataaagttact

SEQ ID NO: 101148 - DNA, 152 bp, Homo sapiens
  misc_feature 1..152: note = chr9:66455725-66455877
  misc_feature 1..152: note = hyper
  source 1..152: mol_type = genomic DNA
gaaagttgtagagtgcgcccctcactgtggcaggagcagtggcgctgagcgtgcccacgggccgcggcttgggtctctctcattttccaggtggtatggccgtggacaatggcagtggcgcctggctggcccaagagcccagtccagctacg

SEQ ID NO: 101149 - DNA, 32 bp, Homo sapiens
  misc_feature 1..32: note = chr9:66455997-66456029
  misc_feature 1..32: note = hyper
  source 1..32: mol_type = genomic DNA
cgcgctgcgctttccgccgacctcccagagcg

SEQ ID NO: 101150 - DNA, 300 bp, Homo sapiens
  misc_feature 1..300: note = chr9:66458292-66458592
  misc_feature 1..300: note = hyper
  source 1..300: mol_type = genomic DNA
cccggcccagccaagcccgcatgactccaggcgtcatcgccaccccggggccgcgggtctcggatccaggacccccagaggcgctcgcccgtgcccccgggcagctgtctccctctacacccgaggaccgccggcctcccagagagtcccgccgtctccggcggccaggcctggctcaggaccaatgtggcaccgccctgctgttgttggggggcgccgccggaggcctctgtcccctgcgcaggcttccggctctaggggcggcctcctttccgcccacgctccagtccttccgggagc

SEQ ID NO: 101151 - DNA, 180 bp, Homo sapiens
  misc_feature 1..180: note = chr9:66494095-66494275
  misc_feature 1..180: note = hyper
  source 1..180: mol_type = genomic DNA
cccagtcggcggagcatggtctgggtggctgctggaatgcttgcgctcgaggcctgagggacccactgttggtgccacctgccctgctctgcgcctctccacgcctgcgccggcgccccctccgcgcctgcgccccctccgcgcctgcaccccctccgcgcctgcgcctctctgcctttg

SEQ ID NO: 101152 - DNA, 157 bp, Homo sapiens
  misc_feature 1..157: note = chr9:6704461-6704618
  misc_feature 1..157: note = hyper
  source 1..157: mol_type = genomic DNA
caggcagccaagaaacgcggagacagactactgggactgcgacgtctcctctcctgttcgctgcgatatgccggcgtcgtgttgagcgggctgcggacacagacagcctgcccggccccactgagtgtttgatccccatcctcgcagctctctagag

SEQ ID NO: 101153 - DNA, 76 bp, Homo sapiens
  misc_feature 1..76: note = chr9:6756353-6756429
  misc_feature 1..76: note = hypo
  source 1..76: mol_type = genomic DNA
tggttgggatcctgacgttacatgcacacatttggaaaattcccagttgagtatacgttagccaagttcagaattg

SEQ ID NO: 101154 - DNA, 76 bp, Homo sapiens
  misc_feature 1..76: note = chr9:6756729-6756805
  misc_feature 1..76: note = hypo
  source 1..76: mol_type = genomic DNA
tctgtgtgtgtagcggaactttgtttttaacaactaaagaaatatggtgacccaataatcccgttagccttagctc

SEQ ID NO: 101155 - DNA, 127 bp, Homo sapiens
  misc_feature 1..127: note = chr9:69197629-69197756
  misc_feature 1..127: note = hyper
  source 1..127: mol_type = genomic DNA
ggggaaacagttggccgatactgttactattatcagcgttattagcggccaggacagtgtggggggcgggcgggggtaaggggcctccccgcgcctcccagcccttcgcgctcggctccagctcttt

SEQ ID NO: 101156 - DNA, 30 bp, Homo sapiens
  misc_feature 1..30: note = chr9:70652569-70652599
  misc_feature 1..30: note = hypo
  source 1..30: mol_type = genomic DNA
ctcgaatgcagggtgcgcctctggcctgct

SEQ ID NO: 101157 - DNA, 120 bp, Homo sapiens
  misc_feature 1..120: note = chr9:71200600-71200720
  misc_feature 1..120: note = hypo
  source 1..120: mol_type = genomic DNA
ctctttatgagaatctaactaatgcctgatgatctgtcactgtctcccgtcacccacccccccacccccgccccaccgccgatgacacggtctagttgcaggaaaacaagctcagggctc

SEQ ID NO: 101158 - DNA, 176 bp, Homo sapiens
  misc_feature 1..176: note = chr9:71223791-71223967
  misc_feature 1..176: note = hypo
  source 1..176: mol_type = genomic DNA
tgatatcattagatacgatattagcccgaggctgcagcagcgcatccccgggcgcggcgcccaccaacactcacagtgcaagggcttggctccgagggggctgggagcccgggcgccctggagtgaggggggccaggagcgggctctggaggctgcagaggcgactctggagagga

SEQ ID NO: 101159 - DNA, 29 bp, Homo sapiens
  misc_feature 1..29: note = chr9:71369369-71369398
  misc_feature 1..29: note = hypo
  source 1..29: mol_type = genomic DNA
ccaccacgcccggccggttccatgatttt

SEQ ID NO: 101160 - DNA, 106 bp, Homo sapiens; identical to SEQ ID NO: 42130
  misc_feature 1..106: note = chr9:71425241-71425347
  misc_feature 1..106: note = hypo
  source 1..106: mol_type = genomic DNA

SEQ ID NO: 101161 - DNA, 27 bp, Homo sapiens
  misc_feature 1..27: note = chr9:71500809-71500836
  misc_feature 1..27: note = hypo
  source 1..27: mol_type = genomic DNA
aaatttggccaggtgcggtggctcacg

SEQ ID NO: 101162 - DNA, 27 bp, Homo sapiens
  misc_feature 1..27: note = chr9:71501076-71501103
  misc_feature 1..27: note = hypo
  source 1..27: mol_type = genomic DNA
agagcgagactccgtctgaaaaaaaaa

SEQ ID NO: 101163 - DNA, 35 bp, Homo sapiens
  misc_feature 1..35: note = chr9:71576130-71576165
  misc_feature 1..35: note = hypo
  source 1..35: mol_type = genomic DNA
tcaaaaaaaaaaaaaaaaagcgtgtcaccacaaat

SEQ ID NO: 101164 - DNA, 82 bp, Homo sapiens
  misc_feature 1..82: note = chr9:71583902-71583984
  misc_feature 1..82: note = hypo
  source 1..82: mol_type = genomic DNA
tctttgggcacagtgcgtagcttctgagggcctcatgtgcttcatgtgtgcaactgggatgttaatacctaccctgatgggt

SEQ ID NO: 101165 - DNA, 30 bp, Homo sapiens; identical to SEQ ID NO: 15216
  misc_feature 1..30: note = chr9:7164747-7164777
  misc_feature 1..30: note = hypo
  source 1..30: mol_type = genomic DNA

SEQ ID NO: 101166 - DNA, 18 bp, Homo sapiens
  misc_feature 1..18: note = chr9:71655284-71655302
  misc_feature 1..18: note = hypo
  source 1..18: mol_type = genomic DNA
atgtaaatatttatacgc

SEQ ID NO: 101167 - DNA, 30 bp, Homo sapiens
  misc_feature 1..30: note = chr9:71704692-71704722
  misc_feature 1..30: note = hypo
  source 1..30: mol_type = genomic DNA
gctctgtgttagcagcgtctggatgggtca

SEQ ID NO: 101168 - DNA, 120 bp, Homo sapiens; identical to SEQ ID NO: 42133
  misc_feature 1..120: note = chr9:71734802-71734922
  misc_feature 1..120: note = hypo
  source 1..120: mol_type = genomic DNA

SEQ ID NO: 101169 - DNA, 19 bp, Homo sapiens
  misc_feature 1..19: note = chr9:71738790-71738809
  misc_feature 1..19: note = hypo
  source 1..19: mol_type = genomic DNA
ttatttattttgagacgga

SEQ ID NO: 101170 - DNA, 311 bp, Homo sapiens
  misc_feature 1..311: note = chr9:71788950-71789261
  misc_feature 1..311: note = hyper
  source 1..311: mol_type = genomic DNA
cccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctg

SEQ ID NO: 101171 - DNA, 61 bp, Homo sapiens; identical to SEQ ID NO: 32483
  misc_feature 1..61: note = chr9:71789696-71789757
  misc_feature 1..61: note = hyper
  source 1..61: mol_type = genomic DNA

SEQ ID NO: 101172 - DNA, 27 bp, Homo sapiens
  misc_feature 1..27: note = chr9:71921187-71921214
  misc_feature 1..27: note = hypo
  source 1..27: mol_type = genomic DNA
tctgggcaagatgatcgccctgaataa

SEQ ID NO: 101173 - DNA, 251 bp, Homo sapiens
  misc_feature 1..251: note = chr9:71939733-71939984
  misc_feature 1..251: note = hyper
  source 1..251: mol_type = genomic DNA
acagagaaggctcctcgctcttctctagccccagctcggcgggtggggacagacgctgagactctcggtggccggcgctgacgtgtcctggccgtgaggtgcctcccacctcgagggacttacttaaatatttggggcagggcaccctcccaggaccccaggaagccggcgcaggttcggcggggaccctgaggctgtggcgcacttgccccggcacagcgcgagcacggagtgcgcgtgggtgagagtga

SEQ ID NO: 101174 - DNA, 30 bp, Homo sapiens
  misc_feature 1..30: note = chr9:72286957-72286987
  misc_feature 1..30: note = hyper
  source 1..30: mol_type = genomic DNA
aggcagcccctctcgcgtccgggggcgccc

SEQ ID NO: 101175 - DNA, 44 bp, Homo sapiens; identical to SEQ ID NO: 42135
  misc_feature 1..44: note = chr9:72819967-72820011
  misc_feature 1..44: note = hypo
  source 1..44: mol_type = genomic DNA

SEQ ID NO: 101176 - DNA, 269 bp, Homo sapiens
  misc_feature 1..269: note = chr9:73027315-73027584
  misc_feature 1..269: note = hyper
  source 1..269: mol_type = genomic DNA
catccctaaaaggctcgaagtaaagtgcgccgcgtcccccctcggtttcaaccacttctctgcaacccgacaagagaattaaataaaagatacgccatctgacttccccgctgccagcgtctcccaggtggggtggccccaccgtcgcggggtgcgggagagtcccgggggcggggcgggacaggggaggggcggacaccactccccgcgaagccacgcaccgcactcgctctgcccgccagtttaaggctctccgtggctcccggagg

SEQ ID NO: 101177 - DNA, 336 bp, Homo sapiens
  misc_feature 1..336: note = chr9:73027969-73028305
  misc_feature 1..336: note = hyper
  source 1..336: mol_type = genomic DNA
cagattcggtggtcacgtcgctgtcggatcccatatcctcatctggactttccagactgtcgctgcacacggagggggtctggatgggtcggtacttgttcaggtccaacaagctcttggcgatggtgaccagtgtgcagtaatccttccaggtgtcccccgggtcaccgtgctccttggtcacctcgcgctcaggtagtcgcagccgctcggcgtccggagcgaccccatgctccggcaccgcagcgcggttcgaaatggaaaccagacactgggcagccacgaagtccatgtaggcggccgcggacatggtgcgggcgacggcagcccaggcgg

SEQ ID NO: 101178 - DNA, 34 bp, Homo sapiens
  misc_feature 1..34: note = chr9:73032801-73032835
  misc_feature 1..34: note = hypo
  source 1..34: mol_type = genomic DNA
aacctattctttttccgtggtaaattgtattatt

SEQ ID NO: 101179 - DNA, 278 bp, Homo sapiens
  misc_feature 1..278: note = chr9:73219-73497
  misc_feature 1..278: note = hyper
  source 1..278: mol_type = genomic DNA
gtggtgcggccctgacggtcgcgcaggccgacggacgacagcgcgctccggatgaagttgggcgggtagctgcgctggccctggaagaggccggtgggtcgccggtgctcgcggggcgcggtgggcactgtccgcaccgggatggggctcccctccgcggcgcctcccggccggtcctgctgcggctccggggccggagggaatccgcagccggccgggggcctccgccagcctggctgcgcgccgggactccgcctcgcgcccggccccctctccag

SEQ ID NO: 101180 - DNA, 30 bp, Homo sapiens
  misc_feature 1..30: note = chr9:73438545-73438575
  misc_feature 1..30: note = hypo
  source 1..30: mol_type = genomic DNA
ctttttaaaaactatcggccatcacacagt

SEQ ID NO: 101181 - DNA, 97 bp, Homo sapiens
  misc_feature 1..97: note = chr9:74061662-74061759
  misc_feature 1..97: note = hyper
  source 1..97: mol_type = genomic DNA
ctccggctgcgtctgcggctctccgcgttgtcctcgcggtcggagcagccccgctccatttccgccgcatccctccacttcttccccatgagaagtt

SEQ ID NO: 101182 - DNA, 323 bp, Homo sapiens; identical to SEQ ID NO: 32486
  misc_feature 1..323: note = chr9:74061787-74062110
  misc_feature 1..323: note = hyper
  source 1..323: mol_type = genomic DNA

SEQ ID NO: 101183 - DNA, 173 bp, Homo sapiens; identical to SEQ ID NO: 42137
  misc_feature 1..173: note = chr9:74469850-74470023
  misc_feature 1..173: note = hypo
  source 1..173: mol_type = genomic DNA

SEQ ID NO: 101184 - DNA, 582 bp, Homo sapiens
  misc_feature 1..582: note = chr9:74764297-74764879
  misc_feature 1..582: note = hyper
  source 1..582: mol_type = genomic DNA
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgt

SEQ ID NO: 101185 - DNA, 30 bp, Homo sapiens
  misc_feature 1..30: note = chr9:75545858-75545888
  misc_feature 1..30: note = hypo
  source 1..30: mol_type = genomic DNA
gaagcatccatagtacgccacggggatcca

SEQ ID NO: 101186 - DNA, 22 bp, Homo sapiens
  misc_feature 1..22: note = chr9:76966084-76966106
  misc_feature 1..22: note = hypo
  source 1..22: mol_type = genomic DNA
ggcaccgcgcctggcctgcatt

SEQ ID NO: 101187 - DNA, 606 bp, Homo sapiens
  misc_feature 1..606: note = chr9:77111763-77112369
  misc_feature 1..606: note = hyper
  source 1..606: mol_type = genomic DNA
caaaccacctgcccacggaaacccccgccggagaccgaagtttacccaaatagcgctcggcaaagcgctgccataaattcaaaactaactctgccgggcccgcgggggttgcgagacagggaccgaacgtgaaacccggggagccccgcgtctcttgcctccgaaggttttccgtgatcagtgtccccttctctgctggagtcggaagtgcctgtcacctgcggatctgcccgactctcccggtcggcccttcttctctgcccagttcggacagtctcgaattccccgtcgcagccccggccacctcggactccctggtccccagcccccgccccaccccccgcctccaccacgtcccctccccgcggtcccagcctctccaggcgctgctgggctctgattggcggctgcgctgacagcaggcggggcctggaagtcgcggccaagcccgccctcgcgtataagcccctctcagcgctctctctccatctctcccctctctttctctctcgctgctcccttcctccctgtaactgaacagtgaaaattcacattgtggatccgctaacaggcacagatgtcatgtgaaaacgcacatgctctgcc

SEQ ID NO: 101188 - DNA, 193 bp, Homo sapiens
  misc_feature 1..193: note = chr9:77112703-77112896
  misc_feature 1..193: note = hyper
  source 1..193: mol_type = genomic DNA
ttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgc

SEQ ID NO: 101189 - DNA, 444 bp, Homo sapiens; identical to SEQ ID NO: 32490
  misc_feature 1..444: note = chr9:77112897-77113341
  misc_feature 1..444: note = hyper
  source 1..444: mol_type = genomic DNA

SEQ ID NO: 101190 - DNA, 151 bp, Homo sapiens; identical to SEQ ID NO: 32491
  misc_feature 1..151: note = chr9:77113558-77113709
  misc_feature 1..151: note = hyper
  source 1..151: mol_type = genomic DNA

SEQ ID NO: 101191 - DNA, 1147 bp, Homo sapiens
  misc_feature 1..1147: note = chr9:77113805-77114952
  misc_feature 1..1147: note = hyper
  source 1..1147: mol_type = genomic DNA
cgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctctatccttcgcacgtacccctgggtcttgacaacagaaagttagtaacggccagctccagaccttcttgcatcccagacccggagagaggtggtctaggcagggagcacttgggagagttgggatgcaatcactggtctcctccttccactgaaagtgatcctctcccacccagtccccctacgcccctagaggagcaccccaggaggcagcgggtctcactcccactccctcccgcacccggtgagccccgagcctggactcaagggtttgctggctggacgctgggatgtgtcaggaaagggaaggagaagaaggaacggagagagactgtccatgggggagggggttgactgtagataagaaacaaggacgtcctgatgggatggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatgggttgtagcttgatctagcatctcctgaaggagcagtttgcagatgactgtcctggttcgccacggcggtcgctttgaggactcc

SEQ ID NO: 101192 - DNA, 274 bp, Homo sapiens
  misc_feature 1..274: note = chr9:77115210-77115484
  misc_feature 1..274: note = hyper
  source 1..274: mol_type = genomic DNA
tcttcatattttccccggacagtgccctaccacagtatgagaggctgttccgtaagaatgggattgagaaaagatccaggctactctgacgtcttgtggagttgggagttgaacttgagagtgaacttgagaagtgaaagcgggaaaagaatcagctttcgctcgtgcagggctactaagcaccctatgttgggagaggggccatttttgacctgggctttacggtgggcccactgcatttccctcatccacacgcgcgcgctttccattccca

SEQ ID NO: 101193 - DNA, 209 bp, Homo sapiens; identical to SEQ ID NO: 32495
  misc_feature 1..209: note = chr9:77502024-77502233
  misc_feature 1..209: note = hyper
  source 1..209: mol_type = genomic DNA

SEQ ID NO: 101194 - DNA, 123 bp, Homo sapiens
  misc_feature 1..123: note = chr9:77502613-77502736
  misc_feature 1..123: note = hyper
  source 1..123: mol_type = genomic DNA
gctattctagatcctcgttagatgtagtgtccctggccccacccacttctatctaaggccgggggcgcagatctagcgaatcgcctaaggtccttgttccccgccagtcgagcagcctgagct

SEQ ID NO: 101195 - DNA, 30 bp, Homo sapiens
  misc_feature 1..30: note = chr9:77802622-77802652
  misc_feature 1..30: note = hypo
  source 1..30: mol_type = genomic DNA
agtgaggtcgcgccacgccaacaccttgac

SEQ ID NO: 101196 - DNA, 34 bp, Homo sapiens
  misc_feature 1..34: note = chr9:78505588-78505622
  misc_feature 1..34: note = hyper
  source 1..34: mol_type = genomic DNA
gccactcagaatcctcgcgcgctgctcggagccg

SEQ ID NO: 101197 - DNA, 77 bp, Homo sapiens
  misc_feature 1..77: note = chr9:78506339-78506416
  misc_feature 1..77: note = hyper
  source 1..77: mol_type = genomic DNA
ttcttgtcccctctgcgtggaaccccctccccctcttccagatgtgctctagcagctgttgccctaactcttgggcg

SEQ ID NO: 101198 - DNA, 256 bp, Homo sapiens
  misc_feature 1..256: note = chr9:78506476-78506732
  misc_feature 1..256: note = hyper
  source 1..256: mol_type = genomic DNA
acaccccagagttgccgggtccgtgttttgtttacttgtcttttccaagccacgcgggactggtagggtctcgggaaaaatccagagtgcccccgtggtggcttcagagacggctggaccttttgacctgaaaagtcgagtagcactagtaatctgaggcagtctcagagagggtgatcgtggggagagggggaaattaggtcttttgggggatagggggtgagcgcgcctctgatgcctgcggggaagggaaagc

SEQ ID NO: 101199 - DNA, 104 bp, Homo sapiens
  misc_feature 1..104: note = chr9:78507584-78507688
  misc_feature 1..104: note = hyper
  source 1..104: mol_type = genomic DNA
cccgcccctcctccccgccgcctgggggatgcggcacctggagaggaggcagagctgctgtcgccgcgtttagaaggagctggggagtgcggggagtgttcaga

SEQ ID NO: 101200 - DNA, 63 bp, Homo sapiens
  misc_feature 1..63: note = chr9:78557098-78557161
  misc_feature 1..63: note = hypo
  source 1..63: mol_type = genomic DNA
gctgcggagctggctcggtgttgccaatttaaaaggacatgcaagtctcgacttttacatatc

SEQ ID NO: 101201 - DNA, 78 bp, Homo sapiens
  misc_feature 1..78: note = chr9:79073402-79073480
  misc_feature 1..78: note = hypo
  source 1..78: mol_type = genomic DNA
tttttttaaacaacatggaaacaaataagacctcgttctgttttctaggagctaaaaatccaacgaaagaagacacag

SEQ ID NO: 101202 - DNA, 95 bp, Homo sapiens
  misc_feature 1..95: note = chr9:79231284-79231379
  misc_feature 1..95: note = hypo
  source 1..95: mol_type = genomic DNA
tgattctttctctcacggtgttggttgactttttcccatagatgaagagaatatttactaaaccaaaatttggggcacatcgtctaaaaactgcg

SEQ ID NO: 101203 - DNA, 75 bp, Homo sapiens
  misc_feature 1..75: note = chr9:79409102-79409177
  misc_feature 1..75: note = hypo
  source 1..75: mol_type = genomic DNA
ttcaccaacgagatacggtgcttcagagaaaataaataaatatgctgatatggcaaatggcggaaccaggatttc

SEQ ID NO: 101204 - DNA, 30 bp, Homo sapiens
  misc_feature 1..30: note = chr9:79521303-79521333
  misc_feature 1..30: note = hyper
  source 1..30: mol_type = genomic DNA
cagcgcccagaagtgcgagccaagtgcaag

SEQ ID NO: 101205 - DNA, 541 bp, Homo sapiens; identical to SEQ ID NO: 32498
  misc_feature 1..541: note = chr9:79626876-79627417
  misc_feature 1..541: note = hyper
  source 1..541: mol_type = genomic DNA

SEQ ID NO: 101206 - DNA, 91 bp, Homo sapiens
  misc_feature 1..91: note = chr9:79628238-79628329
  misc_feature 1..91: note = hyper
  source 1..91: mol_type = genomic DNA
tggatcaacaacatccgccccgcccccccaactccaccaccaccaccagacacacacagacatgggcgggcacccacgtgcccaaaggtgc

SEQ ID NO: 101207 - DNA, 249 bp, Homo sapiens
  misc_feature 1..249: note = chr9:79628692-79628941
  misc_feature 1..249: note = hyper
  source 1..249: mol_type = genomic DNA
ctggttgctgatgtgcggagtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccc

SEQ ID NO: 101208 - DNA, 199 bp, Homo sapiens; identical to SEQ ID NO: 851
  misc_feature 1..199: note = chr9:79629207-79629406
  misc_feature 1..199: note = hyper
  source 1..199: mol_type = genomic DNA

SEQ ID NO: 101209 - DNA, 30 bp, Homo sapiens
  misc_feature 1..30: note = chr9:79629607-79629637
  misc_feature 1..30: note = hyper
  source 1..30: mol_type = genomic DNA
aggcaacagggtcatcgccactttagagaa

SEQ ID NO: 101210 - DNA, 587 bp, Homo sapiens
  misc_feature 1..587: note = chr9:79629850-79630437
  misc_feature 1..587: note = hyper
  source 1..587: mol_type = genomic DNA
aacctgtgtcctgggcgcctgccgggcaaggcgcggggactggacgggtcggaaacggggcagggatgcacttcgcagagatgtcaggtcgggttggtgacgctggaggcgacggattcctaaaacgttataaggggttgacgggtggcgctgctgccctgcagcgtccccagctgcgcagctcctgagctccccgctccgagcgcccagacccccagcgccactccaccgtcgagatcacagcttcaaacctcaactccttggagccttcgaaggcgcagttctgactactgagtatttcctggaaagaaaaagaagcccaaagcggtgaaatgatgcctccagggtcatccaggcctggactcgagctggaagccacgtttccgagtcctggggctggctttctcctaccctcttcaaatccactttaggagtttcgtctgggaaaagtatgcgccgagaagtcagccgaaggtcaggcaagtgccaggctagcgtgaccaggaaggctcctgggaggaccccaaacgtaactaacccaggcaaccttccgcacgtcagctaagtcagtgcgtaaagggagaacc

SEQ ID NO: 101211 - DNA, 1223 bp, Homo sapiens
  misc_feature 1..1223: note = chr9:79631016-79632239
  misc_feature 1..1223: note = hyper
  source 1..1223: mol_type = genomic DNA
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgctctaggcagcaattgcggcctgggccgccgcgtccggctgtggcctaggtggtgggaagtactttctaccctcgccaagcacaacctgaatgcggaagcgtgaggctcggggcgcttcgctcagcctccgagactgttttgtcccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccaggagccgcaagtgcccaacgggcacggtcccagagctgctccccaaaaggagactctgctgttccagcaacccgcggaagggatgctatccgaggtatcaacaaaagatccctttgctcgagctgcgtgtggggtcgaagtccggagagcccttaagtgtgcggcacgcagagctcctcagcagcggcctgacagcggtgcaggagaccccagcttcctgggctgggacagggctgttgtctcacggtcttgttccaaggaaaaggagccacctggctccagcaggctcttgtcaaactgtgagcgtccttggaattctgtggcttcccgaggccaagaggctgtccgctgctcggctctctcaagtgtctcagcggacaaaaatcgcgcagaaactcctatggcaggaggaaagcttccgacatacagtgaaagagaaaacatcttactttgaaaagggcttaggaccaagaagctgctcttttccccgggccttcttgcaagcttcagtcgtaacatctattctcagacgtcttctggcctaggacaaactggccacatagagctagccagaaatctagctcctgactaaagatggaaattacgggcctgacccgctcacggcactcctgcgacctggctaagccaccccacggacagacgtgctcccaccgtccagctcaccaa

SEQ ID NO: 101212 - DNA, 98 bp, Homo sapiens
  misc_feature 1..98: note = chr9:79632823-79632921
  misc_feature 1..98: note = hyper
  source 1..98: mol_type = genomic DNA
ccccagctcagacatcgccatcccagagaaacctcatcttgtccaactcactcgctccaggaaagtgtggtggagcctccattcgccaagccctttag

SEQ ID NO: 101213 - DNA, 525 bp, Homo sapiens
  misc_feature 1..525: note = chr9:79633212-79633737
  misc_feature 1..525: note = hyper
  source 1..525: mol_type = genomic DNA
gagagaagctcacagcgagtagatgaaaacagggaagggtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctcccc

SEQ ID NO: 101214 - DNA, 1711 bp, Homo sapiens
  misc_feature 1..1711: note = chr9:79633738-79635449
  misc_feature 1..1711: note = hyper
  source 1..1711: mol_type = genomic DNA
gccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 101215 - DNA, 234 bp, Homo sapiens
  misc_feature 1..234: note = chr9:79635745-79635979
  misc_feature 1..234: note = hyper
  source 1..234: mol_type = genomic DNA
ggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcg

SEQ ID NO: 101216 - DNA, 363 bp, Homo sapiens
  misc_feature 1..363: note = chr9:79636190-79636553
  misc_feature 1..363: note = hyper
  source 1..363: mol_type = genomic DNA
taggaaagcctcattcgctggtaaattggaagtcgattctgacccttattcctgggagcagaagctggcagagctaaacctcccgcgaagaatccaacagagagtgacgctgaaacggatctcagccaccacgtttctctctgctggtcgcatcctcggcggtcgcctctcgtgaacattcaagacaaaactgccgtccactaaggaaatttcgttttatttaagaaggaaaagaggaagcgtttgataccgttattttcctagtcagctaaatgggcaaggaaacggtgtcatgaataaagtcgctttggagggggaaggggaggagaggaggcagcgggaaccccacgaaatatctttggg

SEQ ID NO: 101217 - DNA, 749 bp, Homo sapiens
  misc_feature 1..749: note = chr9:79636807-79637556
  misc_feature 1..749: note = hyper
  source 1..749: mol_type = genomic DNA
aaatcacttgtatagcgggattttgtttccctaacttacgaatgcaggaaaaactcggcacatcactcgacaatattgctcttaacgcttgcagaaacgttccatggctgttcccttccagtctcctcggacggaagcaaggggaccacccagtcacctttgcacgctgcggctgtttttgtattccgtgtgctgtttgagcgcttatgtctttcaggcgaattaattcttcagtttcaattcgtgaatgggaaagaaacttgccttgtcgctcttgcccttcccccctcttgagccccagggaatagcactttactcgcgacacaattttgggaatggaggggggcagagtggggagaaatccgctttgccctttggctctaagtcacctccgcctcttgtccgcgccgcgttcgggttgtgactttgtttatgtctgctggtgttgtacgcggtgttctctattaaagcttctctctggatatctatgctagccccgtgtgaaggtgtttcagttctccaaggatgaggccgtggtttgagtgcccacagttaggttagggtactttgcaaatccttcccctccctcttatttcttaacttcagaacttcaaaggggtgagtacacgggcgagccaccagtaagcaccgatttccttcattgctcctttcagcctttggcacaatcatctcttttactatctattattattagtagtagtattttagagacaagatcccactatgtt

SEQ ID NO: 101218 - DNA, 273 bp, Homo sapiens
  misc_feature 1..273: note = chr9:79637616-79637889
  misc_feature 1..273: note = hyper
  source 1..273: mol_type = genomic DNA
gctaggattacaggcgtgagccatcacgcccggccaccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 101219 - DNA, 108 bp, Homo sapiens
  misc_feature 1..108: note = chr9:79638136-79638244
  misc_feature 1..108: note = hyper
  source 1..108: mol_type = genomic DNA
gctggggcctgggaagccgcgtcccggcctccgccctccaccctttagcacaggtctactttgaaccagcttccgtgtgcccagccaggccaacgaaagtcacctctg

SEQ ID NO: 101220 - DNA, 223 bp, Homo sapiens
  misc_feature 1..223: note = chr9:80263294-80263517
  misc_feature 1..223: note = hyper
  source 1..223: mol_type = genomic DNA
aacctgcagccctggcgtctgctggacttgcccttctgggcaccccaagccgaaggcgcctggaagtgaaaggggacgagcagggggcgcggagctgggggtgggagctggcacctctaggagcagctcccacacttgcctccctggctggggcgtcccggccaaggtttgctgtaatctgcgcgtctggccgccaggcaccgggttccgacaggtgagtgag

SEQ ID NO: 101221 - DNA, 30 bp, Homo sapiens
  misc_feature 1..30: note = chr9:80263764-80263794
  misc_feature 1..30: note = hyper
  source 1..30: mol_type = genomic DNA
tgctggctctgagctcggagaaggagccgc

SEQ ID NO: 101222 - DNA, 23 bp, Homo sapiens
  misc_feature 1..23: note = chr9:80303276-80303299
  misc_feature 1..23: note = hypo
  source 1..23: mol_type = genomic DNA
ttcctattcggccatcttggctc

SEQ ID NO: 101223 - DNA, 30 bp, Homo sapiens
  misc_feature 1..30: note = chr9:80645516-80645546
  misc_feature 1..30: note = hyper
  source 1..30: mol_type = genomic DNA
caccggccactccaccgcaggccatccccc

SEQ ID NO: 101224 - DNA, 35 bp, Homo sapiens
  misc_feature 1..35: note = chr9:80645867-80645902
  misc_feature 1..35: note = hyper
  source 1..35: mol_type = genomic DNA
gtgaaggcagtggccgggggcgcgcccgggagggt

SEQ ID NO: 101225 - DNA, 186 bp, Homo sapiens
  misc_feature 1..186: note = chr9:80646323-80646509
  misc_feature 1..186: note = hyper
  source 1..186: mol_type = genomic DNA
ggccaccaggtgggccgggggcgcggtgggagcggatagtctgggccgacgggagaagagaggcgggcgcgggaggcgggcgctggctcggggggcgcgtgagagaaggccgccgcgcccggcctcgctcagacgcccgcgcctccttccccgggaacaggcggcccgcctcgccccccgagccgc

SEQ ID NO: 101226 - DNA, 76 bp, Homo sapiens
  misc_feature 1..76: note = chr9:80647171-80647247
  misc_feature 1..76: note = hyper
  source 1..76: mol_type = genomic DNA
acgcgcagcccgagccggcggccgccgttgcgtgccagggccgcagccgacctgcggctgccgtccggccgggcgt

SEQ ID NO: 101227 - DNA, 58 bp, Homo sapiens
  misc_feature 1..58: note = chr9:80849784-80849842
  misc_feature 1..58: note = hypo
  source 1..58: mol_type = genomic DNA
ttatgaatatacaagcgtttactatattaagatttgagcatgtcgcacataaaaataa

SEQ ID NO: 101228 - DNA, 147 bp, Homo sapiens
  misc_feature 1..147: note = chr9:80852173-80852320
  misc_feature 1..147: note = hypo
  source 1..147: mol_type = genomic DNA
ggcatgagccaccgcgcccggcctgtcttcattttttaaggtgtatataagaagtttgtaaagtgctttacaaatacaagccatttgtaaatgtatagtggtataattagggatccagactctctgattattcggaaaatatgttag

SEQ ID NO: 101229 - DNA, 145 bp, Homo sapiens
  misc_feature 1..145: note = chr9:80911891-80912036
  misc_feature 1..145: note = hyper
  source 1..145: mol_type = genomic DNA
gaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggcc

SEQ ID NO: 101230 - DNA, 148 bp, Homo sapiens
  misc_feature 1..148: note = chr9:81181130-81181278
  misc_feature 1..148: note = hypo
  source 1..148: mol_type = genomic DNA
aacatctttctgatacgttaatgggaaggcaaaaacaaaacaaaacaaacaaacacacaccaccttttcccactgggagatgtaacactttaacaaaatagagtctgaaagagccctgggtctagcaagcctccggggagaggctgtg

SEQ ID NO: 101231 - DNA, 154 bp, Homo sapiens
  misc_feature 1..154: note = chr9:81358951-81359105
  misc_feature 1..154: note = hypo
  source 1..154: mol_type = genomic DNA
gtctgttgattgttacgtctttcaagcatgaattaatgaacagtttatggttattataccagcccgaaatattcaatataagctcaggttctacaattgatttggcaagaatcaattctgagtttgtctacagtggattcggcagggacttggc

SEQ ID NO: 101232 - DNA, 38 bp, Homo sapiens
  misc_feature 1..38: note = chr9:82185345-82185383
  misc_feature 1..38: note = hyper
  source 1..38: mol_type = genomic DNA
ctaaggatggaaaggcgcactgacggaggccgccccca

SEQ ID NO: 101233 - DNA, 60 bp, Homo sapiens
  misc_feature 1..60: note = chr9:82185643-82185703
  misc_feature 1..60: note = hyper
  source 1..60: mol_type = genomic DNA
tgctctgttcagtaccgaccgtgttcggggttcacgtggcccagtcggcaaagtttcttt

SEQ ID NO: 101234 - DNA, 30 bp, Homo sapiens
  misc_feature 1..30: note = chr9:82336772-82336802
  misc_feature 1..30: note = hypo
  source 1..30: mol_type = genomic DNA
gcagctgcagcagcacgacttcacctccca

SEQ ID NO: 101235 - DNA, 39 bp, Homo sapiens; identical to SEQ ID NO: 32333
  misc_feature 1..39: note = chr9:841367-841406
  misc_feature 1..39: note = hyper
  source 1..39: mol_type = genomic DNA

SEQ ID NO: 101236 - DNA, 401 bp, Homo sapiens; identical to SEQ ID NO: 32334
  misc_feature 1..401: note = chr9:841449-841850
  misc_feature 1..401: note = hyper
  source 1..401: mol_type = genomic DNA

SEQ ID NO: 101237 - DNA, 181 bp, Homo sapiens; identical to SEQ ID NO: 3384
  misc_feature 1..181: note = chr9:841851-842032
  misc_feature 1..181: note = hyper
  source 1..181: mol_type = genomic DNA

SEQ ID NO: 101238 - DNA, 37 bp, Homo sapiens
  misc_feature 1..37: note = chr9:842207-842244
  misc_feature 1..37: note = hyper
  source 1..37: mol_type = genomic DNA
cgggagcccgggttcagccttagtttttttttttttt

SEQ ID NO: 101239 - DNA, 71 bp, Homo sapiens
  misc_feature 1..71: note = chr9:84241090-84241161
  misc_feature 1..71: note = hypo
  source 1..71: mol_type = genomic DNA
gaactttctcctccccgcaggaaaagtgtttgtgtcagaggtacagattggaaactcgtgacacctcattt

SEQ ID NO: 101240 - DNA, 138 bp, Homo sapiens; identical to SEQ ID NO: 32338
  misc_feature 1..138: note = chr9:842610-842748
  misc_feature 1..138: note = hyper
  source 1..138: mol_type = genomic DNA

SEQ ID NO: 101241 - DNA, 941 bp, Homo sapiens
  misc_feature 1..941: note = chr9:842779-843720
  misc_feature 1..941: note = hyper
  source 1..941: mol_type = genomic DNA
cgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 101242 - DNA, 37 bp, Homo sapiens
  misc_feature 1..37: note = chr9:84294953-84294990
  misc_feature 1..37: note = hypo
  source 1..37: mol_type = genomic DNA
tcttaagtcctctggcgaaggacgctcctcaatttgc

SEQ ID NO: 101243 - DNA, 17 bp, Homo sapiens
  misc_feature 1..17: note = chr9:85372740-85372757
  misc_feature 1..17: note = hypo
  source 1..17: mol_type = genomic DNA
gacgggagctgttccta

SEQ ID NO: 101244 - DNA, 577 bp, Homo sapiens
  misc_feature 1..577: note = chr9:86152387-86152964
  misc_feature 1..577: note = hyper
  source 1..577: mol_type = genomic DNA
atccctcaaggctggcgcccagggcagcccggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcgaggggaaggagactgggcgcggataacgcgtgcctggcgcttgcagggcaccatgcccctccatgccaggataaggccccccaccctcagaggcctgaggaatcgaaatctggctttctagcagtcccccaatcccctccgggagtgggttccttgttctcgcatgcccaccgcaaaggccccccgccctgctcccggc

SEQ ID NO: 101245 - DNA, 212 bp, Homo sapiens
  misc_feature 1..212: note = chr9:86153332-86153544
  misc_feature 1..212: note = hyper
  source 1..212: mol_type = genomic DNA
ctgttcgctcgcctccgcctcgccccctcctttccccgcctccttctgtcgcgcgcgctcgtgcgcctccctctgcccgggctcgctcgccgaggacgcccagagcctgagacccccggcgggctcgcgacgcactcactcccacgcgcgccgagcagctgaaggaggaggcggagggatggctggcgcggctggcccgggtgccctggtgg

SEQ ID NO: 101246 - DNA, 25 bp, Homo sapiens
  misc_feature 1..25: note = chr9:86537478-86537503
  misc_feature 1..25: note = hypo
  source 1..25: mol_type = genomic DNA
ccaccctgcccggccctatcaggac

SEQ ID NO: 101247 - DNA, 581 bp, Homo sapiens; identical to SEQ ID NO: 32520
  misc_feature 1..581: note = chr9:86755532-86756113
  misc_feature 1..581: note = hyper
  source 1..581: mol_type = genomic DNA

SEQ ID NO: 101248 - DNA, 227 bp, Homo sapiens
  misc_feature 1..227: note = chr9:86886509-86886736
  misc_feature 1..227: note = hyper
  source 1..227: mol_type = genomic DNA
aacaaaacaaaacagcgttcctgagcgcccagctgcagcctcctgcgagcacatcatgttccgcacgtctcgctggttcgaggacgcctcgtctgttgctatggaaacagagtagtcaaatcagactgcgacggaggactctactgagtccccgagaacaaattgtttccttctgtttggttccatttggtttaagtagcgggggagaccctcgctttctggataaa

SEQ ID NO: 101249 - DNA, 767 bp, Homo sapiens
  misc_feature 1..767: note = chr9:87282999-87283766
  misc_feature 1..767: note = hyper
  source 1..767: mol_type = genomic DNA
ccaatagatgttttacgttcccttcgtaatatttaacgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaaggtacggcaggggagcaagggcttgggatgccctacgtgggggtgggcatcgcggggagtgaatcca

SEQ ID NO: 101250 - DNA, 50 bp, Homo sapiens
  misc_feature 1..50: note = chr9:87284009-87284059
  misc_feature 1..50: note = hyper
  source 1..50: mol_type = genomic DNA
cccctccaaaaccaccgatccccaaataggtggcccggaatgggggcggt

SEQ ID NO: 101251 - DNA, 439 bp, Homo sapiens; identical to SEQ ID NO: 9946
  misc_feature 1..439: note = chr9:87284555-87284994
  misc_feature 1..439: note = hyper
  source 1..439: mol_type = genomic DNA

SEQ ID NO: 101252 - DNA, 254 bp, Homo sapiens; identical to SEQ ID NO: 9947
  misc_feature 1..254: note = chr9:87285279-87285533
  misc_feature 1..254: note = hyper
  source 1..254: mol_type = genomic DNA

SEQ ID NO: 101253 - DNA, 290 bp, Homo sapiens
  misc_feature 1..290: note = chr9:87285554-87285844
  misc_feature 1..290: note = hyper
  source 1..290: mol_type = genomic DNA
cgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagccta

SEQ ID NO: 101254 - DNA, 30 bp, Homo sapiens; identical to SEQ ID NO: 42145
  misc_feature 1..30: note = chr9:87326719-87326749
  misc_feature 1..30: note = hypo
  source 1..30: mol_type = genomic DNA

SEQ ID NO: 101255 - DNA, 29 bp, Homo sapiens
  misc_feature 1..29: note = chr9:88137397-88137426
  misc_feature 1..29: note = hyper
  source 1..29: mol_type = genomic DNA
acacacacgcacagacgcacactcacgtg

SEQ ID NO: 101256 - DNA, 240 bp, Homo sapiens
  misc_feature 1..240: note = chr9:88137486-88137726
  misc_feature 1..240: note = hyper
  source 1..240: mol_type = genomic DNA
ctgtcagcaagaaaggaaggcaggctgttgagtagggaagtgggagtgcctgccggcgttctcgtctgtccctacttcatccttcctctctcactgtcttacagcaaaggactacagcaaaggcgcgttcagcgcctgcgcggccaggcccggggtgctgggttgcggcttcccgcgggtaaaccctgtcggtacccgatccccgtccgcggaaggccaggagaacgcggttccccttct

SEQ ID NO: 101257 - DNA, 240 bp, Homo sapiens; identical to SEQ ID NO: 3427
  misc_feature 1..240: note = chr9:88137874-88138114
  misc_feature 1..240: note = hyper
  source 1..240: mol_type = genomic DNA

SEQ ID NO: 101258 - DNA, 43 bp, Homo sapiens; identical to SEQ ID NO: 32372
  misc_feature 1..43: note = chr9:8857443-8857486
  misc_feature 1..43: note = hyper
  source 1..43: mol_type = genomic DNA

SEQ ID NO: 101259 - DNA, 1005 bp, Homo sapiens
  misc_feature 1..1005: note = chr9:8857685-8858690
  misc_feature 1..1005: note = hyper
  source 1..1005: mol_type = genomic DNA
cgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 101260 - DNA, 30 bp, Homo sapiens; identical to SEQ ID NO: 42146
  misc_feature 1..30: note = chr9:88832474-88832504
  misc_feature 1..30: note = hypo
  source 1..30: mol_type = genomic DNA

SEQ ID NO: 101261 - DNA, 30 bp, Homo sapiens
  misc_feature 1..30: note = chr9:89083624-89083654
  misc_feature 1..30: note = hypo
  source 1..30: mol_type = genomic DNA
aggcatgagccactgcgccaggcaagggtg

SEQ ID NO: 101262 - DNA, 67 bp, Homo sapiens
  misc_feature 1..67: note = chr9:89131689-89131756
  misc_feature 1..67: note = hypo
  source 1..67: mol_type = genomic DNA
agccttctcctgtgtcgactcccagagcggccggctgggtcctgcactcgctcgttcacatgctccc

SEQ ID NO: 101263 - DNA, 22 bp, Homo sapiens
  misc_feature 1..22: note = chr9:89330755-89330777
  misc_feature 1..22: note = hypo
  source 1..22: mol_type = genomic DNA
ttacaggcgtgagccactgcgc

SEQ ID NO: 101264 - DNA, 30 bp, Homo sapiens
  misc_feature 1..30: note = chr9:89374984-89375014
  misc_feature 1..30: note = hypo
  source 1..30: mol_type = genomic DNA
actactcttgtgcttcgaggcccttattta

SEQ ID NO: 101265 - DNA, 30 bp, Homo sapiens
  misc_feature 1..30: note = chr9:89518042-89518072
  misc_feature 1..30: note = hyper
  source 1..30: mol_type = genomic DNA
ccatggcagattacacgatacagctgtccc

SEQ ID NO: 101266 - DNA, 624 bp, Homo sapiens
  misc_feature 1..624: note = chr9:89560694-89561318
  misc_feature 1..624: note = hyper
  source 1..624: mol_type = genomic DNA
cgagtggggtccaggcgccccggggcgccaagcggccgccgccgccgctgctcctgcgcccaggcccatagggcaggtccccgcggccgcccgatgcagcagcgccgctgcccgggcgcggtgggtgcgggacgccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagccagcatgtcctcaatgacggtgcggcattcgtccgtgcagcgcagcccgttgaagactttgccgcagtaggtcaggtagcggctcagcgccaggttgcagcggctgtcgcggtcgcagcgccgccgggcctcggtgcagcccatgaccccgcccgcgccggggccgcccgcgccgccgccgctcgtccggggcaggcacggctcaatggcgcgcttggtggacttgcagttctcgtcctgcgcgcagtcacagtcct

SEQ ID NO: 101267 - DNA, 30 bp, Homo sapiens
  misc_feature 1..30: note = chr9:89561749-89561779
  misc_feature 1..30: note = hyper
  source 1..30: mol_type = genomic DNA
cggcggacgcggagccggtggaaaagtttg

SEQ ID NO: 101268 - DNA, 82 bp, Homo sapiens
  misc_feature 1..82: note = chr9:89563765-89563847
  misc_feature 1..82: note = hyper
  source 1..82: mol_type = genomic DNA
actaggagattcctccggctgcgggaaatcttcctgtacctgctgaagctgctgcgttcctcagaggcgcttggtctgccgt

SEQ ID NO: 101269 - DNA, 299 bp, Homo sapiens
  misc_feature 1..299: note = chr9:89763321-89763620
  misc_feature 1..299: note = hyper
  source 1..299: mol_type = genomic DNA
tgctactttccatcccgttaatacaatcccggccctgtttcccggccccgcggccattgcagagtcatgaagtcatcgcagctgcgcctgcagccaggcgggaacgggaacgggaactggctggccgcggtcccttctgtcccccgccagccggaaatgtccgcgcgctgaaaagcagacgctgcctgcccggggaacggcgagagagagcgagaaaaaaaaaagcctgaaggcggcgcggcagccagcgagaggggagaaacagattcacacccaggggcctccgggcagggcccacg

SEQ ID NO: 101270 - DNA, 30 bp, Homo sapiens
  misc_feature 1..30: note = chr9:90000239-90000269
  misc_feature 1..30: note = hypo
  source 1..30: mol_type = genomic DNA
caaaaataggtttctcggccgggcgcagtg

SEQ ID NO: 101271 - DNA, 66 bp, Homo sapiens
  misc_feature 1..66: note = chr9:90112790-90112856
  misc_feature 1..66: note = hyper
  source 1..66: mol_type = genomic DNA
tgtgaggaggacagccggaccgagccaacgccggggactttgttccctccgcggaggggactcggc

SEQ ID NO: 101272 - DNA, 30 bp, Homo sapiens
  misc_feature 1..30: note = chr9:90113126-90113156
  misc_feature 1..30: note = hyper
  source 1..30: mol_type = genomic DNA
ctgggaaggccaaggcggagggaaacttgg

SEQ ID NO: 101273 - DNA, 83 bp, Homo sapiens
  misc_feature 1..83: note = chr9:90113665-90113748
  misc_feature 1..83: note = hyper
  source 1..83: mol_type = genomic DNA
gggtgccgtggtgcccggccccacgcgcgcgcggggctgaggggtcgggggcgtccctggccgcccagctttaacaaagggtg

SEQ ID NO: 101274 - DNA, 30 bp, Homo sapiens
  misc_feature 1..30: note = chr9:90279219-90279249
  misc_feature 1..30: note = hypo
  source 1..30: mol_type = genomic DNA
ccccttcaccccctgcgcatagtgtgccca

SEQ ID NO: 101275 - DNA, 161 bp, Homo sapiens
  misc_feature 1..161: note = chr9:90287605-90287766
  misc_feature 1..161: note = hypo
  source 1..161: mol_type = genomic DNA
aagcattgctaattgcggtctttcttccttgtgtatgaatataaatccccatgcaagtaactgcttggcacctgggcacacccggtactggaatttggttattggaaatgactgagctgtcgcggcagcttccttggagaatgcatcgctgaggattgtgg

SEQ ID NO: 101276 - DNA, 30 bp, Homo sapiens
  misc_feature 1..30: note = chr9:90316457-90316487
  misc_feature 1..30: note = hypo
  source 1..30: mol_type = genomic DNA
gataaatggtcacaccgtaatgttcaaaaa

SEQ ID NO: 101277 - DNA, 49 bp, Homo sapiens
  misc_feature 1..49: note = chr9:90321063-90321112
  misc_feature 1..49: note = hypo
  source 1..49: mol_type = genomic DNA
tgaaacagttcaggacgtgctgctcctggacccccgctggctctgcaca

SEQ ID NO: 101278 - DNA, 165 bp, Homo sapiens; identical to SEQ ID NO: 42147
  misc_feature 1..165: note = chr9:90322123-90322288
  misc_feature 1..165: note = hypo
  source 1..165: mol_type = genomic DNA

SEQ ID NO: 101279 - DNA, 170 bp, Homo sapiens
  misc_feature 1..170: note = chr9:90331505-90331675
  misc_feature 1..170: note = hypo
  source 1..170: mol_type = genomic DNA
gggtcagtcggtctccgctcaaatggtcccagagatggaggattggaaaagcagattttaattcctacgtgagctgacacttaccacctgtatttctcatcccttgttctgtcttccaggctataaagacgccttgaatcctcctccacgatacccgccccactatttgt

SEQ ID NO: 101280 - DNA, 98 bp, Homo sapiens
  misc_feature 1..98: note = chr9:90340845-90340943
  misc_feature 1..98: note = hyper
  source 1..98: mol_type = genomic DNA
ccactgaggcaggcacgcccagctctgggacagtcagtaaacaagccacgaaccgcgccagggatcagagcacccagagtccccgcccagctgccggc

SEQ ID NO: 101281 - DNA, 79 bp, Homo sapiens
  misc_feature 1..79: note = chr9:90341264-90341343
  misc_feature 1..79: note = hyper
  source 1..79: mol_type = genomic DNA
gcgtgactggttgagcgggcaggccagcctccgagccgggtggacacaggtaccgcagccaggccgcgccgcgccgact

SEQ ID NO: 101282 - DNA, 30 bp, Homo sapiens
  misc_feature 1..30: note = chr9:90386516-90386546
  misc_feature 1..30: note = hypo
  source 1..30: mol_type = genomic DNA
cccggcgagtacctccgctctgtgagtggg

SEQ ID NO: 101283 - DNA, 173 bp, Homo sapiens
  misc_feature 1..173: note = chr9:90421580-90421753
  misc_feature 1..173: note = hypo
  source 1..173: mol_type = genomic DNA
ctgctcaaggtgacccgagtcagaactgcaggtcagccccttcctggcttcctccgcaggcactgtctgctcctgaactcccaccacaatcctcagcgatgcattctccaaagaagccgctgtgacagctgtcattttcaaaaaccaaattccagtaccgggtgtgcccaggt

SEQ ID NO: 101284 - DNA, 30 bp, Homo sapiens
  misc_feature 1..30: note = chr9:90588928-90588958
  misc_feature 1..30: note = hyper
  source 1..30: mol_type = genomic DNA
tgagggcaactatctcgccagtctgcagga

SEQ ID NO: 101285 - DNA, 93 bp, Homo sapiens; identical to SEQ ID NO: 32533
  misc_feature 1..93: note = chr9:90589194-90589287
  misc_feature 1..93: note = hyper
  source 1..93: mol_type = genomic DNA

SEQ ID NO: 101286 - DNA, 184 bp, Homo sapiens
  misc_feature 1..184: note = chr9:90589592-90589776
  misc_feature 1..184: note = hyper
  source 1..184: mol_type = genomic DNA
cagcaagcttaatcccgcataaaaaacgcatgcgccgagagcgtgcccgcagcagggcccacggaacgatgacagcaggcacctcctatctgcccccgcccccggcgtcacgtgactagctgcgctggtgcacgcagccgggaggggcgggctccttcccctggcaagccggaagctccgcacc

SEQ ID NO: 101287 - DNA, 84 bp, Homo sapiens
  misc_feature 1..84: note = chr9:90691103-90691187
  misc_feature 1..84: note = hyper
  source 1..84: mol_type = genomic DNA
tggtgtcaaagcagacgtctgctcggtgtggccgtatttttgtgagcggagctgcttttgtgagcgctgcgtccctgcagcatc

SEQ ID NO: 101288 - DNA, 103 bp, Homo sapiens
  misc_feature 1..103: note = chr9:90749344-90749447
  misc_feature 1..103: note = hypo
  source 1..103: mol_type = genomic DNA
ctcagggcctggcctcggacagagacctcccccgtctcatgaccagagacctcccccgtctcatgaccggtcctggccgctgagcccacgggtttgattttgc

SEQ ID NO: 101289 - DNA, 193 bp, Homo sapiens
  misc_feature 1..193: note = chr9:91149133-91149326
  misc_feature 1..193: note = hyper
  source 1..193: mol_type = genomic DNA
ggcgctgaaggggagcgcgaggagtgggaggaagtgaaggaggaggaagagcacggtgtgggggaagcgcaggaggcaataggtggggcgggacggagggcagggcgctgcgtcgggagaaagtgtagaagcgctggggagagtgcccacgacgggagagcccaggggcgcgagggcgcgggagtgtgggcgg

SEQ ID NO: 101290 - DNA, 30 bp, Homo sapiens
  misc_feature 1..30: note = chr9:91149724-91149754
  misc_feature 1..30: note = hyper
  source 1..30: mol_type = genomic DNA
agttggaggagagtgcggggatgtgggcgg

SEQ ID NO: 101291 - DNA, 409 bp, Homo sapiens
  misc_feature 1..409: note = chr9:91149976-91150385
  misc_feature 1..409: note = hyper
  source 1..409: mol_type = genomic DNA
tgcggggaatgtgggcggggcgcagtggtgggagggcgcaggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacc

SEQ ID NO: 101292 - DNA, 40 bp, Homo sapiens; identical to SEQ ID NO: 32536
  misc_feature 1..40: note = chr9:91150621-91150661
  misc_feature 1..40: note = hyper
  source 1..40: mol_type = genomic DNA

SEQ ID NO: 101293 - DNA, 69 bp, Homo sapiens
  misc_feature 1..69: note = chr9:91321072-91321141
  misc_feature 1..69: note = hypo
  source 1..69: mol_type = genomic DNA
actagccctttgctgcgatgatgcctccccgttggggtgcggctggtccgtttgcgagggaggtgggaa

SEQ ID NO: 101294 - DNA, 398 bp, Homo sapiens; identical to SEQ ID NO: 32537
  misc_feature 1..398: note = chr9:91605965-91606363
  misc_feature 1..398: note = hyper
  source 1..398: mol_type = genomic DNA

SEQ ID NO: 101295 - DNA, 30 bp, Homo sapiens; identical to SEQ ID NO: 32538
  misc_feature 1..30: note = chr9:91606806-91606836
  misc_feature 1..30: note = hyper
  source 1..30: mol_type = genomic DNA

SEQ ID NO: 101296 - DNA, 1242 bp, Homo sapiens
  misc_feature 1..1242: note = chr9:91792357-91793599
  misc_feature 1..1242: note = hyper
  source 1..1242: mol_type = genomic DNA
tgagaaagtaaagcccgtcgaagagaaagcagcacagcatttggcctgctctgcaaggagctgggaattcttgctgcggggggcaacaagatacccaccctcccgccggggaagacacagcaggagtagggccgccactccgtgcatctctcctcccgggggctgcccagctctccccagcgcgtttcctagatactaggcaggccggacccccgctgcccagggttgggcgcccatgacactggtcagacatctggtaagccaggtggcaaaggcgtgccaaaaaagtggagcctagggaaaaccgggacggagcgggccacccgagtggtaaaccttttcccaatggatgcgggaaaagcgcatttgtagttccctcctcaccgctgtcaagcgagctgattgctaaggagtgcgcatttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccgagagccgcgcgcccgcccgctcccgggcggccgacgacaggccgcggaggcccgagctggagagtttcaggtgggacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcaggcgagccactgtccccggagcgggacggagagtgggggccccgggacagccttctggagaacgagagcagagcaagaggatggtgccctcccaccgttaaaagccagcacagcggcggccgcgcagccccggcccgggagaccgctgct

SEQ ID NO: 101297 - DNA, 344 bp, Homo sapiens
  misc_feature 1..344: note = chr9:91849514-91849858
  misc_feature 1..344: note = hyper
  source 1..344: mol_type = genomic DNA
cctgcactccaggagcggtttgacttgggtggttatggaaacggagcccgatctgcatagggttaatctgccgagtagtgactacttctgtcaaattctccccaagggtaaaccctgcgggctgaggaggcagcggcggaggctgggcgcacgtgggtgctgcagtagccggcggacgcccagggcgcacgggggcgcaccgagagacctcaccgaacccaaagagcgtgcggttcgtctcgcccaaaaccacagcgctggctacagaaacccctgaaatcggaaatactctaaccaaaggtactgagagcgaatctcatctttcccatcggggaaagtagatg

SEQ ID NO: 101298 - DNA, 30 bp, Homo sapiens
  misc_feature 1..30: note = chr9:91870244-91870274
  misc_feature 1..30: note = hypo
  source 1..30: mol_type = genomic DNA
cagagagggaccatgcgggcaaagccagct

SEQ ID NO: 101299 - DNA, 267 bp, Homo sapiens
  misc_feature 1..267: note = chr9:91995936-91996203
  misc_feature 1..267: note = hypo
  source 1..267: mol_type = genomic DNA
ccaaaggaaatgggacgtcgaggagtcactcacccgggcacacagaagcatcgccgctcatctcctgaatcaaacccctgcaaaacaaccggcacgtgttattcacccacacacatgggggacatccccaggcagcgcatcccgccccatacctgctggggctctcggtctggtgcagagccacgcaggtcgctgtgggcgggctccaggcgcagtaggggtcccgcgccagcacacagtcctcgcaggtgccgtgcttcccacaga

SEQ ID NO: 101300 - DNA, 101 bp, Homo sapiens
  misc_feature 1..101: note = chr9:92163460-92163561
  misc_feature 1..101: note = hypo
  source 1..101: mol_type = genomic DNA
catgagcacctttcccgagtgtaatagggtggcctgaagaaacagcacattctcctccatgagctcctgcagagccttttctttttaaaaaaaaaatacag

SEQ ID NO: 101301 - DNA, 30 bp, Homo sapiens
  misc_feature 1..30: note = chr9:92800931-92800961
  misc_feature 1..30: note = hypo
  source 1..30: mol_type = genomic DNA
tataattaaattgtacgtatttatggggta

SEQ ID NO: 101302 - DNA, 159 bp, Homo sapiens; identical to SEQ ID NO: 42151
  misc_feature 1..159: note = chr9:92897057-92897216
  misc_feature 1..159: note = hypo
  source 1..159: mol_type = genomic DNA

SEQ ID NO: 101303 - DNA, 77 bp, Homo sapiens; identical to SEQ ID NO: 15229
  misc_feature 1..77: note = chr9:92980516-92980593
  misc_feature 1..77: note = hypo
  source 1..77: mol_type = genomic DNA

SEQ ID NO: 101304 - DNA, 290 bp, Homo sapiens
  misc_feature 1..290: note = chr9:93404961-93405251
  misc_feature 1..290: note = hyper
  source 1..290: mol_type = genomic DNA
caatcatgccaaagccgcccgtgccccaatgcggacgcagcgaagccacggcagaagggggaaatcggttacctggggaagaacacaactccgctcagagcttcttcagagctccactcgcgcaggacagggcagcgcagggtgtgtggatgcggctcctcccggaggcaggcgcagcgcactccctcccgccgccgtgacgatgctgtcagctgctcgcccgccgtgcgccctgcaccgcccaccggccgtgctccctgcgcccagcgccctcgcgctccacccgctcg

SEQ ID NO: 101305 - DNA, 197 bp, Homo sapiens
  misc_feature 1..197: note = chr9:93462703-93462900
  misc_feature 1..197: note = hypo
  source 1..197: mol_type = genomic DNA
ggttcacgccgttctcctgcctcagccttccggcgctccggagtgtttcaagcaggatatcacctgaattgtacttgaaaagaagctttcttgcagcttggtggcgcttggattgaagagtagcaagtgtggaatgtggccactaatgagcgggctggagcttagcacaggtgctcctgatgcgggctcagctaggg

SEQ ID NO: 101306 - DNA, 46 bp, Homo sapiens
  misc_feature 1..46: note = chr9:93564410-93564456
  misc_feature 1..46: note = hyper
  source 1..46: mol_type = genomic DNA
ggacggaggtcagaccgtgcggaaagtgacccgggcaccccagggc

SEQ ID NO: 101307 - DNA, 32 bp, Homo sapiens
  misc_feature 1..32: note = chr9:93698029-93698061
  misc_feature 1..32: note = hypo
  source 1..32: mol_type = genomic DNA
gagcaggtggttggccgggcgcggtggctcac

SEQ ID NO: 101308 - DNA, 158 bp, Homo sapiens
  misc_feature 1..158: note = chr9:93901190-93901348
  misc_feature 1..158: note = hypo
  source 1..158: mol_type = genomic DNA
ggtaggtgaatcatgcgtttgcgtaaacagtactggtgaatggtcccattgtagacatgaagttctgcacttgcttttaaggctagcatttactcatttgccttttaaacctgtcatcatgtgcccttctaataaacatcttgaaactgtctgtccat

SEQ ID NO: 101309 - DNA, 248 bp, Homo sapiens
  misc_feature 1..248: note = chr9:93955929-93956177
  misc_feature 1..248: note = hyper
  source 1..248: mol_type = genomic DNA
aaaaggaaatacacacgcacacatggacctaacacacaaaacgtccttctgcgggaagccagcactaggaaagaaaaaaaaaaaaatccgaagtgaaattatgacacagggttttgtaacccgcggtggcgcgcttctgaaacccgagcccggcagcggcttcttatctgcaccgcgttccaggaagcagccggcgtttcggccgcgcaagggcagccgccgcacgtaggcagcgtcccccagcccgg

SEQ ID NO: 101310 - DNA, 213 bp, Homo sapiens
  misc_feature 1..213: note = chr9:93956444-93956657
  misc_feature 1..213: note = hyper
  source 1..213: mol_type = genomic DNA
ccgccactgctgtcacgtagcaatcaagagtaaaggttatcacaaagtctgttcttcgaaggaaagagttggaatcaaggacttcggacgggaggaagttggtaagttaccgcttcctccctcctgttttcctctccttgtttaacttctcacaagaacatgtggcagcgctgcaggttaactcatcttacataacttcggggccgtgtcaac

SEQ ID NO: 101311 - DNA, 480 bp, Homo sapiens
  misc_feature 1..480: note = chr9:94183464-94183944
  misc_feature 1..480: note = hyper
  source 1..480: mol_type = genomic DNA
gagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgcca

SEQ ID NO: 101312 - DNA, 32 bp, Homo sapiens
  misc_feature 1..32: note = chr9:94187211-94187243
  misc_feature 1..32: note = hyper
  source 1..32: mol_type = genomic DNA
aaaagagcacctagccgcgacttcttaagtcg

SEQ ID NO: 101313 - DNA, 42 bp, Homo sapiens
  misc_feature 1..42: note = chr9:94486293-94486335
  misc_feature 1..42: note = hypo
  source 1..42: mol_type = genomic DNA
gcaccggctggtagccgttgacggggacgtagagctgcggcg

SEQ ID NO: 101314 - DNA, 30 bp, Homo sapiens; identical to SEQ ID NO: 42155
  misc_feature 1..30: note = chr9:94572598-94572628
  misc_feature 1..30: note = hypo
  source 1..30: mol_type = genomic DNA

SEQ ID NO: 101315 - DNA, 87 bp, Homo sapiens
  misc_feature 1..87: note = chr9:94573085-94573172
  misc_feature 1..87: note = hypo
  source 1..87: mol_type = genomic DNA
cacacacagggaatgcggccctaattaggaccccacttcgctgtgaggaagacagacccagaggggagacatcggcactctcatgct

SEQ ID NO: 101316 - DNA, 93 bp, Homo sapiens
  misc_feature 1..93: note = chr9:94579436-94579529
  misc_feature 1..93: note = hypo
  source 1..93: mol_type = genomic DNA
tcagtgctggtgaggcggttggcttggcatttctctcagccaacctgactttactgaaatagagtcgagaaggaaggccgggacccagcaggg

SEQ ID NO: 101317 - DNA, 141 bp, Homo sapiens; identical to SEQ ID NO: 42157
  misc_feature 1..141: note = chr9:94658109-94658250
  misc_feature 1..141: note = hypo
  source 1..141: mol_type = genomic DNA

SEQ ID NO: 101318 - DNA, 22 bp, Homo sapiens
  misc_feature 1..22: note = chr9:94685022-94685044
  misc_feature 1..22: note = hypo
  source 1..22: mol_type = genomic DNA
ccgcgcccgaccaagaatattt

SEQ ID NO: 101319 - DNA, 978 bp, Homo sapiens
  misc_feature 1..978: note = chr9:94711102-94712080
  misc_feature 1..978: note = hyper
  source 1..978: mol_type = genomic DNA
tgggcctgaaggccccgcccgccctcctccacccccgcagggtgccgagaatccggcccgaggcgcgcgggcgggaggtgctcccggagtctgcaccgccagagctaacgccgcctcctccaggcaacctaggcaggtcccaagctgcacttccgaacctccccgccgttcctctgcgccccggatccaagcagccgaaaccgcgcagggactcgggggaagtggggccccgggaggaaacccacctaggagccgggccccgcccctcccgccgccagcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagactctggaaacacttaggcgtccccagagcgcggcttattgtaaccagcccgagggggtccggggtgcgggccgggagcggcgtcgggcgagatgcgaatggccctgcctggcgcccctcgttcaggagcatgggcgccggcgcagcggccgggagcatagtgg

SEQ ID NO: 101320 - DNA, 794 bp, Homo sapiens; identical to SEQ ID NO: 32547
  misc_feature 1..794: note = chr9:94712294-94713088
  misc_feature 1..794: note = hyper
  source 1..794: mol_type = genomic DNA

SEQ ID NO: 101321 - DNA, 30 bp, Homo sapiens
  misc_feature 1..30: note = chr9:94746198-94746228
  misc_feature 1..30: note = hypo
  source 1..30: mol_type = genomic DNA
ccggagactgggagtcgatgcagaatggac

SEQ ID NO: 101322 - DNA, 137 bp, Homo sapiens
  misc_feature 1..137: note = chr9:94862789-94862926
  misc_feature 1..137: note = hypo
  source 1..137: mol_type = genomic DNA
actctaactgtggaccgattactgatttattgtgccatcagtgcgctcaccaactggccctggtgtttctaggtgatccccatctcaaacctgcagaccagccccagtaatccacagctaggcgagtgtttccaggg

SEQ ID NO: 101323 - DNA, 102 bp, Homo sapiens
  misc_feature 1..102: note = chr9:94863469-94863571
  misc_feature 1..102: note = hypo
  source 1..102: mol_type = genomic DNA
gagagaaaacttaatcgaataataaaaaaaaacaagccatagcctgaatgagaaattcaacaaagacatagataccattaaagaaaacaaacaggccaggcg

SEQ ID NO: 101324 - DNA, 245 bp, Homo sapiens
  misc_feature 1..245: note = chr9:94934584-94934829
  misc_feature 1..245: note = hypo
  source 1..245: mol_type = genomic DNA
cctggaccacaaagacgaggaggacggcctgtctctggaccggagcagcaccatggcctcagaccacgtggtggacatgcaggacctcaccgagttcctggatgaagcctcttcgcccagcgaatatgctgtcttcctcctccactggctcttccctgagctctttgaccactgcaagctgggcgagtactacagctgctatggggatggcagcaagcaggagctggagccgcagaggctgcaga

SEQ ID NO: 101325 - DNA, 30 bp, Homo sapiens
  misc_feature 1..30: note = chr9:95416325-95416355
  misc_feature 1..30: note = hypo
  source 1..30: mol_type = genomic DNA
gagacacagcagctacgcaggtctcaggtc

SEQ ID NO: 101326 - DNA, 169 bp, Homo sapiens
  misc_feature 1..169: note = chr9:95417482-95417651
  misc_feature 1..169: note = hypo
  source 1..169: mol_type = genomic DNA
ctttgcctaactcaccgacacatctgttcttccctcacgtggccctgtgtggccctgcagatgcagcgaccctgaggggtgcatcgtcagcctggaatgggctctgcacctactttcccactgcgccagagcccagcggcgtcctactgggacacgctcacctgcaggg

SEQ ID NO: 101327 - DNA, 30 bp, Homo sapiens
  misc_feature 1..30: note = chr9:95442637-95442667
  misc_feature 1..30: note = hypo
  source 1..30: mol_type = genomic DNA
ccatgcatatgaagccgatgcctgcacccc

SEQ ID NO: 101328 - DNA, 310 bp, Homo sapiens
  misc_feature 1..310: note = chr9:95485043-95485353
  misc_feature 1..310: note = hypo
  source 1..310: mol_type = genomic DNA
atgtcatcccgcaggcggccacgctggatctccacattctggttgatctgttgggggagagggaaaggcaggtatgagcagcctccacagggcacgagaggggctcagtgcagccaggcacgccatggccagccatacagccagaactcaagagccctggcctgcaggtgccagtgtgactgcctggagaggagagggagcccagagcagtatgccagagtgcacagcggactgcagaggttccagagtaaattccctcagcccttctcacctgggaacccgtgactgcctgctccgacccttggtttct

SEQ ID NO: 101329 - DNA, 30 bp, Homo sapiens
  misc_feature 1..30: note = chr9:95501326-95501356
  misc_feature 1..30: note = hypo
  source 1..30: mol_type = genomic DNA
ctagcctggctgcctcggttgggccctccc

SEQ ID NO: 101330 - DNA, 65 bp, Homo sapiens
  misc_feature 1..65: note = chr9:95560810-95560875
  misc_feature 1..65: note = hypo
  source 1..65: mol_type = genomic DNA
cagacacagccttggcgttgttcagaaggagggacattccaggtgctgggcgaagcagaggaggt

SEQ ID NO: 101331 - DNA, 1045 bp, Homo sapiens
  misc_feature 1..1045: note = chr9:95569676-95570721
  misc_feature 1..1045: note = hyper
  source 1..1045: mol_type = genomic DNA
cacaggcctgttggccgcggcgggccttggctcccctgagcctggtgggcctgcaaagagctgcgtccaggagccgcccccagggaacaagctgccagcgggcctggggagaaccgcccgtccgatgagctcggctgagcgtgcacgcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaa

SEQ ID NO: 101332 - DNA, 85 bp, Homo sapiens
  misc_feature 1..85: note = chr9:95570901-95570986
  misc_feature 1..85: note = hyper
  source 1..85: mol_type = genomic DNA
ccgagcccgcccgcactccccgcatctcaaaaccggggctagaggtccctgtagctgcggccaagccaggcggtctgccctgcgg

SEQ ID NO: 101333 - DNA, 337 bp, Homo sapiens
  misc_feature 1..337: note = chr9:95571355-95571692
  misc_feature 1..337: note = hyper
  source 1..337: mol_type = genomic DNA
gagggcccctgtcagcggccccgatctctctttggaggaggagcggggcgggagtcacggccaggagggccctcaggccggaagggatgcacgtctgcgattccgagacgtcccgcgcgagcccaggagaacccgcaagccagcagcgcctgcgcccgagctgcagcagccccctgcaggccacgcgggctcgggagcggtttccggagtccgagctggcgctgagctgcaggcgcgagcctaaaggcttagccggggcccacgctgtctgagagatcggagcgttcagctacaggcacgcgcttaacggcttcgtggagctcactcggtctgagag

SEQ ID NO: 101334 - DNA, 516 bp, Homo sapiens
  misc_feature 1..516: note = chr9:95571752-95572268
  misc_feature 1..516: note = hyper
  source 1..516: mol_type = genomic DNA
tgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggtatcgggggctcagcctgcggtgggagggggccccaggcccggcttccctgcagcccctggggcgggggccttggagggccccgggcaccctcggagccgcggagccaaatggag

SEQ ID NO: 101335 - DNA, 159 bp, Homo sapiens
  misc_feature 1..159: note = chr9:95709693-95709852
  misc_feature 1..159: note = hyper
  source 1..159: mol_type = genomic DNA
cgtccctgcagctgccgggagaggaggagacagggcggctgcctgtgggtgccgcggaccttcggggcgggccagggaggcgggaccgctcctcagaaccccaggggcttcagtcctgggctgattggcgcgggaagcacagcccggccctccaggtcc

SEQ ID NO: 101336 - DNA, 243 bp, Homo sapiens
  misc_feature 1..243: note = chr9:95821220-95821463
  misc_feature 1..243: note = hyper
  source 1..243: mol_type = genomic DNA
agcaacgatctgccccgaggacgaacctcctcgaccctccgccggcccagcaggcgccctagcggagccgaagcctggcagcgagcagttcgaaaccaggcggctgcacgcagcagcccgcgcgcccgttcccgagtggccgcagcgccttggtcccgggcgtctgcggacagcgcggccggccaagcctctccacgccgcaggctccgggcccctccgcgcccctcccggggaagtcgaaac

SEQ ID NO: 101337 - DNA, 430 bp, Homo sapiens
  misc_feature 1..430: note = chr9:95946132-95946562
  misc_feature 1..430: note = hyper
  source 1..430: mol_type = genomic DNA
ggccttgaggtctagcgcgccgggctgcggcgtgctgaggcgttgagcctgctgcctcctctcaggaagaaacggggtcctccgcagctgacagccctgcggggcgttccaaagaacttcagaggacaggagcgctacctcgagcaaagaaccgcgggtgggagcccaggtagccggcccgcaggtggccgcgcgcgcctgccagtcagccagcccgtccgcagccaggtgggcgtgccaggcccagccccctgcgccggtccggggcggggcgaacggagccccgccctccccgcgcgccgggtcggagccggtgcgggagcggagccgcgcgaagccggcaggagcacgcgggagcgcggccccgcagtggcccggcccgagagagcagcgcgcaggagctggagcggcgccacggcccccaccccag

SEQ ID NO: 101338 - DNA, 30 bp, Homo sapiens
  misc_feature 1..30: note = chr9:95946829-95946859
  misc_feature 1..30: note = hyper
  source 1..30: mol_type = genomic DNA
ctttacagctgcctccgggacagcctagca

SEQ ID NO: 101339 - DNA, 36 bp, Homo sapiens
  misc_feature 1..36: note = chr9:95947222-95947258
  misc_feature 1..36: note = hyper
  source 1..36: mol_type = genomic DNA
tggcggccgccgagacgtccccggcacgctgatgga

SEQ ID NO: 101340 - DNA, 110 bp, Homo sapiens
  misc_feature 1..110: note = chr9:96024041-96024151
  misc_feature 1..110: note = hypo
  source 1..110: mol_type = genomic DNA
cctcagtgaaggcagcgccggccctgacttgcaccttgtcccctgtgcccccagattctgcttggccacccagctccctatgctgtggacgtcgccgctcaggtccccac

SEQ ID NO: 101341 - DNA, 23 bp, Homo sapiens
  misc_feature 1..23: note = chr9:96230169-96230192
  misc_feature 1..23: note = hypo
  source 1..23: mol_type = genomic DNA
cttttttttttgagacggagttt

SEQ ID NO: 101342 - DNA, 57 bp, Homo sapiens
  misc_feature 1..57: note = chr9:96362025-96362082
  misc_feature 1..57: note = hypo
  source 1..57: mol_type = genomic DNA
gcagcaagggggattcggagcacgaaagggatttagaggcgccggtggggccaggtg

SEQ ID NO: 101343 - DNA, 48 bp, Homo sapiens
  misc_feature 1..48: note = chr9:96436127-96436175
  misc_feature 1..48: note = hypo
  source 1..48: mol_type = genomic DNA
caaggactcagactacggtgagtgtcactcctgcgtggggcagggccc

SEQ ID NO: 101344 - DNA, 28 bp, Homo sapiens
  misc_feature 1..28: note = chr9:96573710-96573738
  misc_feature 1..28: note = hypo
  source 1..28: mol_type = genomic DNA
tttttttttttgagacggagtctcgctc

SEQ ID NO: 101345 - DNA, 139 bp, Homo sapiens
  misc_feature 1..139: note = chr9:96588601-96588740
  misc_feature 1..139: note = hyper
  source 1..139: mol_type = genomic DNA
cgccgccaccattcccgttccggttggagaacacaatgcaccgcgcacaggctgtgccaaagtccacaggcacccttcggcctccatcatcgcgccctcttcacagatgagcaaacggaggccagacgtcaccggcagg

SEQ ID NO: 101346 - DNA, 115 bp, Homo sapiens; identical to SEQ ID NO: 32556
  misc_feature 1..115: note = chr9:96588857-96588972
  misc_feature 1..115: note = hyper
  source 1..115: mol_type = genomic DNA

SEQ ID NO: 101347 - DNA, 130 bp, Homo sapiens
  misc_feature 1..130: note = chr9:96590139-96590269
  misc_feature 1..130: note = hyper
  source 1..130: mol_type = genomic DNA
aattgctccggcggccggggggcgggctgggcgccgggtacattagcgcctgctttgctcgctgatggtgtttatagggatgtggaacgggcctccaggaaaccgtctggcaggccgggcttcagcaaat

SEQ ID NO: 101348 - DNA, 360 bp, Homo sapiens
  misc_feature 1..360: note = chr9:96708199-96708559
  misc_feature 1..360: note = hyper
  source 1..360: mol_type = genomic DNA
cggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacgctgcctcctcccagcgcttccaagtggcgcctgggcccacatccttgcctgctctctcccactcttccacctctccttgctcgttccggacaccctggcct

SEQ ID NO: 101349 - DNA, 352 bp, Homo sapiens
  misc_feature 1..352: note = chr9:96710044-96710396
  misc_feature 1..352: note = hyper
  source 1..352: mol_type = genomic DNA
aagttatgagtggcccgggggaccagaatagaggtagagagctgagccagagtcagcacctgctggcccctcggctgccattaccttcctgccccgcccagcggagcgaggagtcccagctcccttacctccctacagtggggttggggaggtggcatttgagaagttttccttcagctcggagatctggccccgggctgagctgggagggagggtgggggctgtaggtgggaccgctggggaacccagcctgaacagaggggacagaggttcccagcatcagctagtctcctccgtggacacaggaacccaaagtgggctcaggggatgtcctttgcgttccttctccggt

SEQ ID NO: 101350 - DNA, 783 bp, Homo sapiens; identical to SEQ ID NO: 32559
  misc_feature 1..783: note = chr9:96710664-96711447
  misc_feature 1..783: note = hyper
  source 1..783: mol_type = genomic DNA

SEQ ID NO: 101351 - DNA, 163 bp, Homo sapiens
  misc_feature 1..163: note = chr9:96711534-96711697
  misc_feature 1..163: note = hyper
  source 1..163: mol_type = genomic DNA
cgggcgccaggtagctccggtcgggcacgcgcagtccgacagactgtgtcaccttggaagacaggatgcggccctttacctagagtggcagctttgtgggctaggtcagcacggggtctccgggccggcgggcaatcgtctgcctctgcgccttagctccctg

SEQ ID NO: 101352 - DNA, 30 bp, Homo sapiens
  misc_feature 1..30: note = chr9:96711975-96712005
  misc_feature 1..30: note = hyper
  source 1..30: mol_type = genomic DNA
agttcccctctgtgccgggaggtggctgtt

SEQ ID NO: 101353 - DNA, 30 bp, Homo sapiens
  misc_feature 1..30: note = chr9:96712723-96712753
  misc_feature 1..30: note = hyper
  source 1..30: mol_type = genomic DNA
cccccgccacccccccgcccacccctcatt

SEQ ID NO: 101354 - DNA, 888 bp, Homo sapiens
  misc_feature 1..888: note = chr9:96713146-96714034
  misc_feature 1..888: note = hyper
  source 1..888: mol_type = genomic DNA
gcccagcctagactgcgggaaggcaactgagacctccatgagaagggggcacctgagagcacatgcaaccaagctgtgtccctgcaagggaccaccctccctaggccggtgtcagctgagtcctctctctccgtcggccaggtgccctcactgcccagaggtggaactcagcagcccaggcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggc

SEQ ID NO: 101355 - DNA, 112 bp, Homo sapiens
  misc_feature 1..112: note = chr9:96714862-96714974
  misc_feature 1..112: note = hyper
  source 1..112: mol_type = genomic DNA
aaactgagaggattccggtgcgtaccaggcaccgagggaatcggggggttgggcagagtctcagtggggagaaagaggagagcagctctgcatgcaccggggcatggcccag

SEQ ID NO: 101356 - DNA, 147 bp, Homo sapiens
  misc_feature 1..147: note = chr9:96715226-96715373
  misc_feature 1..147: note = hyper
  source 1..147: mol_type = genomic DNA
ccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcc

SEQ ID NO: 101357 - DNA, 14 bp, Homo sapiens
  misc_feature 1..14: note = chr9:96715687-96715701
  misc_feature 1..14: note = hyper
  source 1..14: mol_type = genomic DNA
gtgttctgtcctgg

SEQ ID NO: 101358 - DNA, 157 bp, Homo sapiens
  misc_feature 1..157: note = chr9:96716667-96716824
  misc_feature 1..157: note = hyper
  source 1..157: mol_type = genomic DNA
agcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcc

SEQ ID NO: 101359 - DNA, 524 bp, Homo sapiens; identical to SEQ ID NO: 3432
  misc_feature 1..524: note = chr9:96716904-96717428
  misc_feature 1..524: note = hyper
  source 1..524: mol_type = genomic DNA

SEQ ID NO: 101360 - DNA, 184 bp, Homo sapiens
  misc_feature 1..184: note = chr9:96717449-96717633
  misc_feature 1..184: note = hyper
  source 1..184: mol_type = genomic DNA
cgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccggga

SEQ ID NO: 101361 - DNA, 408 bp, Homo sapiens
  misc_feature 1..408: note = chr9:96717848-96718256
  misc_feature 1..408: note = hyper
  source 1..408: mol_type = genomic DNA
ctggaaggagagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctgggaaggaggtggtctcaagcagcctccagtcccgggctcaacaccgccaacccggcaag

SEQ ID NO: 101362 - DNA, 45 bp, Homo sapiens; identical to SEQ ID NO: 32566
  misc_feature 1..45: note = chr9:96720841-96720886
  misc_feature 1..45: note = hyper
  source 1..45: mol_type = genomic DNA

SEQ ID NO: 101363 - DNA, 366 bp, Homo sapiens; identical to SEQ ID NO: 857
  misc_feature 1..366: note = chr9:96721102-96721468
  misc_feature 1..366: note = hyper
  source 1..366: mol_type = genomic DNA

SEQ ID NO: 101364 - DNA, 353 bp, Homo sapiens
  misc_feature 1..353: note = chr9:96721688-96722041
  misc_feature 1..353: note = hyper
  source 1..353: mol_type = genomic DNA
gggaatggagctcgtttcctcttttcttttttcttcttcttcttttttttttttaaacctttggttctgattgtccttggcccagcaggctgttggtggcgttggtggtgctgctgggactggggcaccggccttggccgcaggtgtgctgtgcccgacagaggccgcctggaccgcgcccggaacgccctgtccgggtgggctgcggcgttcgccctgcttttgccccgagccgagactggcaacatcttttctagcttcaaaacagaaaattttggaattataaaattaccccctccccacgcttacaggtcattatctcctggagaccaccaactcgctttctctttgga

SEQ ID NO: 101365 - DNA, 298 bp, Homo sapiens
  misc_feature 1..298: note = chr9:96722862-96723160
  misc_feature 1..298: note = hyper
  source 1..298: mol_type = genomic DNA
ggcgagtgtggacccttcgagaatgctcccttggcccaggactgatccccacgagcatacagcttcggccttccgaggagagtcagggtcggtgcggaccgactccgcaggccctcccttgccccatctgggctggtgccaggccgcagctcgagacctggtttccaccccgggctcccacagagcccatgaagcgctggtcacagcccctggaagctgcagacccggcttttcgaggagcctccccgacgtgcagagcctgagaccccagagagcggccggctcgtgcgggccagaa

SEQ ID NO: 101366 - DNA, 181 bp, Homo sapiens
  misc_feature 1..181: note = chr9:96723170-96723351
  misc_feature 1..181: note = hyper
  source 1..181: mol_type = genomic DNA
cgcccgcggaaacgactcggcttttctttcttttccccttttctttctttatttgcttttttttttcctctcttcccttcttccacccatttccccctcctctttcttttgtttttttttagtcctccccccacccctcttctttcttttgttgctcgttcactctcgctcttgtctcctc

SEQ ID NO: 101367 - DNA, 59 bp, Homo sapiens; identical to SEQ ID NO: 32341
  misc_feature 1..59: note = chr9:969556-969615
  misc_feature 1..59: note = hyper
  source 1..59: mol_type = genomic DNA

SEQ ID NO: 101368 - DNA, 438 bp, Homo sapiens; identical to SEQ ID NO: 32342
  misc_feature 1..438: note = chr9:969667-970105
  misc_feature 1..438: note = hyper
  source 1..438: mol_type = genomic DNA

SEQ ID NO: 101369 - DNA, 727 bp, Homo sapiens
  misc_feature 1..727: note = chr9:970185-970912
  misc_feature 1..727: note = hyper
  source 1..727: mol_type = genomic DNA
cggggcccgggacctgcgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacct

SEQ ID NO: 101370 - DNA, 202 bp, Homo sapiens
  misc_feature 1..202: note = chr9:970992-971194
  misc_feature 1..202: note = hyper
  source 1..202: mol_type = genomic DNA
cgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaatcccaacaccttggg

SEQ ID NO: 101371 - DNA, 317 bp, Homo sapiens
  misc_feature 1..317: note = chr9:971852-972169
  misc_feature 1..317: note = hyper
  source 1..317: mol_type = genomic DNA
tacccctcccccacccgcctgccctcgggagcgggtcgcctccactccaccacctgtttaagttcctccccctcggcgcccctccagtccccaccccggccccggtccaaaaaaccagcaaacggaacttttccacagttgaaagccgcggcccgcgaggccgggctgggaggggaaagcggggcgtgtctggggggcggggccccgagcactccggaagttgccccgcccaggaggctcctgggaaagtgaggagagggcccgggcctactttcgtcctggtgtggcgcccctcagcctcccctcctcccagttcc

SEQ ID NO: 101372 - DNA, 170 bp, Homo sapiens
  misc_feature 1..170: note = chr9:9719642-9719812
  misc_feature 1..170: note = hypo
  source 1..170: mol_type = genomic DNA
atccccctcacagctcgctatgctgcggcggtgaggggagaagggctgtaaaccttctgggatccccgacctcagggctccccatgtcagggctgtgtcattcggtaacaccctctttggggttctgcggtttctggcatctctacgctttcaggcgcactgcattcccc

SEQ ID NO: 101373 - DNA, 832 bp, Homo sapiens
  misc_feature 1..832: note = chr9:972189-973021
  misc_feature 1..832: note = hyper
  source 1..832: mol_type = genomic DNA
cggcctggcctccaggcaaagttcgcgccccctgttcctggggtgtcggccgcgcgggccgtttcccttcattactcccgggcccctgaatccgaacgctttcccagaagcgcgcaaatccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 101374 - DNA, 30 bp, Homo sapiens
  misc_feature 1..30: note = chr9:97315453-97315483
  misc_feature 1..30: note = hypo
  source 1..30: mol_type = genomic DNA
atcacttggcccccacgggtgccctcctac

SEQ ID NO: 101375 - DNA, 341 bp, Homo sapiens
  misc_feature 1..341: note = chr9:97317331-97317672
  misc_feature 1..341: note = hypo
  source 1..341: mol_type = genomic DNA
atgcagtctaggaaccggcatgcgcataacctcaggatataaataatgctgaagcagagttacgttttttttgttgttgttttttttgtttttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagaggtgggtaaagagtgtggttagtgccaaagggaaaaaaggatagcg

SEQ ID NO: 101376 - DNA, 106 bp, Homo sapiens; identical to SEQ ID NO: 32348
  misc_feature 1..106: note = chr9:973183-973289
  misc_feature 1..106: note = hyper
  source 1..106: mol_type = genomic DNA

SEQ ID NO: 101377 - DNA, 30 bp, Homo sapiens
  misc_feature 1..30: note = chr9:97369352-97369382
  misc_feature 1..30: note = hypo
  source 1..30: mol_type = genomic DNA
ctcatcttggggccccgagacacctgccag

SEQ ID NO: 101378 - DNA, 43 bp, Homo sapiens; identical to SEQ ID NO: 32349
  misc_feature 1..43: note = chr9:973762-973805
  misc_feature 1..43: note = hyper
  source 1..43: mol_type = genomic DNA

SEQ ID NO: 101379 - DNA, 88 bp, Homo sapiens
  misc_feature 1..88: note = chr9:97401378-97401466
  misc_feature 1..88: note = hyper
  source 1..88: mol_type = genomic DNA
ggcagacagacaggacggggcccaccgcccaaggcccgactcacaggtgcgcgatgcccgccttgcgcaccgccgaagagatggcttt

SEQ ID NO: 101380 - DNA, 386 bp, Homo sapiens
  misc_feature 1..386: note = chr9:97401694-97402080
  misc_feature 1..386: note = hyper
  source 1..386: mol_type = genomic DNA
agctgcaggtgcgggcggcaggtgcgggccgcgggacctggcgggaggactgacagaccgactgccgccccgagtgtccgcagcgctcgtggtgcaactgggccaggccaggcgccggcgggtgaatcgcggaaacctttagacgcgggtcggccccccgcccccgggaacactcttgcgccccgcctaccccgcggaccagaccgcggctccgcctgcttggatcttcagacaaggtcggggatcctccctgcggtctcccaacccccgcccccacgcgccctgccgccccctagtcttcctgggctgtcgccccccacacacacccctccgtgccctccacccgcactgtggagcgggactcgggccatcggactctgccagag

SEQ ID NO: 101381 - DNA, 1357 bp, Homo sapiens
  misc_feature 1..1357: note = chr9:975333-976690
  misc_feature 1..1357: note = hyper
  source 1..1357: mol_type = genomic DNA
cagcggacttgcctacgctctcatctagcatttgattccccaccaggagatgggcttggtgcacgctctcagaagcgcatccaccgaaggctctggaactgccccgcttcgcatagagctattgtgctgccctgcagtgtatccacttgttttgtttgtttgtttgttttttggtttttgcttgtttgctgatgggcagtggggaggtgcgagggtggagggccttctttgtgcatatatagcgatagtctgcactaggccaagcccgctactcctgggagaatgggaacacgcaaataatctaaacaaagttttctgctgtcatcttgtgaaggaccctctcccccaagacatctatgactggggtctatgggttaaggaggtgaaaaagtggccccatcccatatccataactgaatcacagaatccgtggggatttgaactgagtggctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 101382 - DNA, 30 bp, Homo sapiens
  misc_feature 1..30: note = chr9:97674944-97674974
  misc_feature 1..30: note = hypo
  source 1..30: mol_type = genomic DNA
aaagagtaggaatctcggctatgggctccc

SEQ ID NO: 101383 - DNA, 139 bp, Homo sapiens
  misc_feature 1..139: note = chr9:97679482-97679621
  misc_feature 1..139: note = hypo
  source 1..139: mol_type = genomic DNA
cagaagggatgtatccgctgctctgctggtcagtagctgagccttctgtatggtctgcagagctgccactgagccagaggtggtctctgtgtttcctagactcaaggtggtctccatgttttgtcgttgccatgctgtt

SEQ ID NO: 101384 - DNA, 30 bp, Homo sapiens
  misc_feature 1..30: note = chr9:97681851-97681881
  misc_feature 1..30: note = hypo
  source 1..30: mol_type = genomic DNA
caggggctgagagttcggcttgtaaatgtg

SEQ ID NO: 101385 - DNA, 90 bp, Homo sapiens
  misc_feature 1..90: note = chr9:97682129-97682219
  misc_feature 1..90: note = hypo
  source 1..90: mol_type = genomic DNA
ggttcccccctctctcgggtcttcctttgtctctatcatgggatattgggctgcacatgttgaaattgtgaaaagcgttgaatccataag

SEQ ID NO: 101386 - DNA, 176 bp, Homo sapiens
  misc_feature 1..176: note = chr9:97688199-97688375
  misc_feature 1..176: note = hypo
  source 1..176: mol_type = genomic DNA
gcacagtgcctgacacgtggagaatgtacaagaaatacctgttcccttcctctttgtgtttccctccgtcttacacacaggcattcagcaggggtttaatatgaacgtgcctctatcaccatctcttccctggagtgcctcccttctgagactctcagattcgcgctggtcctggc

SEQ ID NO: 101387 - DNA, 50 bp, Homo sapiens
  misc_feature 1..50: note = chr9:976911-976961
  misc_feature 1..50: note = hyper
  source 1..50: mol_type = genomic DNA
cgcccctgagcgggcctcgcagccccgccgtccagcgctccctggccctc

SEQ ID NO: 101388 - DNA, 432 bp, Homo sapiens
  misc_feature 1..432: note = chr9:977171-977603
  misc_feature 1..432: note = hyper
  source 1..432: mol_type = genomic DNA
gtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcctactctccgccaggccggggct

SEQ ID NO: 101389 - DNA, 200 bp, Homo sapiens
  misc_feature 1..200: note = chr9:97807628-97807828
  misc_feature 1..200: note = hypo
  source 1..200: mol_type = genomic DNA
cacccggcgggcctccgctgcgtccactgcggacaggggtcggtgagaggccccaggtccagcgcgacttgcttttgttaaaacctccttgtgttaggtgtgctcccagctttggagccaggcttttggacacgcctgagtttttctaaagccttcttgttccggtcttcccgcaccttccagtgcggtcaaggatgctg

SEQ ID NO: 101390 - DNA, 30 bp, Homo sapiens; identical to SEQ ID NO: 42166
  misc_feature 1..30: note = chr9:97863868-97863898
  misc_feature 1..30: note = hypo
  source 1..30: mol_type = genomic DNA

SEQ ID NO: 101391 - DNA, 171 bp, Homo sapiens
  misc_feature 1..171: note = chr9:97864916-97865087
  misc_feature 1..171: note = hypo
  source 1..171: mol_type = genomic DNA
ctggaagggttgggccgttctgggagggtgaacaactgccttggttttcccaggactattctggttttactgcctcaggtccgacagcccaggacacccttcagaactgggccttccacctcctgaccaccactaaagggagcctcttgtcgcatgcgcactgtgtgaatg

SEQ ID NO: 101392 - DNA, 30 bp, Homo sapiens
  misc_feature 1..30: note = chr9:97867526-97867556
  misc_feature 1..30: note = hypo
  source 1..30: mol_type = genomic DNA
aggtgggtcatgttacggggactttctgta

SEQ ID NO: 101393 - DNA, 30 bp, Homo sapiens
  misc_feature 1..30: note = chr9:97887305-97887335
  misc_feature 1..30: note = hypo
  source 1..30: mol_type = genomic DNA
aaatactctcaacagcgtcttattctctgg

SEQ ID NO: 101394 - DNA, 62 bp, Homo sapiens
  misc_feature 1..62: note = chr9:97887619-97887681
  misc_feature 1..62: note = hypo
  source 1..62: mol_type = genomic DNA
acaggataaatttgtcgctccctgttatattttctttaaaattgcaacgtgcagagctctct

SEQ ID NO: 101395 - DNA, 30 bp, Homo sapiens
  misc_feature 1..30: note = chr9:97891726-97891756
  misc_feature 1..30: note = hypo
  source 1..30: mol_type = genomic DNA
cttcatgagtgatgacgcaggcatctaacc

SEQ ID NO: 101396 - DNA, 44 bp, Homo sapiens
  misc_feature 1..44: note = chr9:98076575-98076619
  misc_feature 1..44: note = hypo
  source 1..44: mol_type = genomic DNA
attttaaaaataattcggctgctctacctgtggagtagccattc

SEQ ID NO: 101397 - DNA, 212 bp, Homo sapiens; identical to SEQ ID NO: 859
  misc_feature 1..212: note = chr9:98111349-98111561
  misc_feature 1..212: note = hyper
  source 1..212: mol_type = genomic DNA

SEQ ID NO: 101398 - DNA, 264 bp, Homo sapiens; identical to SEQ ID NO: 860
  misc_feature 1..264: note = chr9:98111894-98112158
  misc_feature 1..264: note = hyper
  source 1..264: mol_type = genomic DNA

SEQ ID NO: 101399 - DNA, 52 bp, Homo sapiens; identical to SEQ ID NO: 861
  misc_feature 1..52: note = chr9:98112343-98112395
  misc_feature 1..52: note = hyper
  source 1..52: mol_type = genomic DNA

SEQ ID NO: 101400 - DNA, 287 bp, Homo sapiens
  misc_feature 1..287: note = chr9:981609-981896
  misc_feature 1..287: note = hyper
  source 1..287: mol_type = genomic DNA
agctcttggcctggccggtttgcacgcagtgcagttgctgtgtgtgtgttgcggagggttgcggcagctggcccaggactgggaccctggccacagcgggttcaaagtaggggcaaagatagggggcagcggctccttgcggccgcaatggactgccgtctccttgcaccagggggtcggagctgcagctgagcccagcttctcgccgcctgctggggacggctctttccttggtcactgtcaggaagcagctcactaggcagctcaggaaccgcccagagacagcc

SEQ ID NO: 101401 - DNA, 25 bp, Homo sapiens
  misc_feature 1..25: note = chr9:98196381-98196406
  misc_feature 1..25: note = hypo
  source 1..25: mol_type = genomic DNA
ccaccgcgcccggcctatgggctcc

SEQ ID NO: 101402 - DNA, 393 bp, Homo sapiens
  misc_feature 1..393: note = chr9:98277959-98278352
  misc_feature 1..393: note = hyper
  source 1..393: mol_type = genomic DNA
aagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttccatcaccagctctgcctccgctggcgagtcagtagccac

SEQ ID NO: 101403 - DNA, 53 bp, Homo sapiens
  misc_feature 1..53: note = chr9:98278666-98278719
  misc_feature 1..53: note = hyper
  source 1..53: mol_type = genomic DNA
gcgtccccgtgtccccgcgccgcccgaggagcacggcgcgcgaggcgaggtgg

SEQ ID NO: 101404 - DNA, 30 bp, Homo sapiens
  misc_feature 1..30: note = chr9:98279806-98279836
  misc_feature 1..30: note = hyper
  source 1..30: mol_type = genomic DNA
tggtccgaagaatcacggattgacatttgc

SEQ ID NO: 101405 - DNA, 30 bp, Homo sapiens
  misc_feature 1..30: note = chr9:98315417-98315447
  misc_feature 1..30: note = hyper
  source 1..30: mol_type = genomic DNA
gagccaggagggtggcgtccaggggcagtg

SEQ ID NO: 101406 - DNA, 30 bp, Homo sapiens; identical to SEQ ID NO: 32577
  misc_feature 1..30: note = chr9:98315763-98315793
  misc_feature 1..30: note = hyper
  source 1..30: mol_type = genomic DNA

SEQ ID NO: 101407 - DNA, 405 bp, Homo sapiens
  misc_feature 1..405: note = chr9:98783120-98783525
  misc_feature 1..405: note = hyper
  source 1..405: mol_type = genomic DNA
ccagagcagcagcaacgtgggctgtttggtgcggaggttcctggtttgggttggccaggcgtagagtgcttccgacaattcacccaccctccaagacgcgcgggccggggagcggggagagggcggagggaacggcgcaccgggccccgtcggactgttggaccaaaagtcctcagtgtcgggggctcgcagcgccgccgcggcgaacccagctagggggcaccgcctgcgccgggcacagggaggccgttcggctttccccctcgcgcccattactctcaggcgtcccggggaaccccgcgggccaagtgtcgggctgcgtccgggcagaggcggcttcgcctggtgtcagcgcgtttccgaagggcacccgcggcggggcccacaactcgagctgggagccgc

SEQ ID NO: 101408 - DNA, 563 bp, Homo sapiens
  misc_feature 1..563: note = chr9:98783773-98784336
  misc_feature 1..563: note = hyper
  source 1..563: mol_type = genomic DNA
gcggcctgggggacacggggcaaattctcggatagcgacgggcaggaaggggacccgggctggcgatgggccgagtgcctcctttgctctcacccccgcgcgaagacgaggccagtgggcgggtggcgtggggcgaggcctccgcaggccgccgggggcccaggcacctggagccgggagggtccgctcccttccccgccctggatggcggcctatgggaaagcagtctccactggatcccgcgcgcgtcgcgccgaggtcgtgggaaaccgagggcgggagggcgggagggcggaggcgccggcagggtcggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctcc

SEQ ID NO: 101409 - DNA, 40 bp, Homo sapiens; identical to SEQ ID NO: 32580
  misc_feature 1..40: note = chr9:98784337-98784377
  misc_feature 1..40: note = hyper
  source 1..40: mol_type = genomic DNA

SEQ ID NO: 101410 - DNA, 155 bp, Homo sapiens
  misc_feature 1..155: note = chr9:98784772-98784927
  misc_feature 1..155: note = hyper
  source 1..155: mol_type = genomic DNA
gcacagaggggcactcggcttgtaagcaacggagtaattcagagcccgtcagccccacgccgagtttattcaccctggcaggggcttccgcgggagccatgacccttcctaactggggtggaaggacccgcagcgccagccgggtccgggccaga

SEQ ID NO: 101411 - DNA, 466 bp, Homo sapiens
  misc_feature 1..466: note = chr9:98789547-98790013
  misc_feature 1..466: note = hyper
  source 1..466: mol_type = genomic DNA
gtgtgctctagttcccggcaaagcaggtgggagacggagtgaccggcaggacaggctgcctggggaaccgggaaggctgaagtggacacaggaggagctggcagggagagcccaggccccgcgggctgcgggaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 101412 - DNA, 15 bp, Homo sapiens
  misc_feature 1..15: note = chr9:98790083-98790098
  misc_feature 1..15: note = hyper
  source 1..15: mol_type = genomic DNA
cgactcctcagcctt

SEQ ID NO: 101413 - DNA, 20 bp, Homo sapiens
  misc_feature 1..20: note = chr9:98793021-98793041
  misc_feature 1..20: note = hypo
  source 1..20: mol_type = genomic DNA
aggtacgtggctccagcgac

SEQ ID NO: 101414 - DNA, 30 bp, Homo sapiens
  misc_feature 1..30: note = chr9:99189069-99189099
  misc_feature 1..30: note = hypo
  source 1..30: mol_type = genomic DNA
gggtcatagagcagccgtgggtttaacatt

SEQ ID NO: 101415 - DNA, 84 bp, Homo sapiens
  misc_feature 1..84: note = chr9:99380993-99381077
  misc_feature 1..84: note = hyper
  source 1..84: mol_type = genomic DNA
agggtcccaaggctacggagcagcgggggtttggccaacgccaaaaaggggcagctcccgtgccaggcgcgttcagcgcgctcg

SEQ ID NO: 101416 - DNA, 177 bp, Homo sapiens
  misc_feature 1..177: note = chr9:99381503-99381680
  misc_feature 1..177: note = hyper
  source 1..177: mol_type = genomic DNA
tgatgtccaggtacacgtcgtcctgggggtcccggcggcgcgggtcttgctgcgtggagctgcggatcttcttcacacccggcgaggtcgacgagcagcgccgcgagcaggggggcgcggcggcccagctcgaccgccgctcgcttttccgcttcatggaggcggccgcggcccgtc

SEQ ID NO: 101417 - DNA, 303 bp, Homo sapiens
  misc_feature 1..303: note = chr9:99449095-99449398
  misc_feature 1..303: note = hyper
  source 1..303: mol_type = genomic DNA
gaggagccccagcaccgtgcctcgacctcaccggattctggtcctcactgccgcccgggcctttccgcttcttcaccaaggcggacaggctgacgcactaccacgccgcgcgacagcgaccgcgcgcaaagcgccaggaaccccccctactgcccgccccgcgctggcgaagcgcgacccgtcccgccccgccccgccctcggcacagcgtcagaggcggggacgcgcgctggtctatttttgggcatccggatggcgactgcgggaaatcgagttctcatgctggggcgaaaggtgtgtctg

SEQ ID NO: 101418 - DNA, 179 bp, Homo sapiens
  misc_feature 1..179: note = chr9:99487982-99488161
  misc_feature 1..179: note = hypo
  source 1..179: mol_type = genomic DNA
gtggaagctcattcacggcaaattcacatgttttggatgactcagattttctctttctcactctaaattctcctgtggagtcagccagccatcctattccagctaaatcagctgatcttggtcaccaccccatccccagggatgggcggagggggtggcggcagcgacagcaggggagg

SEQ ID NO: 101419 - DNA, 41 bp, Homo sapiens
  misc_feature 1..41: note = chr9:99539965-99540006
  misc_feature 1..41: note = hyper
  source 1..41: mol_type = genomic DNA
ctcaccgcagacccacgggctgtacgcgctttgtggcaggt

SEQ ID NO: 101420 - DNA, 518 bp, Homo sapiens
  misc_feature 1..518: note = chr9:99639574-99640092
  misc_feature 1..518: note = hyper
  source 1..518: mol_type = genomic DNA
aactttcctgggggccgcgggcgaaggaacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctcttcatcagacggaattttccgtctgtgcaaaaatgaagcttactcggtatcatgtgtgc

SEQ ID NO: 101421 - DNA, 19 bp, Homo sapiens
  misc_feature 1..19: note = chr9:9980357-9980376
  misc_feature 1..19: note = hypo
  source 1..19: mol_type = genomic DNA
caggaattgggaggccgag

SEQ ID NO: 101422 - DNA, 564 bp, Homo sapiens
  misc_feature 1..564: note = chr9:99983140-99983704
  misc_feature 1..564: note = hyper
  source 1..564: mol_type = genomic DNA
aaattatccaccaagcgctacaggcgggaaattgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgat

SEQ ID NO: 101423 - DNA, 240 bp, Homo sapiens
  misc_feature 1..240: note = chr9:99983764-99984004
  misc_feature 1..240: note = hyper
  source 1..240: mol_type = genomic DNA
cctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatccc

SEQ ID NO: 101424 - DNA, 46 bp, Homo sapiens
  misc_feature 1..46: note = chrX:103087251-103087297
  misc_feature 1..46: note = hyper
  source 1..46: mol_type = genomic DNA
tcggcggtggggacccggtgtagccgcctcccgccctccatgtggc

SEQ ID NO: 101425 - DNA, 199 bp, Homo sapiens
  misc_feature 1..199: note = chrX:108803671-108803870
  misc_feature 1..199: note = hypo
  source 1..199: mol_type = genomic DNA
catcatccaatccatcgagggtccagagagaacaaacaagtggagtaagggaaaattcactctatcttcttctgctggaagatccatcttctcctgcccttggacatcggagcttctggttctcaggactttggattcagcctgagtcacaccaccgtctctcctgttcctccagcttgcagatggcagatcatggaac

SEQ ID NO: 101426 - DNA, 30 bp, Homo sapiens; identical to SEQ ID NO: 46885
  misc_feature 1..30: note = chrX:11773720-11773750
  misc_feature 1..30: note = hypo
  source 1..30: mol_type = genomic DNA

SEQ ID NO: 101427 - DNA, 36 bp, Homo sapiens
  misc_feature 1..36: note = chrX:12157151-12157187
  misc_feature 1..36: note = hyper
  source 1..36: mol_type = genomic DNA
gtttgcacccagggccgctgccgcgggcaacttggt

SEQ ID NO: 101428 - DNA, 164 bp, Homo sapiens
  misc_feature 1..164: note = chrX:122924437-122924601
  misc_feature 1..164: note = hypo
  source 1..164: mol_type = genomic DNA
ggtgtgagtcaccgcacctggccaagatttttgtttaaattctaaatagtaaccgtttgctttagggcttactcagttgctttttgctactcaagccatggaagagcagacaggaggctgttcagaaaaaaatgtatactaaaggatgacgttggctttttgtt

SEQ ID NO: 101429 - DNA, 30 bp, Homo sapiens
  misc_feature 1..30: note = chrX:12734830-12734860
  misc_feature 1..30: note = hypo
  source 1..30: mol_type = genomic DNA
ggacgaggtgagctgcgaggaggacctcgt

SEQ ID NO: 101430 - DNA, 80 bp, Homo sapiens
  misc_feature 1..80: note = chrX:136134699-136134779
  misc_feature 1..80: note = hyper
  source 1..80: mol_type = genomic DNA
ggcgaaggcaaactgcgcgcacggcgccctctagtgcccaggagctgtcactgcgcgggtgcccgcggccccagctctcc

SEQ ID NO: 101431 - DNA, 181 bp, Homo sapiens
  misc_feature 1..181: note = chrX:13707253-13707434
  misc_feature 1..181: note = hyper
  source 1..181: mol_type = genomic DNA
tccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgaggtgagcgggactcgggactccttcggg

SEQ ID NO: 101432 - DNA, 30 bp, Homo sapiens
  misc_feature 1..30: note = chrX:13740786-13740816
  misc_feature 1..30: note = hypo
  source 1..30: mol_type = genomic DNA
cacgctaggattctgcgctgtccaatctat

SEQ ID NO: 101433 - DNA, 1260 bp, Homo sapiens
  misc_feature 1..1260: note = chrX:13955858-13957118
  misc_feature 1..1260: note = hyper
  source 1..1260: mol_type = genomic DNA
aaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgagg

SEQ ID NO: 101434 - DNA, 94 bp, Homo sapiens
  misc_feature 1..94: note = chrX:139804733-139804827
  misc_feature 1..94: note = hypo
  source 1..94: mol_type = genomic DNA
tacataaatatcacccggattccctccacaacatgaaatctaaccccatgaaacccatgatagtccacaaaaccagacacgccttatatcaccc

SEQ ID NO: 101435 - DNA, 151 bp, Homo sapiens
  misc_feature 1..151: note = chrX:14048060-14048211
  misc_feature 1..151: note = hyper
  source 1..151: mol_type = genomic DNA
agtccccccctgtgtcgcggacgtcacgttcgcaccgcaggcggtgcagtgctggaggccggaagctgcctgctaatcggctaccccgagtggagcgccggggcggcaggcgtgggatggctgcgggtggcggggccggcggagagggagc

SEQ ID NO: 101436 - DNA, 30 bp, Homo sapiens
  misc_feature 1..30: note = chrX:150560243-150560273
  misc_feature 1..30: note = hypo
  source 1..30: mol_type = genomic DNA
ctgctgggtgcaaggcgctcagtctgcagc

SEQ ID NO: 101437 - DNA, 30 bp, Homo sapiens
  misc_feature 1..30: note = chrX:150732700-150732730
  misc_feature 1..30: note = hypo
  source 1..30: mol_type = genomic DNA
acgccaggctctgtccggcaggtctggggc

SEQ ID NO: 101438 - DNA, 30 bp, Homo sapiens
  misc_feature 1..30: note = chrX:151080838-151080868
  misc_feature 1..30: note = hypo
  source 1..30: mol_type = genomic DNA
aaccccaggacctctcgcctcctcccccac

SEQ ID NO: 101439 - DNA, 30 bp, Homo sapiens
  misc_feature 1..30: note = chrX:151088584-151088614
  misc_feature 1..30: note = hypo
  source 1..30: mol_type = genomic DNA
ccatccaggttgaatcgcattccgtttctg

SEQ ID NO: 101440 - DNA, 102 bp, Homo sapiens
  misc_feature 1..102: note = chrX:15511442-15511544
  misc_feature 1..102: note = hyper
  source 1..102: mol_type = genomic DNA
gcggcctagaggaggcgggaggcgggagtctacgggtctcggaggccctggggctccgccctcgggaatgtcactccactctcgctccgccctacgcctctc

SEQ ID NO: 101441 - DNA, 262 bp, Homo sapiens
  misc_feature 1..262: note = chrX:15756104-15756366
  misc_feature 1..262: note = hyper
  source 1..262: mol_type = genomic DNA
agcagggctcagaggcgtggcccaggctagagggaagagcccagggggagcgcagaggcggggctaggagggagcaggggtgaatgggggcgtggcccgggcgagaggggcgtggctgtagctaaaggggtgtggccagggtggagggcagagactggcacagtttggttgggcgtgaccggggcaataagtacggacgtagtggggcgtggatctgccaggtgggggcgtggcctccattgaggggcgtggccctggtatg

SEQ ID NO: 101442 - DNA, 30 bp, Homo sapiens
  misc_feature 1..30: note = chrX:16702919-16702949
  misc_feature 1..30: note = hypo
  source 1..30: mol_type = genomic DNA
atgcaggtaacgggccgggcgtggtgactc

SEQ ID NO: 101443 - DNA, 230 bp, Homo sapiens
  misc_feature 1..230: note = chrX:16729910-16730140
  misc_feature 1..230: note = hyper
  source 1..230: mol_type = genomic DNA
attctgtagcagcagcgtagttcggcactatgcgccctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtg

SEQ ID NO: 101444 - DNA, 476 bp, Homo sapiens
  misc_feature 1..476: note = chrX:16730152-16730628
  misc_feature 1..476: note = hyper
  source 1..476: mol_type = genomic DNA
cgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagccggcgccatcagagagcggacaaaggagcccggccccacaagtgcaccggggctgggggtgcagggcggagaggccctggggacgagggatggcccgggcgccgaggccctgggggtctgggacaggcccagaagggaagttacctgcgcggtggtggtagcaccggggagggtggccggtgggcacggcgggctccaccccgcggctggcctggcgctcacctgtcgggctggggaaggggtcgctgccggggctgtccaaagccgcccccgggatcttcccaccgcccacacgggcctcggggtgcgcggcgc

SEQ ID NO: 101445 - DNA, 50 bp, Homo sapiens
  misc_feature 1..50: note = chrX:16730852-16730902
  misc_feature 1..50: note = hyper
  source 1..50: mol_type = genomic DNA
ggcacttcgagtgcgcgggtgaactccacgcttcccggggaaccccggct

SEQ ID NO: 101446 - DNA, 395 bp, Homo sapiens
  misc_feature 1..395: note = chrX:16887830-16888225
  misc_feature 1..395: note = hyper
  source 1..395: mol_type = genomic DNA
gcgtagaaagagccgcggcgctcgcttcccagcggcgggggccgcctccgccccggggccgagggcgccggagggagcgcagccgctggaggagggaagggaagaggggggcccagccctcggccccgcgcccggctccggaagtgctcggagccctcggcgcggcggtcccgtcccgcgcaggcccctcgaggcgcgcgcccagtctcgcgcccggccccgccccctgctccgcacgccaattcgcgcctttcgccggcgcgtgccgcggcctcgcgcgcccgccgccccccgcggccccggcgcgcgccgccccgcagggcctcttactctctttactcgccatcttgcgtcgggtcgttcgcccctcgccgccgcctcggactcctctcgtt

SEQ ID NO: 101447 - DNA, 112 bp, Homo sapiens
  misc_feature 1..112: note = chrX:16888552-16888664
  misc_feature 1..112: note = hyper
  source 1..112: mol_type = genomic DNA
gcgggtttcacgcggcgttcggaggcgggcttctgggggtgggcggagcgtgccgcggcaggaagttggcgatgcgcaggcgcgagggctcgcccggcgctcccagggccgg

SEQ ID NO: 101448 - DNA, 30 bp, Homo sapiens
  misc_feature 1..30: note = chrX:19353762-19353792
  misc_feature 1..30: note = hypo
  source 1..30: mol_type = genomic DNA
tgcagaaagcaaaaccgtggataaagggga

SEQ ID NO: 101449 - DNA, 20 bp, Homo sapiens
  misc_feature 1..20: note = chrX:19435187-19435207
  misc_feature 1..20: note = hypo
  source 1..20: mol_type = genomic DNA
caagatggctgaatacgaac

SEQ ID NO: 101450 - DNA, 35 bp, Homo sapiens
  misc_feature 1..35: note = chrX:20160936-20160971
  misc_feature 1..35: note = hypo
  source 1..35: mol_type = genomic DNA
agtcctttcactcgcccagccgggttgggagcctg

SEQ ID NO: 101451 - DNA, 42 bp, Homo sapiens
  misc_feature 1..42: note = chrX:22973409-22973451
  misc_feature 1..42: note = hypo
  source 1..42: mol_type = genomic DNA
aaggataatagttttcggccgggagcggtggctcatgcctgt

SEQ ID NO: 101452 - DNA, 39 bp, Homo sapiens
  misc_feature 1..39: note = chrX:23217730-23217769
  misc_feature 1..39: note = hypo
  source 1..39: mol_type = genomic DNA
aaaaacaaagaataaaaaataaagcgtctgacacttaag

SEQ ID NO: 101453 - DNA, 35 bp, Homo sapiens
  misc_feature 1..35: note = chrX:23714117-23714152
  misc_feature 1..35: note = hypo
  source 1..35: mol_type = genomic DNA
cacaactcagctgggcgcggtagctcacacctgta

SEQ ID NO: 101454 - DNA, 22 bp, Homo sapiens
  misc_feature 1..22: note = chrX:23825274-23825296
  misc_feature 1..22: note = hypo
  source 1..22: mol_type = genomic DNA
gcaagaccgtctcctcccaaaa

SEQ ID NO: 101455 - DNA, 30 bp, Homo sapiens
  misc_feature 1..30: note = chrX:24074681-24074711
  misc_feature 1..30: note = hypo
  source 1..30: mol_type = genomic DNA
atataaagttctggccgggtgcagtggctt

SEQ ID NO: 101456 - DNA, 100 bp, Homo sapiens
  misc_feature 1..100: note = chrX:25039052-25039152
  misc_feature 1..100: note = hyper
  source 1..100: mol_type = genomic DNA
tgtcaattcccaggccgcgcggaccggagctgggctgtcggcgtccgcacccccagcctccccacctcagcccccttttcgggctcggctcagcgccacg

SEQ ID NO: 101457 - DNA, 173 bp, Homo sapiens
  misc_feature 1..173: note = chrX:26179543-26179716
  misc_feature 1..173: note = hypo
  source 1..173: mol_type = genomic DNA
tgagtggtgataatgcgctgccgaagtcgggtctcctgatgtcgatcctgggtttgatcttcatgagaggcaaccgtgccactgaagaggaggtctggaagttcctgggtctgttggggatatatgatgggatcctgcattcaatctatggggatgctcggaagatcattact

SEQ ID NO: 101458 - DNA, 147 bp, Homo sapiens
  misc_feature 1..147: note = chrX:2742585-2742732
  misc_feature 1..147: note = hypo
  source 1..147: mol_type = genomic DNA
tctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcc

SEQ ID NO: 101459 - DNA, 83 bp, Homo sapiens
  misc_feature 1..83: note = chrX:2746913-2746996
  misc_feature 1..83: note = hyper
  source 1..83: mol_type = genomic DNA
gggggctggcggaggcggggccgggcttccggacagaggccaatcgctgccctcggggcctccagcgccggctctgggccgag

SEQ ID NO: 101460 - DNA, 235 bp, Homo sapiens
  misc_feature 1..235: note = chrX:2747708-2747943
  misc_feature 1..235: note = hyper
  source 1..235: mol_type = genomic DNA
gtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctgga

SEQ ID NO: 101461 - DNA, 100 bp, Homo sapiens
  misc_feature 1..100: note = chrX:2825711-2825811
  misc_feature 1..100: note = hypo
  source 1..100: mol_type = genomic DNA
ccacgcaggtgtgaacgcagaacgcaggtgtcggccctgtggtatcagcatgaacctccctattcagtgaaaaggaggagggacacgaggcagtccacac

SEQ ID NO: 101462 - DNA, 30 bp, Homo sapiens
  misc_feature 1..30: note = chrX:2835934-2835964
  misc_feature 1..30: note = hypo
  source 1..30: mol_type = genomic DNA
aggatacagttccagcgtcgcacaaacccg

SEQ ID NO: 101463 - DNA, 148 bp, Homo sapiens
  misc_feature 1..148: note = chrX:2836217-2836365
  misc_feature 1..148: note = hypo
  source 1..148: mol_type = genomic DNA
ggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaa

SEQ ID NO: 101464 - DNA, 158 bp, Homo sapiens; identical to SEQ ID NO: 38629
  misc_feature 1..158: note = chrX:2846239-2846397
  misc_feature 1..158: note = hyper
  source 1..158: mol_type = genomic DNA

SEQ ID NO: 101465 - DNA, 49 bp, Homo sapiens
  misc_feature 1..49: note = chrX:2846807-2846856
  misc_feature 1..49: note = hyper
  source 1..49: mol_type = genomic DNA
cttagtggggcagagcggggggcgcggttcggggcgggtcttagggagc

SEQ ID NO: 101466 - DNA, 121 bp, Homo sapiens
  misc_feature 1..121: note = chrX:2847075-2847196
  misc_feature 1..121: note = hyper
  source 1..121: mol_type = genomic DNA
ggctctgctgtctggcgtctttcccgggcacagaacgcgcctccagctacattttggagactacaaggcgccggacacaaccacgccctttacaggggcccaggctcgcccggggcgcccc

SEQ ID NO: 101467 - DNA, 159 bp, Homo sapiens
  misc_feature 1..159: note = chrX:2931173-2931332
  misc_feature 1..159: note = hypo
  source 1..159: mol_type = genomic DNA
aagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgag

SEQ ID NO: 101468 - DNA, 30 bp, Homo sapiens
  misc_feature 1..30: note = chrX:2933263-2933293
  misc_feature 1..30: note = hypo
  source 1..30: mol_type = genomic DNA
tgtctttgctctcctcgcctttctgttttt

SEQ ID NO: 101469 - DNA, 30 bp, Homo sapiens
  misc_feature 1..30: note = chrX:29374805-29374835
  misc_feature 1..30: note = hypo
  source 1..30: mol_type = genomic DNA
ctacatctatacgaccgcaaataatgctac

SEQ ID NO: 101470 - DNA, 100 bp, Homo sapiens
  misc_feature 1..100: note = chrX:2945321-2945421
  misc_feature 1..100: note = hypo
  source 1..100: mol_type = genomic DNA
atctttggttgtgtcgtaatctttggttttaggtggcaaaggaatgggaggatgggaaggaggtatccgtgtgccagggatattccggtggccgtcagtc

SEQ ID NO: 101471 - DNA, 30 bp, Homo sapiens
  misc_feature 1..30: note = chrX:30648695-30648725
  misc_feature 1..30: note = hypo
  source 1..30: mol_type = genomic DNA
ggacaccatgaaagccgccatggccccgga

SEQ ID NO: 101472 - DNA, 39 bp, Homo sapiens
  misc_feature 1..39: note = chrX:3229228-3229267
  misc_feature 1..39: note = hypo
  source 1..39: mol_type = genomic DNA
ctctgactctcatctcgtccttcccgacctgattttcag

SEQ ID NO: 101473 - DNA, 471 bp, Homo sapiens
  misc_feature 1..471: note = chrX:3263355-3263826
  misc_feature 1..471: note = hyper
  source 1..471: mol_type = genomic DNA
ggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggc

SEQ ID NO: 101474 - DNA, 251 bp, Homo sapiens
  misc_feature 1..251: note = chrX:3263918-3264169
  misc_feature 1..251: note = hyper
  source 1..251: mol_type = genomic DNA
cgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcag

SEQ ID NO: 101475 - DNA, 386 bp, Homo sapiens
  misc_feature 1..386: note = chrX:3264627-3265013
  misc_feature 1..386: note = hyper
  source 1..386: mol_type = genomic DNA
cggccgggagtttgccggggccatgcccttcccggggccgggggtgaggcagctcggcttcccagcgcggcacagcaagccggcgcccttttattcccggcgctgcgaggcttccccaagtccacgcctcggcacacccccaccctgccccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtc

SEQ ID NO: 101476 - DNA, 73 bp, Homo sapiens
  misc_feature 1..73: note = chrX:3265150-3265223
  misc_feature 1..73: note = hyper
  source 1..73: mol_type = genomic DNA
cgggctggccccgccggcatcccactagctgcaggcagggctgcaacgtgagagccgccgccacgccctcccg

SEQ ID NO: 101477 - DNA, 122 bp, Homo sapiens
  misc_feature 1..122: note = chrX:33744448-33744570
  misc_feature 1..122: note = hyper
  source 1..122: mol_type = genomic DNA
tccccgccctccccacgcgcgggggcgccctgacagtcccctgctgctcctctgctgggcgccacaactttccccaacccgtgccaacttccagggcacagcctctgcggagagtagcaggg

SEQ ID NO: 101478 - DNA, 94 bp, Homo sapiens
  misc_feature 1..94: note = chrX:34149739-34149833
  misc_feature 1..94: note = hypo
  source 1..94: mol_type = genomic DNA
ggagtcttgggaggctccgggcttagatgggacactccagtctcgggaggctctgggaggagatgggacaccggagtctcgggaggcttcaggc

SEQ ID NO: 101479 - DNA, 102 bp, Homo sapiens
  misc_feature 1..102: note = chrX:3478175-3478277
  misc_feature 1..102: note = hypo
  source 1..102: mol_type = genomic DNA
gcttggcttgggctcagaggcctgacaatttctatctgtggagtaacgcagttccccctccatgatgtgggtgggcctagtctaatccgttgaagacctgac

SEQ ID NO: 101480 - DNA, 33 bp, Homo sapiens
  misc_feature 1..33: note = chrX:3630804-3630837
  misc_feature 1..33: note = hyper
  source 1..33: mol_type = genomic DNA
caggaggttttgtgacgtcggacggcccaggcc

SEQ ID NO: 101481 - DNA, 40 bp, Homo sapiens
  misc_feature 1..40: note = chrX:3694581-3694621
  misc_feature 1..40: note = hypo
  source 1..40: mol_type = genomic DNA
ccatagttggccaggcgcggtggctcacgcatgtaatccc

SEQ ID NO: 101482 - DNA, 140 bp, Homo sapiens
  misc_feature 1..140: note = chrX:3746502-3746642
  misc_feature 1..140: note = hypo
  source 1..140: mol_type = genomic DNA
cagtgtgagaatggccgaaaacgacacccagatgcaaacattacctgcaggccaccgcgtgctgactctctcaccaagcaggagcgggcccctccctcacgcggagccgctggcacggacagccccgggaaggtcaggct

SEQ ID NO: 101483 - DNA, 30 bp, Homo sapiens
  misc_feature 1..30: note = chrX:39868222-39868252
  misc_feature 1..30: note = hyper
  source 1..30: mol_type = genomic DNA
gccaacactgtcacccggaacgtccccgcc

SEQ ID NO: 101484 - DNA, 30 bp, Homo sapiens
  misc_feature 1..30: note = chrX:39964600-39964630
  misc_feature 1..30: note = hyper
  source 1..30: mol_type = genomic DNA
cgcagtcacggggaccggaagccctcgcgc

SEQ ID NO: 101485 - DNA, 30 bp, Homo sapiens
  misc_feature 1..30: note = chrX:39968920-39968950
  misc_feature 1..30: note = hyper
  source 1..30: mol_type = genomic DNA
caccgagcggttttgcggagctgcccgagg

SEQ ID NO: 101486 - DNA, 323 bp, Homo sapiens
  misc_feature 1..323: note = chrX:40005519-40005842
  misc_feature 1..323: note = hyper
  source 1..323: mol_type = genomic DNA
cggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggca

SEQ ID NO: 101487 - DNA, 30 bp, Homo sapiens
  misc_feature 1..30: note = chrX:40006116-40006146
  misc_feature 1..30: note = hyper
  source 1..30: mol_type = genomic DNA
ccccgacgcagacaccgctgtcagccccct

SEQ ID NO: 101488 - DNA, 132 bp, Homo sapiens
  misc_feature 1..132: note = chrX:40014537-40014669
  misc_feature 1..132: note = hyper
  source 1..132: mol_type = genomic DNA
ctttagaaaaagaggcgagaaggggcgcaccgcagtgccgcggctgctgcgaccgggggagagggtcgggggctgcggagcagaggagtccgcacccccgcggccagggtcaggcggcgtggatatcacccg

SEQ ID NO: 101489 - DNA, 377 bp, Homo sapiens
  misc_feature 1..377: note = chrX:40017591-40017968
  misc_feature 1..377: note = hyper
  source 1..377: mol_type = genomic DNA
gcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgct

SEQ ID NO: 101490 - DNA, 44 bp, Homo sapiens; identical to SEQ ID NO: 38658
  misc_feature 1..44: note = chrX:40031390-40031434
  misc_feature 1..44: note = hyper
  source 1..44: mol_type = genomic DNA

SEQ ID NO: 101491 - DNA, 632 bp, Homo sapiens
  misc_feature 1..632: note = chrX:40034425-40035057
  misc_feature 1..632: note = hyper
  source 1..632: mol_type = genomic DNA
gcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccgg

SEQ ID NO: 101492 - DNA, 15 bp, Homo sapiens
  misc_feature 1..15: note = chrX:40035724-40035739
  misc_feature 1..15: note = hyper
  source 1..15: mol_type = genomic DNA
agaaaacaaggccgg

SEQ ID NO: 101493 - DNA, 124 bp, Homo sapiens
  misc_feature 1..124: note = chrX:40126463-40126587
  misc_feature 1..124: note = hyper
  source 1..124: mol_type = genomic DNA
ctccgcgcatagcaccggggcgttttttccttccagctggaggcttcccatttaacctctaaggtgccagaagatccggatccctcgcgggcaggcctttggctggctccgggctaggctggga

SEQ ID NO: 101494 - DNA, 54 bp, Homo sapiens; identical to SEQ ID NO: 46889
  misc_feature 1..54: note = chrX:41331697-41331751
  misc_feature 1..54: note = hypo
  source 1..54: mol_type = genomic DNA

SEQ ID NO: 101495 - DNA, 30 bp, Homo sapiens
  misc_feature 1..30: note = chrX:4335009-4335039
  misc_feature 1..30: note = hypo
  source 1..30: mol_type = genomic DNA
ttagtgccggtaacacggaagcggctttct

SEQ ID NO: 101496 - DNA, 22 bp, Homo sapiens
  misc_feature 1..22: note = chrX:44136212-44136234
  misc_feature 1..22: note = hypo
  source 1..22: mol_type = genomic DNA
acttacagctgaggccgggcac

SEQ ID NO: 101497 - DNA, 100 bp, Homo sapiens
  misc_feature 1..100: note = chrX:44202862-44202962
  misc_feature 1..100: note = hyper
  source 1..100: mol_type = genomic DNA
ccagaagagagggcccggcaggcagcggcgcctcccggccgtgttgtttggcccccacgttgcctggagacgggaagcggcgtcacggagggaggagggg

SEQ ID NO: 101498 - DNA, 163 bp, Homo sapiens
  misc_feature 1..163: note = chrX:44729844-44730007
  misc_feature 1..163: note = hypo
  source 1..163: mol_type = genomic DNA
taatgttctcaaggtcgcacagcctgtgtagagcaaggattcgaatccaggtctgcctcactccaactcccacccattgcatccactccttgctgttctgctattacatagtaatagcgggaagaaaagtgttgaggtgtggagagtgggtagcctttttttt

SEQ ID NO: 101499 - DNA, 36 bp, Homo sapiens
  misc_feature 1..36: note = chrX:44751504-44751540
  misc_feature 1..36: note = hypo
  source 1..36: mol_type = genomic DNA
agcttgctgggatttcgaggccgggtacggtggctc

SEQ ID NO: 101500 - DNA, 22 bp, Homo sapiens
  misc_feature 1..22: note = chrX:44755610-44755632
  misc_feature 1..22: note = hypo
  source 1..22: mol_type = genomic DNA
ccgcgcccggccaaaaataaat

SEQ ID NO: 101501 - DNA, 52 bp, Homo sapiens; identical to SEQ ID NO: 46892
  misc_feature 1..52: note = chrX:44922962-44923014
  misc_feature 1..52: note = hypo
  source 1..52: mol_type = genomic DNA

SEQ ID NO: 101502 - DNA, 32 bp, Homo sapiens
  misc_feature 1..32: note = chrX:4606598-4606630
  misc_feature 1..32: note = hypo
  source 1..32: mol_type = genomic DNA
atttttttttttagacggcttctcactctgtt

SEQ ID NO: 101503 - DNA, 31 bp, Homo sapiens
  misc_feature 1..31: note = chrX:4606870-4606901
  misc_feature 1..31: note = hypo
  source 1..31: mol_type = genomic DNA
tgtgagccactgtgcccggctgtgagcagaa

SEQ ID NO: 101504 - DNA, 30 bp, Homo sapiens
  misc_feature 1..30: note = chrX:4636880-4636910
  misc_feature 1..30: note = hypo
  source 1..30: mol_type = genomic DNA
cgccgtattagattgcggtttttgccttta

SEQ ID NO: 101505 - DNA, 196 bp, Homo sapiens
  misc_feature 1..196: note = chrX:4691958-4692154
  misc_feature 1..196: note = hypo
  source 1..196: mol_type = genomic DNA
tttgccaaatttgtccgggcattttccccctatgaatgtgccccataaccctttgaggaactgcttggttttaactgctggcatgcagtgcattgggataaaattgtgcaaaccacatcctggggtaatgatattcctctttgctctcctcaaaccatggtcccgtggacacatagatgcccgcacctgtgatgca

SEQ ID NO: 101506 - DNA, 99 bp, Homo sapiens
  misc_feature 1..99: note = chrX:47440990-47441089
  misc_feature 1..99: note = hypo
  source 1..99: mol_type = genomic DNA
cctctgtttgaatcccggccatgccctgtgatcttaggaaaattctacagttcctctacgccccatatttcctcatccgtaaaacgggaataagaaccg

SEQ ID NO: 101507 - DNA, 30 bp, Homo sapiens
  misc_feature 1..30: note = chrX:54977452-54977482
  misc_feature 1..30: note = hypo
  source 1..30: mol_type = genomic DNA
ggaagcagatggcaccgtgactgtgcatag

SEQ ID NO: 101508 - DNA, 30 bp, Homo sapiens; identical to SEQ ID NO: 46884
  misc_feature 1..30: note = chrX:5757324-5757354
  misc_feature 1..30: note = hypo
  source 1..30: mol_type = genomic DNA

SEQ ID NO: 101509 - DNA, 40 bp, Homo sapiens; identical to SEQ ID NO: 46893
  misc_feature 1..40: note = chrX:58297213-58297253
  misc_feature 1..40: note = hypo
  source 1..40: mol_type = genomic DNA

SEQ ID NO: 101510 - DNA, 30 bp, Homo sapiens; identical to SEQ ID NO: 46894
  misc_feature 1..30: note = chrX:58304829-58304859
  misc_feature 1..30: note = hypo
  source 1..30: mol_type = genomic DNA

SEQ ID NO: 101511 - DNA, 124 bp, Homo sapiens
  misc_feature 1..124: note = chrX:58307150-58307274
  misc_feature 1..124: note = hypo
  source 1..124: mol_type = genomic DNA
cctttggggtgccttcggtgggagagacacgcacccagcttgggagacaggtactccacgaacacccctggtagggcacaggggctgccgggaaggcactgacctccggcggggcaccccagcc

SEQ ID NO: 101512 - DNA, 94 bp, Homo sapiens
  misc_feature 1..94: note = chrX:6143621-6143715
  misc_feature 1..94: note = hyper
  source 1..94: mol_type = genomic DNA
cacttctatgttgcccgcagaacgcccacacaaactggcaattctgcttcgtcaggataacgaggtctccctaaactttttcttttcctttttt

SEQ ID NO: 101513 - DNA, 514 bp, Homo sapiens
  misc_feature 1..514: note = chrX:6143775-6144289
  misc_feature 1..514: note = hyper
  source 1..514: mol_type = genomic DNA
tcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaaaaatgaccaaatagaaataaaataaaataaaaataaaaagaagccatactaccaccttgtggatccagctcgcaagaacatcacctgcttagttccaaaacccccacccaacccccaccccaaatttcttaagttgggtccaaatgacagatcgggatcctctgtcctcactccccgcagactcgcccaagccctaggctgaattcgtgacgcgcgcgcccagcacccgggcgagttgcaagccccggcgcaccgcaggggccaaaaccccgccggaacctcctaggaccccttcacgctgcctcctgcaccccctcccccgccatccccgagatagcagcagc

SEQ ID NO: 101514 - DNA, 807 bp, Homo sapiens
  misc_feature 1..807: note = chrX:6144913-6145720
  misc_feature 1..807: note = hyper
  source 1..807: mol_type = genomic DNA
tccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcc

SEQ ID NO: 101515 - DNA, 15 bp, Homo sapiens
  misc_feature 1..15: note = chrX:6145835-6145850
  misc_feature 1..15: note = hyper
  source 1..15: mol_type = genomic DNA
cgtcatcttatccga

SEQ ID NO: 101516 - DNA, 30 bp, Homo sapiens
  misc_feature 1..30: note = chrX:67871660-67871690
  misc_feature 1..30: note = hypo
  source 1..30: mol_type = genomic DNA
ctcacagaaatgccacgaacatttggtggg

SEQ ID NO: 101517 - DNA, 145 bp, Homo sapiens
  misc_feature 1..145: note = chrX:69501680-69501825
  misc_feature 1..145: note = hypo
  source 1..145: mol_type = genomic DNA
ttcagatgtgcctagcgatctcttgcctatttcctcttcctggagggtcacggaactactgagaacaatcttccccacctccacccctttgctgtgattacactacacttagcccgtgcttttccccatacgctgaccccaactt

SEQ ID NO: 101518 - DNA, 155 bp, Homo sapiens
  misc_feature 1..155: note = chrX:71525843-71525998
  misc_feature 1..155: note = hyper
  source 1..155: mol_type = genomic DNA
ggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtc

SEQ ID NO: 101519 - DNA, 34 bp, Homo sapiens
  misc_feature 1..34: note = chrX:71526883-71526917
  misc_feature 1..34: note = hyper
  source 1..34: mol_type = genomic DNA
gcgcgggtgctgtgccgtccgctgctctcttcct

SEQ ID NO: 101520 - DNA, 30 bp, Homo sapiens
  misc_feature 1..30: note = chrX:73740816-73740846
  misc_feature 1..30: note = hypo
  source 1..30: mol_type = genomic DNA
ctctgcagcatgggtcggagccctcgcgat

SEQ ID NO: 101521 - DNA, 38 bp, Homo sapiens
  misc_feature 1..38: note = chrX:78711045-78711083
  misc_feature 1..38: note = hypo
  source 1..38: mol_type = genomic DNA
ctgacctcgtgatccgcccgcctcggccttacaaccat

SEQ ID NO: 101522 - DNA, 178 bp, Homo sapiens
  misc_feature 1..178: note = chrX:7895411-7895589
  misc_feature 1..178: note = hyper
  source 1..178: mol_type = genomic DNA
accaaggccgcgctacgctctccgcgagccggcccaggaaagtcctgcggcaggggttggtaccgcctcccgcgcaggtatgtgacgtcatcgcgccgacgaaggcgcccgctaggccccgcctgctctatttaaacttctggactcaacctggccgctagaccggagcgtcctccag

SEQ ID NO: 101523 - DNA, 554 bp, Homo sapiens
  misc_feature 1..554: note = chrX:8698504-8699058
  misc_feature 1..554: note = hyper
  source 1..554: mol_type = genomic DNA
gccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 101524 - DNA, 113 bp, Homo sapiens
  misc_feature 1..113: note = chrX:8699110-8699223
  misc_feature 1..113: note = hyper
  source 1..113: mol_type = genomic DNA
cggggtttgggggacggttcccccgggactcgttgaggagtatccgaatacggccccgccaaatcccctgtccccggcacttcttccctgacgctctacgctagtccagggca

SEQ ID NO: 101525 - DNA, 314 bp, Homo sapiens
  misc_feature 1..314: note = chrX:8699436-8699750
  misc_feature 1..314: note = hyper
  source 1..314: mol_type = genomic DNA
ggtgaggtccccaggcgcagccggacgcgcctcccagactccctcccagtgccccggagcgcctgggactttgcgggagtcgccgcccgcccggagtctcgcgcactccaattcccgggaaaccgccacatccacacacccactcccagcatccacgactctccctccccagggaaatcgcctttggtttcctgctgggaaggagggagttggggcaagatgtctcgggcttctttttcttttcaggagccgggaagaggctggaaaggagagttccagcaccccgactgtaagatccacgcccaggggaagcc

SEQ ID NO: 101526 - DNA, 422 bp, Homo sapiens
  misc_feature 1..422: note = chrX:8700038-8700460
  misc_feature 1..422: note = hyper
  source 1..422: mol_type = genomic DNA
gcagagggtcaggaccgcgccgggcaccccgggcaccatggctgcgggtcgagggcgagggcgagggcgccgggcgcgggccgaggctccctgctccgcgccggggctgcactgctgaggaccaggcagacgccgcgactgagccggaaagttcaatccttcaactccggccggaccctcctcgccgacctccctcccagctcgccctcgaggggtggggtgagggggacaggaggccgcaccattggctggaaggcgtgtgagtgacaggggggccgggcgcagggcccatgggccggtctcgtcagctgcgagcccgggcgctccgggggagggcgacgccgagcggctttccacgccgcgcaggtctcgaggggcccagctcccacgcaggcgcctctcccgttcgcaccaaccgcttc

SEQ ID NO: 101527 - DNA, 30 bp, Homo sapiens
  misc_feature 1..30: note = chrX:91035211-91035241
  misc_feature 1..30: note = hyper
  source 1..30: mol_type = genomic DNA
caacccttgagggtacgacccttggcgcag

SEQ ID NO: 101528 - DNA, 516 bp, Homo sapiens
  misc_feature 1..516: note = chrX:91035598-91036114
  misc_feature 1..516: note = hyper
  source 1..516: mol_type = genomic DNA
cccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccaca

SEQ ID NO: 101529 - DNA, 221 bp, Homo sapiens
  misc_feature 1..221: note = chrX:91037061-91037282
  misc_feature 1..221: note = hyper
  source 1..221: mol_type = genomic DNA
tgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaaccca

SEQ ID NO: 101530 - DNA, 41 bp, Homo sapiens
  misc_feature 1..41: note = chrX:92928695-92928736
  misc_feature 1..41: note = hyper
  source 1..41: mol_type = genomic DNA
aattgacaaactgtacgcccaacgaacggccaaacgccact

SEQ ID NO: 101531 - DNA, 45 bp, Homo sapiens
  misc_feature 1..45: note = chrX:9433426-9433471
  misc_feature 1..45: note = hyper
  source 1..45: mol_type = genomic DNA
gggaggttcggagcgcggccgggcgcgcggcgccgccacaagttg

SEQ ID NO: 101532 - DNA, 126 bp, Homo sapiens
  misc_feature 1..126: note = chrX:9433712-9433838
  misc_feature 1..126: note = hyper
  source 1..126: mol_type = genomic DNA
cccgaagtgccggcgcgccttgcggggagagacggaggtcggcggggggctcctttgttttggggagggggaagtggccggtaagtttagggaagcgctcggcttttcctccggtgcccctttgtc

SEQ ID NO: 101533 - DNA, 105 bp, Homo sapiens
  misc_feature 1..105: note = chrX:97101386-97101491
  misc_feature 1..105: note = hypo
  source 1..105: mol_type = genomic DNA
caaggaggacttaggcgcccagggccccatcaccagctccgcgggcatcagccaggagaggactggcagctagatttcacccacatgccgcggcacaagcattac

SEQ ID NO: 101534 - DNA, 101 bp, Homo sapiens
  misc_feature 1..101: note = chrX:97285055-97285156
  misc_feature 1..101: note = hypo
  source 1..101: mol_type = genomic DNA
ggggtatgtatggtgcgggggtggggggcggctaacttcccgctttgctggagttgcaactacttttggtcggatgcctggaaagccagagtatctaaagc

SEQ ID NO: 101535 - DNA, 30 bp, Homo sapiens
  misc_feature 1..30: note = chrX:99924339-99924369
  misc_feature 1..30: note = hypo
  source 1..30: mol_type = genomic DNA
gtcagccaacatcatcgaggagctcaggtc

SEQ ID NO: 101536 - DNA, 20 bp, Homo sapiens
  misc_feature 1..20: note = chrY:14301600-14301620
  misc_feature 1..20: note = hypo
  source 1..20: mol_type = genomic DNA
gagcgacacagaagacgggt

SEQ ID NO: 101537 - DNA, 57 bp, Homo sapiens
  misc_feature 1..57: note = chrY:14567906-14567963
  misc_feature 1..57: note = hypo
  source 1..57: mol_type = genomic DNA
tggccctccgcccaccgcgtgcctagatgtgggggcaccgtgcgtgttgccgaactt

SEQ ID NO: 101538 - DNA, 30 bp, Homo sapiens; identical to SEQ ID NO: 46899
  misc_feature 1..30: note = chrY:14621298-14621328
  misc_feature 1..30: note = hypo
  source 1..30: mol_type = genomic DNA

SEQ ID NO: 101539 - DNA, 243 bp, Homo sapiens
  misc_feature 1..243: note = chrY:16635817-16636060
  misc_feature 1..243: note = hyper
  source 1..243: mol_type = genomic DNA
catgcacccctttcccgtgtgtgtgggttacgacgtgggtgggagtggtgaggcaagccgcaaaagtggggtagagctggtggttttgcttcttcggaagcctttgagtgtggcctggaccttagatgggggtgcagggcggtttgccgctgccaccctcggcaccatctctgaactgcccgcttttccggaggagcggaaaagttggaagccgaaaagacaggcgcccggagccctggtcta

SEQ ID NO: 101540 - DNA, 89 bp, Homo sapiens
  misc_feature 1..89: note = chrY:21728053-21728142
  misc_feature 1..89: note = hypo
  source 1..89: mol_type = genomic DNA
actgatattatactacgaccttggaagcaaaaccgttattataagcaaaagaagctagacgcaaagtccacttacgtcaggattacata

SEQ ID NO: 101541 - DNA, 116 bp, Homo sapiens
  misc_feature 1..116: note = chrY:22901316-22901432
  misc_feature 1..116: note = hypo
  source 1..116: mol_type = genomic DNA
gagtgtccaagtgtccggacctgtaggttccagtgctcaccctgcgcttttatatatctggttgtttgcagtggatcaggagcccctggccaggattttgccggtgttgtttgttt

SEQ ID NO: 101542 - DNA, 159 bp, Homo sapiens
  misc_feature 1..159: note = chrY:22918423-22918582
  misc_feature 1..159: note = hypo
  source 1..159: mol_type = genomic DNA
cgctgtcttgacagacgccagagagactcgtgaggttgtcaaaggtctgggagttttgcggggtttgttctggagtctggcaggaagtaatatttgctcaaaactgggcgtgaaatagcctggactgtcctttctcctccgatccggtattacccgtta

SEQ ID NO: 101543 - DNA, 94 bp, Homo sapiens
  misc_feature 1..94: note = chrY:23111711-23111805
  misc_feature 1..94: note = hypo
  source 1..94: mol_type = genomic DNA
atcctgtggtgcactatgttttaagcctattggaaaagtgcagcattctggtgggagtgatccgattttccatgtgccccgggtccctcaccca

SEQ ID NO: 101544 - DNA, 30 bp, Homo sapiens
  misc_feature 1..30: note = chrY:23613703-23613733
  misc_feature 1..30: note = hypo
  source 1..30: mol_type = genomic DNA
caggtaccccgagtccggcggagataaaga

SEQ ID NO: 101545 - DNA, 67 bp, Homo sapiens
  misc_feature 1..67: note = chrY:4869647-4869714
  misc_feature 1..67: note = hyper
  source 1..67: mol_type = genomic DNA
ttaaaagaggttcatcggaaaatgtgactttttaaaagcgagcagccgcaaacgggtgcatttttta

SEQ ID NO: 101546 - DNA, 210 bp, Homo sapiens
  misc_feature 1..210: note = chrY:6778824-6779034
  misc_feature 1..210: note = hyper
  source 1..210: mol_type = genomic DNA
aaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgagtgctag

SEQ ID NO: 101547 - DNA, 30 bp, Homo sapiens
  misc_feature 1..30: note = chrY:6779293-6779323
  misc_feature 1..30: note = hyper
  source 1..30: mol_type = genomic DNA
tggggaagggggaggcggctgctaagttta

SEQ ID NO: 101548 - DNA, 61 bp, Homo sapiens
  misc_feature 1..61: note = chrY:6779746-6779807
  misc_feature 1..61: note = hyper
  source 1..61: mol_type = genomic DNA
ggcagatcctgggtccggccttgcttcccagtggtaccttctctcacggagggggcggggc

SEQ ID NO: 101549 - DNA, 40 bp, Homo sapiens
  misc_feature 1..40: note = CR856017.2_11887-39781:16677-16717
  misc_feature 1..40: note = hypo
  source 1..40: mol_type = genomic DNA
ttcccacctccaggacgggaggtaccgctcctagggattt

SEQ ID NO: 101550 - DNA, 32 bp, Homo sapiens
  misc_feature 1..32: note = CR936360.14_69981-85448:11336-11368
  misc_feature 1..32: note = hypo
  source 1..32: mol_type = genomic DNA
ctagtttgagccagccggccgcagtggcttac

SEQ ID NO: 101551 - DNA, 30 bp, Homo sapiens; identical to SEQ ID NO: 46912
  misc_feature 1..30: note = FP565324.3_2001-29640:15187-15217
  misc_feature 1..30: note = hypo
  source 1..30: mol_type = genomic DNA

SEQ ID NO: 101552 - DNA, 30 bp, Homo sapiens
  misc_feature 1..30: note = FP565324.3_2001-29640:19444-19474
  misc_feature 1..30: note = hypo
  source 1..30: mol_type = genomic DNA
ggaggagcatcttcccgtgcttgtttattg

SEQ ID NO: 101553 - DNA, 124 bp, Homo sapiens
  misc_feature 1..124: note = FP565324.3_2001-29640:19686-19810
  misc_feature 1..124: note = hypo
  source 1..124: mol_type = genomic DNA
cggcaagtaggtggccggatcgccctccgtcccgcctcctgtgcccccagcccctctgcaccccgtctccttcctcttcttcgccaagctctgagcaccctctccggggcgctaggtgctctcc

SEQ ID NO: 101554 - DNA, 30 bp, Homo sapiens
  misc_feature 1..30: note = FP565324.3_2001-29640:25504-25534
  misc_feature 1..30: note = hypo
  source 1..30: mol_type = genomic DNA
cattcattacagccacggctgaggactctc

SEQ ID NO: 101555 - DNA, 264 bp, Homo sapiens
  misc_feature 1..264: note = GL000220.1:138909-139173
  misc_feature 1..264: note = hypo
  source 1..264: mol_type = genomic DNA
tttttggccatctttcgggcaatgtaactactacagcaaaatgagatatgatccattaaacaacatattcgcaaatcaaaaagtgtttcagtaatataatgcttcagatttagaagcaaatcaaatgatagaactccactgctgtaataagtcaccccaaagatcaccgtatctgacaaaataactaccacagggttatgacttcagaatcatactttctcttgatatttacttatgtatgtatttattttttttaatttattt

SEQ ID NO: 101556 - DNA, 160 bp, Homo sapiens
  misc_feature 1..160: note = GL000258.1:893139-893299
  misc_feature 1..160: note = hyper
  source 1..160: mol_type = genomic DNA
ggctccagccctctacgccaccgtcaaggagggtcggcctggtcccgggcgggcagccaagccattccccagaaattcagattaacctggacccgcgtggaggattcagctcctagatgctcttccgtctcagaagtgcgccccccgcaccagttttcag

SEQ ID NO: 101557 - DNA, 30 bp, Homo sapiens
  misc_feature 1..30: note = GL383548.1:10245-10275
  misc_feature 1..30: note = hypo
  source 1..30: mol_type = genomic DNA
ccctcccccaggcatcgatctcgtgaataa

SEQ ID NO: 101558 - DNA, 82 bp, Homo sapiens; identical to SEQ ID NO: 14151
  misc_feature 1..82: note = JH159140.1:144237-144319
  misc_feature 1..82: note = hyper
  source 1..82: mol_type = genomic DNA

SEQ ID NO: 101559 - DNA, 184 bp, Homo sapiens
  misc_feature 1..184: note = JH636052.4:1361645-1361829
  misc_feature 1..184: note = hyper
  source 1..184: mol_type = genomic DNA
ttgctgggggcggaccgtgttgacaaagtcgctggaaatcactgtcagagatgtagcttttaggatagtattgtccaggatctgctaggctctatccactgcaggccttggtggggggggagggggggcctgcgaagcacaggaaaacttgtcttttcgttgtaacttccgcttcgttactaca

SEQ ID NO: 101560 - DNA, 24 bp, Homo sapiens
  misc_feature 1..24: note = JH636052.4:1362108-1362132
  misc_feature 1..24: note = hyper
  source 1..24: mol_type = genomic DNA
gacttgctcctacagcgcgggaaa

SEQ ID NO: 101561 - DNA, 24 bp, Homo sapiens
  misc_feature 1..24: note = JH636052.4:1362192-1362216
  misc_feature 1..24: note = hyper
  source 1..24: mol_type = genomic DNA
tgatgtcaccgacagtgcctttcc

SEQ ID NO: 101562 - DNA, 30 bp, Homo sapiens
  misc_feature 1..30: note = JH636052.4:1370528-1370558
  misc_feature 1..30: note = hypo
  source 1..30: mol_type = genomic DNA
agccaccgtgcccagcgtaaccaagattat

SEQ ID NO: 101563 - DNA, 18 bp, Homo sapiens
  misc_feature 1..18: note = JH636052.4:2022610-2022628
  misc_feature 1..18: note = hypo
  source 1..18: mol_type = genomic DNA
aacaataaaacaggccgg

SEQ ID NO: 101564 - DNA, 29 bp, Homo sapiens
  misc_feature 1..29: note = JH636052.4:2254977-2255006
  misc_feature 1..29: note = hypo
  source 1..29: mol_type = genomic DNA
ccaccgcgcccggccggtttaccattttt

SEQ ID NO: 101565 - DNA, 32 bp, Homo sapiens
  misc_feature 1..32: note = JH636052.4:2269647-2269679
  misc_feature 1..32: note = hyper
  source 1..32: mol_type = genomic DNA
ctcggtgatgcgcttcgcgtatttgcggacga

SEQ ID NO: 101566 - DNA, 36 bp, Homo sapiens
  misc_feature 1..36: note = JH636052.4:2280989-2281025
  misc_feature 1..36: note = hyper
  source 1..36: mol_type = genomic DNA
aagaataacccttgccgtctattttttcattacaaa

SEQ ID NO: 101567 - DNA, 89 bp, Homo sapiens
  misc_feature 1..89: note = JH636052.4:2302679-2302768
  misc_feature 1..89: note = hyper
  source 1..89: mol_type = genomic DNA
gtccgcgacccgagccgccgcctcgaggctcaggggaagctgaacgctcggtgggctcctgggatgcatcttcgcgttctttgcgccgc

SEQ ID NO: 101568 - DNA, 211 bp, Homo sapiens; identical to SEQ ID NO: 38684
  misc_feature 1..211: note = JH636052.4:5118718-5118929
  misc_feature 1..211: note = hyper
  source 1..211: mol_type = genomic DNA

SEQ ID NO: 101569 - DNA, 225 bp, Homo sapiens
  misc_feature 1..225: note = JH636058.1:413166-413391
  misc_feature 1..225: note = hyper
  source 1..225: mol_type = genomic DNA
tcggggtccggcgggcggcggtgaaccacggcgcccgcggacatggacaccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcctgcc

SEQ ID NO: 101570 - DNA, 445 bp, Homo sapiens
  misc_feature 1..445: note = NW_001838014.1_249000-295694:13512-13957
  misc_feature 1..445: note = hypo
  source 1..445: mol_type = genomic DNA
ggcccctcggcagtgcggcccctcagcagtggggccaaagcgccattgccggcagccggtcgggaggagggtgaaagagaaatcctggctgcacacagaaggcaccaactgtttgctcatcgcagagcagggcagtggtgcccaggagggcggggcatcggatactgaaacacgagcaggtttccggcatcgagactggggctggagacttcaggaaacctcattttcttccccaaacatccacccttttctttaaagtaggccaaaggcctccgtttcacgctgtgtgagccaggcgtgtcaagccacagcggtcgaggcgggtgtttctcagggcaggctttaaaggtgctcgggcccttcggccggcgccctctgcaggcagggcaaagggtggggccatggggtccctgcaaagatcaggctaaggcgactccaccgcact

SEQ ID NO: 101571 - DNA, 61 bp, Homo sapiens; identical to SEQ ID NO: 46915
  misc_feature 1..61: note = NW_001838014.1_249000-295694:3702-3763
  misc_feature 1..61: note = hypo
  source 1..61: mol_type = genomic DNA

SEQ ID NO: 101572 - DNA, 191 bp, Homo sapiens
  misc_feature 1..191: note = NW_001838014.1_249000-295694:4069-4260
  misc_feature 1..191: note = hypo
  source 1..191: mol_type = genomic DNA
acctggccctaaatccgactgctggagccagagccagagccgtgcggagacacggagccggccgaagccactcagggttggagccgcctcgccacacccaggaccctgggcgctacattgagggtggctgggtgcaggggtgatggcggcggttcctagttggcagccaggagacacgtactcactccagc

SEQ ID NO: 101573 - DNA, 30 bp, Homo sapiens
  misc_feature 1..30: note = NW_001838014.1_249000-295694:441-471
  misc_feature 1..30: note = hypo
  source 1..30: mol_type = genomic DNA
ctctgagagcgtccgcgagcagctccgcag

SEQ ID NO: 101574 - DNA, 284 bp, Homo sapiens
  misc_feature 1..284: note = NW_001838014.1_249000-295694:7106-7390
  misc_feature 1..284: note = hypo
  source 1..284: mol_type = genomic DNA
cctcgggaagtgctccgagaggtgcacaaacaggcactcgaacaacggcgatgagctcactctccacgacggatcgccagggacgatctaaatatccactcatgctcccgcacgcacgaggttccccagcgctctgggtctcaggccgccggagaggagtatttaatgcgacaccagcgccgctcgtgcgtgctgtgaagagcagccgttaaaagcggttatgcaaatctgtgtttgctgatttgtttaatgtgcacaacatactgctacgtgggccaagcctt

SEQ ID NO: 101575 - DNA, 36 bp, Homo sapiens
  misc_feature 1..36: note = NW_001838016.1_818233-828058:5545-5581
  misc_feature 1..36: note = hypo
  source 1..36: mol_type = genomic DNA
ctttcgtgttgtcaccgagaacgtcccctgcggcac

SEQ ID NO: 101576 - DNA, 30 bp, Homo sapiens
  misc_feature 1..30: note = NW_001838016.1_818233-828058:6037-6067
  misc_feature 1..30: note = hypo
  source 1..30: mol_type = genomic DNA
gggaagtgggggggacggagccttggcaag

SEQ ID NO: 101577 - DNA, 30 bp, Homo sapiens
  misc_feature 1..30: note = NW_001838016.1_818233-828058:6848-6878
  misc_feature 1..30: note = hypo
  source 1..30: mol_type = genomic DNA
gcccagatgccctggcgcccaaggacccct

SEQ ID NO: 101578 - DNA, 32 bp, Homo sapiens
  misc_feature 1..32: note = NW_001838016.1_818233-828058:7308-7340
  misc_feature 1..32: note = hypo
  source 1..32: mol_type = genomic DNA
cggtccccaagagcccgcggggtgggtggggg

SEQ ID NO: 101579 - DNA, 166 bp, Homo sapiens
  misc_feature 1..166: note = NW_001838016.1_818233-828058:7554-7720
  misc_feature 1..166: note = hypo
  source 1..166: mol_type = genomic DNA
aagaacaggaagcgccggcagcgtgtgccccaccacactcgccgctgatgcgtggggtgtggggcgggtggggaaggtttccaaataaacagaaacacctgggcccagagaggagggcgtggctgacagaggggtccctggcatggtagaacgttctgggcagagg

SEQ ID NO: 101580 - DNA, 81 bp, Homo sapiens
  misc_feature 1..81: note = NW_001838056.1_145425-224902:38739-38820
  misc_feature 1..81: note = hypo
  source 1..81: mol_type = genomic DNA
gcgtgggaaaggggccgctggtgtcctgtcaaagggcgaaacacccaggagtcctctcctcaggacctccttgagccgact

SEQ ID NO: 101581 - DNA, 140 bp, Homo sapiens
  misc_feature 1..140: note = NW_001838056.1_145425-224902:42669-42809
  misc_feature 1..140: note = hypo
  source 1..140: mol_type = genomic DNA
gactcacccaaacaccgtactggcaggcctgaggctgggatgccacactgctttccccggactgtctgctgtttctgcatcctggtagcccctccgtgtagcatagtgtcccgaatctgttttgtcgaccccctggattg

SEQ ID NO: 101582 - DNA, 30 bp, Homo sapiens
  misc_feature 1..30: note = NW_001838194.1_126783-128006:853-883
  misc_feature 1..30: note = hypo
  source 1..30: mol_type = genomic DNA
cttctcctgctcctgcgtcttcttctcctc

SEQ ID NO: 101583 - DNA, 274 bp, Homo sapiens
  misc_feature 1..274: note = NW_001838403.1_1-2251:78-352
  misc_feature 1..274: note = hyper
  source 1..274: mol_type = genomic DNA
ccggggccctgggggcgcgttgacccctcgccctgtcccagcgggacccgggaggcgctaacagcttccgagctcgcggtcgggggacccatcccgcagaggcctggggagccgcgcgaagccggcgagcaaacagctggaaattattaccagttaatgcgctccgtgtggccgcagccgcctgttggccccggaaggcgggccctggcgctcctgcccgtcccggaggagaggcctgtcctcgggggctccgcaggcgcgggtcacccctggt

SEQ ID NO: 101584 - DNA, 70 bp, Homo sapiens
  misc_feature 1..70: note = NW_001838877.2_33615069-33616110:636-706
  misc_feature 1..70: note = hypo
  source 1..70: mol_type = genomic DNA
cttgccacatttactcgggatattttattgacaaatatgcaggttagtccaggtgcggtggctcacacct

SEQ ID NO: 101585 - DNA, 24 bp, Homo sapiens
  misc_feature 1..24: note = NW_001839407.1_42766-49957:1190-1214
  misc_feature 1..24: note = hypo
  source 1..24: mol_type = genomic DNA
tcgccggcccgctggtgcctctgc

SEQ ID NO: 101586 - DNA, 39 bp, Homo sapiens
  misc_feature 1..39: note = NW_001839407.1_56047-63507:7039-7078
  misc_feature 1..39: note = hypo
  source 1..39: mol_type = genomic DNA
ttgcctacgccgctacggctctttcggaaggggtggtct

SEQ ID NO: 101587 - DNA, 30 bp, Homo sapiens
  misc_feature 1..30: note = NW_001839407.1_56047-63507:754-784
  misc_feature 1..30: note = hypo
  source 1..30: mol_type = genomic DNA
aggggcctggtccttcgattctgaaaccag

SEQ ID NO: 101588 - DNA, 77 bp, Homo sapiens
  misc_feature 1..77: note = NW_001839455.1_124947-137693:9386-9463
  misc_feature 1..77: note = hypo
  source 1..77: mol_type = genomic DNA
cagcccgtcctcctccgatgacacgatgctgtaggggttggcccggctggctgcggtcatcccgggggttgggggac

SEQ ID NO: 101589 - DNA, 140 bp, Homo sapiens
  misc_feature 1..140: note = NW_001839455.1_50266-109797:44348-44488
  misc_feature 1..140: note = hypo
  source 1..140: mol_type = genomic DNA
tggcgcctcccctgacggggcagccagcctgagccgcatgggccgccctgcagaagcatggtctggggatggtaatgaacgcagcaaatgtttcacttgctctgcttctgggcccccatgctcagcgctcctccctcaca

SEQ ID NO: 101590 - DNA, 30 bp, Homo sapiens
  misc_feature 1..30: note = NW_001839603.1_36678-41438:2681-2711
  misc_feature 1..30: note = hypo
  source 1..30: mol_type = genomic DNA
tagatgtctgtgttccgctgccaggcgctc

SEQ ID NO: 101591 - DNA, 39 bp, Homo sapiens
  misc_feature 1..39: note = NW_001839609.1_1-3470:1119-1158
  misc_feature 1..39: note = hypo
  source 1..39: mol_type = genomic DNA
aactcttttggacaccgagccaaagcgaggcactgcgag

SEQ ID NO: 101592 - DNA, 75 bp, Homo sapiens
  misc_feature 1..75: note = NW_001839668.1_21493-58548:15519-15594
  misc_feature 1..75: note = hypo
  source 1..75: mol_type = genomic DNA
ggtttttgaacccaccgtagcggctttttgtgcccaccgccgcacctttttgtggcttttcgcccccgctgccac

SEQ ID NO: 101593 - DNA, 90 bp, Homo sapiens; identical to SEQ ID NO: 46922
  misc_feature 1..90: note = NW_001839760.1_243903-260476:6752-6842
  misc_feature 1..90: note = hypo
  source 1..90: mol_type = genomic DNA

SEQ ID NO: 101594 - DNA, 64 bp, Homo sapiens
  misc_feature 1..64: note = NW_001840246.1_7363-10559:45-109
  misc_feature 1..64: note = hypo
  source 1..64: mol_type = genomic DNA
gcgacctgtggaccccggcccctaccccactaagtaatcctctgggacgcgggttgtgcaagca

SEQ ID NO: 101595 - DNA, 32 bp, Homo sapiens
  misc_feature 1..32: note = NW_001840306.1_6328-82586:11021-11053
  misc_feature 1..32: note = hypo
  source 1..32: mol_type = genomic DNA
gttcctccatgctgtcgcgtgtgtccgaatct

SEQ ID NO: 101596 - DNA, 178 bp, Homo sapiens
  misc_feature 1..178: note = NW_001840306.1_6328-82586:33514-33692
  misc_feature 1..178: note = hypo
  source 1..178: mol_type = genomic DNA
ctcacacttctgccccggccacccccgcaccgcacgcagactgaataaaatatgccagataaccctggcagggacaccggccaccaatgaatttaactttcctacacataatccgccaaggatgctgcgaggctatttagaaggttttgttgttctcgctgcgcgtctctccttgctt

SEQ ID NO: 101597 - DNA, 29 bp, Homo sapiens
  misc_feature 1..29: note = NW_001840646.1_6803-11069:2056-2085
  misc_feature 1..29: note = hypo
  source 1..29: mol_type = genomic DNA
ccttccggaggagccgtggaggcataggc

SEQ ID NO: 101598 - DNA, 77 bp, Homo sapiens
  misc_feature 1..77: note = NW_001840700.1_1-4272:2301-2378
  misc_feature 1..77: note = hypo
  source 1..77: mol_type = genomic DNA
caaagcaggcatgcagggcctcgcattggcccggggtcctaaccagtctccttcgccgtcaccgtccccaggcttcg

SEQ ID NO: 101599 - DNA, 16 bp, Homo sapiens
  misc_feature 1..16: note = NW_001840754.1_117-3691:2521-2537
  misc_feature 1..16: note = hypo
  source 1..16: mol_type = genomic DNA
ccgcagggagggtgcc

SEQ ID NO: 101600 - DNA, 30 bp, Homo sapiens; identical to SEQ ID NO: 46924
  misc_feature 1..30: note = NW_001840841.1_1-4205:1669-1699
  misc_feature 1..30: note = hypo
  source 1..30: mol_type = genomic DNA

SEQ ID NO: 101601 - DNA, 187 bp, Homo sapiens
  misc_feature 1..187: note = NW_001840866.1_38854-140524:80412-80599
  misc_feature 1..187: note = hypo
  source 1..187: mol_type = genomic DNA
ctgccaggcagcttccgggaaaccaaagtctttgggttccggtgggagtatggttgcaaagctgaaacaaaggaattaacagaagggcaccaccaggagtggagcctgtggcttaatttgactcaacacgggaaacctcacccggacagggacaggattgacagctctttctcgattccgtgagtgg

SEQ ID NO: 101602 - DNA, 30 bp, Homo sapiens
  misc_feature 1..30: note = NW_001840954.1_1-14936:6819-6849
  misc_feature 1..30: note = hypo
  source 1..30: mol_type = genomic DNA
catgagagctttgcccggttttctcccaca

SEQ ID NO: 101603 - DNA, 23 bp, Homo sapiens
  misc_feature 1..23: note = NW_001841011.1_96346-168555:36552-36575
  misc_feature 1..23: note = hypo
  source 1..23: mol_type = genomic DNA
ggggggaacgagtgacctttcca

SEQ ID NO: 101604 - DNA, 36 bp, Homo sapiens
  misc_feature 1..36: note = NW_001841011.1_96346-168555:37241-37277
  misc_feature 1..36: note = hypo
  source 1..36: mol_type = genomic DNA
tgcacatgtgtgaggcgcgagcggcttctcccgtcc

SEQ ID NO: 101605 - DNA, 120 bp, Homo sapiens
  misc_feature 1..120: note = NW_001841051.1_40144-46142:4764-4884
  misc_feature 1..120: note = hypo
  source 1..120: mol_type = genomic DNA
cgcctgccttcttgcttgctgcgtctcccgggtcagggctgagattcacgctggagttgcctcagctggtgtgacctctcattctgaaacgaaatctgtacccttggctacggaatgcca

SEQ ID NO: 101606 - DNA, 78 bp, Homo sapiens
  misc_feature 1..78: note = NW_001841110.1_111-11841:9020-9098
  misc_feature 1..78: note = hypo
  source 1..78: mol_type = genomic DNA
ggccctgggagccagcgttgagcagaacccgtacctgggcatcgccaccagggaacggctgacacgggccattgtcat

SEQ ID NO: 101607 - DNA, 37 bp, Homo sapiens
  misc_feature 1..37: note = NW_001841138.1_665891-688550:14581-14618
  misc_feature 1..37: note = hypo
  source 1..37: mol_type = genomic DNA
gagagagacccaagccgcgaaccgtgggcatgctcag

SEQ ID NO: 101608 - DNA, 18 bp, Homo sapiens
  misc_feature 1..18: note = NW_001841138.1_67124-102688:26293-26311
  misc_feature 1..18: note = hypo
  source 1..18: mol_type = genomic DNA
ggccgtgcaacaaacaaa

SEQ ID NO: 101609 - DNA, 137 bp, Homo sapiens
  misc_feature 1..137: note = NW_001841138.1_67124-102688:27763-27900
  misc_feature 1..137: note = hypo
  source 1..137: mol_type = genomic DNA
agtagggagtgggtaatttgcatgcctgctgccttccttgaatgtggtagccatttctcaggctccctctccagaatcgaaccctgattccttgtcacccgtggtcaccatggtaggcacagcgactaccatcgaaa

SEQ ID NO: 101610 - DNA, 55 bp, Homo sapiens; identical to SEQ ID NO: 46928
  misc_feature 1..55: note = NW_001841145.1_177495-186900:5222-5277
  misc_feature 1..55: note = hypo
  source 1..55: mol_type = genomic DNA

SEQ ID NO: 101611 - DNA, 37 bp, Homo sapiens
  misc_feature 1..37: note = NW_001841145.1_177495-186900:6312-6349
  misc_feature 1..37: note = hypo
  source 1..37: mol_type = genomic DNA
ctgaccacccccaccccacactcgcccaccacccaca

SEQ ID NO: 101612 - DNA, 25 bp, Homo sapiens
  misc_feature 1..25: note = NW_001841145.1_68487-74424:228-253
  misc_feature 1..25: note = hypo
  source 1..25: mol_type = genomic DNA
ctccacacagcggagaggtgccgtt

SEQ ID NO: 101613 - DNA, 39 bp, Homo sapiens
  misc_feature 1..39: note = NW_001841157.1_1611084-1612812:1051-1090
  misc_feature 1..39: note = hypo
  source 1..39: mol_type = genomic DNA
aatcccctgagcacccgcagctcccgggttccctgctgc

SEQ ID NO: 101614 - DNA, 20 bp, Homo sapiens
  misc_feature 1..20: note = NW_001841160.1_117611-172877:34909-34929
  misc_feature 1..20: note = hypo
  source 1..20: mol_type = genomic DNA
gtaatcgaatggaataaata

SEQ ID NO: 101615 - DNA, 69 bp, Homo sapiens; identical to SEQ ID NO: 46929
  misc_feature 1..69: note = NW_001842432.1_1-179261:101291-101360
  misc_feature 1..69: note = hypo
  source 1..69: mol_type = genomic DNA

SEQ ID NO: 101616 - DNA, 95 bp, Homo sapiens
  misc_feature 1..95: note = NW_001842432.1_1-179261:103119-103214
  misc_feature 1..95: note = hypo
  source 1..95: mol_type = genomic DNA
ttggggccgggaggccgcatcctaggcctccctggggcctgcggcgctggcagcagctccatgttgaggtcacctacagccggcaccacggcacg

SEQ ID NO: 101617 - DNA, 157 bp, Homo sapiens
  misc_feature 1..157: note = NW_001842432.1_1-179261:113208-113365
  misc_feature 1..157: note = hypo
  source 1..157: mol_type = genomic DNA
ctcctaccactctggcgtgctgtagtgtctgtcaccaccatgaactcacagcaaggtgagcaacggtgtcccaggctccatcctccagcatatggcaggtgtctcctcctctccctggcatggagcacctgggcaggtaaagccagaaaagcctaga

SEQ ID NO: 101618 - DNA, 38 bp, Homo sapiens; identical to SEQ ID NO: 67336
  misc_feature 1..38: note = AC006359.3_31144-32210:157-195
  misc_feature 1..38: note = Hyper
  source 1..38: mol_type = genomic DNA

SEQ ID NO: 101619 - DNA, 41 bp, Homo sapiens; identical to SEQ ID NO: 67338
  misc_feature 1..41: note = AC010098.8_29020-31687:525-566
  misc_feature 1..41: note = Hyper
  source 1..41: mol_type = genomic DNA

SEQ ID NO: 101620 - DNA, 18 bp, Homo sapiens
  misc_feature 1..18: note = AC010098.8_29020-31687:1483-1501
  misc_feature 1..18: note = Hyper
  source 1..18: mol_type = genomic DNA
gcggctttttgcccccgc

SEQ ID NO: 101621 - DNA, 179 bp, Homo sapiens; identical to SEQ ID NO: 67339
  misc_feature 1..179: note = AC018688.9_35552-170204:78812-78991
  misc_feature 1..179: note = Hypo
  source 1..179: mol_type = genomic DNA

SEQ ID NO: 101622 - DNA, 94 bp, Homo sapiens; identical to SEQ ID NO: 67340
  misc_feature 1..94: note = AC018688.9_35552-170204:82698-82792
  misc_feature 1..94: note = Hypo
  source 1..94: mol_type = genomic DNA

SEQ ID NO: 101623 - DNA, 120 bp, Homo sapiens; identical to SEQ ID NO: 67341
  misc_feature 1..120: note = AC127380.4_153-32188:9589-9709
  misc_feature 1..120: note = Hyper
  source 1..120: mol_type = genomic DNA

SEQ ID NO: 101624 - DNA, 30 bp, Homo sapiens; identical to SEQ ID NO: 67342
  misc_feature 1..30: note = AC137488.2_1-70728:40075-40105
  misc_feature 1..30: note = Hypo
  source 1..30: mol_type = genomic DNA

SEQ ID NO: 101625 - DNA, 40 bp, Homo sapiens; identical to SEQ ID NO: 67343
  misc_feature 1..40: note = AC145029.2_135730-137748:1618-1658
  misc_feature 1..40: note = Hyper
  source 1..40: mol_type = genomic DNA

SEQ ID NO: 101626 - DNA, 198 bp, Homo sapiens; identical to SEQ ID NO: 67344
  misc_feature 1..198: note = AC188622.2_1-37519:11868-12066
  misc_feature 1..198: note = Hypo
  source 1..198: mol_type = genomic DNA

SEQ ID NO: 101627 - DNA, 30 bp, Homo sapiens; identical to SEQ ID NO: 67345
  misc_feature 1..30: note = AC207871.4_32367-39588:2999-3029
  misc_feature 1..30: note = Hypo
  source 1..30: mol_type = genomic DNA

SEQ ID NO: 101628 - DNA, 45 bp, Homo sapiens; identical to SEQ ID NO: 67346
  misc_feature 1..45: note = AC211344.3_7702-13588:3836-3881
  misc_feature 1..45: note = Hyper
  source 1..45: mol_type = genomic DNA

SEQ ID NO: 101629 - DNA, 95 bp, Homo sapiens; identical to SEQ ID NO: 67349
  misc_feature 1..95: note = AC211950.2_11234-25326:25-120
  misc_feature 1..95: note = Hyper
  source 1..95: mol_type = genomic DNA

SEQ ID NO: 101630 - DNA, 18 bp, Homo sapiens
  misc_feature 1..18: note = AC211950.2_11234-25326:180-198
  misc_feature 1..18: note = Hyper
  source 1..18: mol_type = genomic DNA
aagcggcttttttttaat

SEQ ID NO: 101631 - DNA, 152 bp, Homo sapiens; identical to SEQ ID NO: 67350
  misc_feature 1..152: note = AC211950.2_11234-25326:8748-8900
  misc_feature 1..152: note = Hyper
  source 1..152: mol_type = genomic DNA

SEQ ID NO: 101632 - DNA, 598 bp, Homo sapiens; identical to SEQ ID NO: 67347
  misc_feature 1..598: note = AC211950.2_11234-25326:13291-13889
  misc_feature 1..598: note = Hyper
  source 1..598: mol_type = genomic DNA

SEQ ID NO: 101633 - DNA, 173 bp, Homo sapiens; identical to SEQ ID NO: 67351
  misc_feature 1..173: note = AC225595.1_16282-19523:1056-1229
  misc_feature 1..173: note = Hypo
  source 1..173: mol_type = genomic DNA

SEQ ID NO: 101634 - DNA, 74 bp, Homo sapiens; identical to SEQ ID NO: 67352
  misc_feature 1..74: note = AC231386.2_19255-24791:4032-4106
  misc_feature 1..74: note = Hyper
  source 1..74: mol_type = genomic DNA

SEQ ID NO: 101635 - DNA, 30 bp, Homo sapiens; identical to SEQ ID NO: 46903
  misc_feature 1..30: note = AC239873.3_5604-11530:5296-5326
  misc_feature 1..30: note = Hypo
  source 1..30: mol_type = genomic DNA

SEQ ID NO: 101636 - DNA, 259 bp, Homo sapiens; identical to SEQ ID NO: 67354
  misc_feature 1..259: note = AC241442.1_28021-33880:323-582
  misc_feature 1..259: note = Hyper
  source 1..259: mol_type = genomic DNA

SEQ ID NO: 101637 - DNA, 420 bp, Homo sapiens; identical to SEQ ID NO: 67355
  misc_feature 1..420: note = AC241851.2_88-34049:15133-15553
  misc_feature 1..420: note = Hyper
  source 1..420: mol_type = genomic DNA

SEQ ID NO: 101638 - DNA, 30 bp, Homo sapiens; identical to SEQ ID NO: 67356
  misc_feature 1..30: note = AEKP01008621.1_1-2685:1692-1722
  misc_feature 1..30: note = Hypo
  source 1..30: mol_type = genomic DNA

SEQ ID NO: 101639 - DNA, 30 bp, Homo sapiens; identical to SEQ ID NO: 67357
  misc_feature 1..30: note = AEKP01044741.1_1-4554:2853-2883
  misc_feature 1..30: note = Hypo
  source 1..30: mol_type = genomic DNA

SEQ ID NO: 101640 - DNA, 30 bp, Homo sapiens; identical to SEQ ID NO: 67358
  misc_feature 1..30: note = AEKP01132292.1_2033-9536:6910-6940
  misc_feature 1..30: note = Hypo
  source 1..30: mol_type = genomic DNA

SEQ ID NO: 101641 - DNA, 30 bp, Homo sapiens; identical to SEQ ID NO: 16832
  misc_feature 1..30: note = AEKP01139090.1_11256-14570:719-749
  misc_feature 1..30: note = Hypo
  source 1..30: mol_type = genomic DNA

SEQ ID NO: 101642 - DNA, 30 bp, Homo sapiens; identical to SEQ ID NO: 67360
  misc_feature 1..30: note = AEKP01146324.1_36063-42453:2576-2606
  misc_feature 1..30: note = Hypo
  source 1..30: mol_type = genomic DNA

SEQ ID NO: 101643 - DNA, 21 bp, Homo sapiens
  misc_feature 1..21: note = AEKP01149800.1_88-7643:5248-5269
  misc_feature 1..21: note = Hypo
  source 1..21: mol_type = genomic DNA
gtgtgagggtgtgagcgggtg

SEQ ID NO: 101644 - DNA, 30 bp, Homo sapiens; identical to SEQ ID NO: 67362
  misc_feature 1..30: note = AEKP01149800.1_88-7643:5586-5616
  misc_feature 1..30: note = Hypo
  source 1..30: mol_type = genomic DNA

SEQ ID NO: 101645 - DNA, 158 bp, Homo sapiens; identical to SEQ ID NO: 67363
  misc_feature 1..158: note = AEKP01153556.1_1-5252:377-535
  misc_feature 1..158: note = Hypo
  source 1..158: mol_type = genomic DNA

SEQ ID NO: 101646 - DNA, 42 bp, Homo sapiens; identical to SEQ ID NO: 67364
  misc_feature 1..42: note = AEKP01153556.1_1-5252:995-1037
  misc_feature 1..42: note = Hypo
  source 1..42: mol_type = genomic DNA

SEQ ID NO: 101647 - DNA, 30 bp, Homo sapiens; identical to SEQ ID NO: 67365
  misc_feature 1..30: note = AEKP01160869.1_25046-30418:2610-2640
  misc_feature 1..30: note = Hypo
  source 1..30: mol_type = genomic DNA

SEQ ID NO: 101648 - DNA, 49 bp, Homo sapiens; identical to SEQ ID NO: 67366
  misc_feature 1..49: note = AEKP01166227.1_44013-111583:24167-24216
  misc_feature 1..49: note = Hypo
  source 1..49: mol_type = genomic DNA

SEQ ID NO: 101649 - DNA, 123 bp, Homo sapiens; identical to SEQ ID NO: 38671
  misc_feature 1..123: note = AEKP01168736.1_1-4752:1196-1319
  misc_feature 1..123: note = Hyper
  source 1..123: mol_type = genomic DNA

SEQ ID NO: 101650 - DNA, 280 bp, Homo sapiens; identical to SEQ ID NO: 67368
  misc_feature 1..280: note = AEKP01168736.1_1-4752:1533-1813
  misc_feature 1..280: note = Hyper
  source 1..280: mol_type = genomic DNA

SEQ ID NO: 101651 - DNA, 940 bp, Homo sapiens; identical to SEQ ID NO: 67369
  misc_feature 1..940: note = AEKP01168736.1_1-4752:1873-2813
  misc_feature 1..940: note = Hyper
  source 1..940: mol_type = genomic DNA

SEQ ID NO: 101652 - DNA, 30 bp, Homo sapiens; identical to SEQ ID NO: 67370
  misc_feature 1..30: note = AEKP01171299.1_4392-9704:2569-2599
  misc_feature 1..30: note = Hypo
  source 1..30: mol_type = genomic DNA

SEQ ID NO: 101653 - DNA, 273 bp, Homo sapiens; identical to SEQ ID NO: 67371
  misc_feature 1..273: note = AEKP01171767.1_199-12179:10825-11098
  misc_feature 1..273: note = Hyper
  source 1..273: mol_type = genomic DNA

SEQ ID NO: 101654 - DNA, 30 bp, Homo sapiens; identical to SEQ ID NO: 67372
  misc_feature 1..30: note = AEKP01184864.1_3582-5885:670-700
  misc_feature 1..30: note = Hypo
  source 1..30: mol_type = genomic DNA

SEQ ID NO: 101655 - DNA, 58 bp, Homo sapiens; identical to SEQ ID NO: 46908
  misc_feature 1..58: note = AEKP01188815.1_1-4777:2612-2670
  misc_feature 1..58: note = Hypo
  source 1..58: mol_type = genomic DNA

SEQ ID NO: 101656 - DNA, 30 bp, Homo sapiens; identical to SEQ ID NO: 67374
  misc_feature 1..30: note = AEKP01193750.1_12147-15056:206-236
  misc_feature 1..30: note = Hypo
  source 1..30: mol_type = genomic DNA

SEQ ID NO: 101657 - DNA, 213 bp, Homo sapiens; identical to SEQ ID NO: 67375
  misc_feature 1..213: note = AEKP01196136.1_22995-25251:442-655
  misc_feature 1..213: note = Hypo
  source 1..213: mol_type = genomic DNA

SEQ ID NO: 101658 - DNA, 61 bp, Homo sapiens; identical to SEQ ID NO: 67376
  misc_feature 1..61: note = AEKP01196137.1_1-1039:721-782
  misc_feature 1..61: note = Hypo
  source 1..61: mol_type = genomic DNA

SEQ ID NO: 101659 - DNA, 196 bp, Homo sapiens; identical to SEQ ID NO: 67377
  misc_feature 1..196: note = AEKP01197830.1_1-1408:29-225
  misc_feature 1..196: note = Hyper
  source 1..196: mol_type = genomic DNA

SEQ ID NO: 101660 - DNA, 78 bp, Homo sapiens; identical to SEQ ID NO: 67378
  misc_feature 1..78: note = AEKP01197830.1_1-1408:476-554
  misc_feature 1..78: note = Hyper
  source 1..78: mol_type = genomic DNA

SEQ ID NO: 101661 - DNA, 39 bp, Homo sapiens; identical to SEQ ID NO: 67379
  misc_feature 1..39: note = AEKP01210344.1_1299-2924:730-769
  misc_feature 1..39: note = Hypo
  source 1..39: mol_type = genomic DNA

SEQ ID NO: 101662 - DNA, 30 bp, Homo sapiens; identical to SEQ ID NO: 67380
  misc_feature 1..30: note = AEKP01213519.1_104-1403:796-826
  misc_feature 1..30: note = Hypo
  source 1..30: mol_type = genomic DNA

SEQ ID NO: 101663 - DNA, 23 bp, Homo sapiens
  misc_feature 1..23: note = AEKP01218892.1_1-1226:1010-1033
  misc_feature 1..23: note = Hypo
  source 1..23: mol_type = genomic DNA
gaggctgcaggggcacgggcggg

SEQ ID NO: 101664 - DNA, 26 bp, Homo sapiens
  misc_feature 1..26: note = AEKP01225640.1_1-1497:736-762
  misc_feature 1..26: note = Hypo
  source 1..26: mol_type = genomic DNA
gccctgggacccttccggggttgggc

SEQ ID NO: 101665 - DNA, 54 bp, Homo sapiens; identical to SEQ ID NO: 69899
  misc_feature 1..54: note = chr1:713277-713331
  misc_feature 1..54: note = Hypo
  source 1..54: mol_type = genomic DNA

SEQ ID NO: 101666 - DNA, 30 bp, Homo sapiens; identical to SEQ ID NO: 69974
  misc_feature 1..30: note = chr1:834881-834911
  misc_feature 1..30: note = Hypo
  source 1..30: mol_type = genomic DNA

SEQ ID NO: 101667 - DNA, 315 bp, Homo sapiens; identical to SEQ ID NO: 69975
  misc_feature 1..315: note = chr1:840707-841022
  misc_feature 1..315: note = Hyper
  source 1..315: mol_type = genomic DNA

SEQ ID NO: 101668 - DNA, 49 bp, Homo sapiens; identical to SEQ ID NO: 69990
  misc_feature 1..49: note = chr1:860840-860889
  misc_feature 1..49: note = Hyper
  source 1..49: mol_type = genomic DNA

SEQ ID NO: 101669 - DNA, 224 bp, Homo sapiens; identical to SEQ ID NO: 69991
  misc_feature 1..224: note = chr1:865391-865615
  misc_feature 1..224: note = Hypo
  source 1..224: mol_type = genomic DNA

SEQ ID NO: 101670 - DNA, 30 bp, Homo sapiens; identical to SEQ ID NO: 69999
  misc_feature 1..30: note = chr1:885425-885455
  misc_feature 1..30: note = Hypo
  source 1..30: mol_type = genomic DNA

SEQ ID NO: 101671 - DNA, 53 bp, Homo sapiens; identical to SEQ ID NO: 70001
  misc_feature 1..53: note = chr1:895125-895178
  misc_feature 1..53: note = Hyper
  source 1..53: mol_type = genomic DNA

SEQ ID NO: 101672 - DNA, 48 bp, Homo sapiens; identical to SEQ ID NO: 38688
  misc_feature 1..48: note = chr1:898728-898776
  misc_feature 1..48: note = Hypo
  source 1..48: mol_type = genomic DNA

SEQ ID NO: 101673 - DNA, 30 bp, Homo sapiens; identical to SEQ ID NO: 70007
  misc_feature 1..30: note = chr1:908640-908670
  misc_feature 1..30: note = Hypo
  source 1..30: mol_type = genomic DNA

SEQ ID NO: 101674 - DNA, 1282 bp, Homo sapiens; identical to SEQ ID NO: 70035
  misc_feature 1..1282: note = chr1:913503-914785
  misc_feature 1..1282: note = Hypo
  source 1..1282: mol_type = genomic DNA

SEQ ID NO: 101675 - DNA, 210 bp, Homo sapiens; identical to SEQ ID NO: 70037
  misc_feature 1..210: note = chr1:918367-918577
  misc_feature 1..210: note = Hypo
  source 1..210: mol_type = genomic DNA

SEQ ID NO: 101676 - DNA, 57 bp, Homo sapiens; identical to SEQ ID NO: 70047
  misc_feature 1..57: note = chr1:935070-935127
  misc_feature 1..57: note = Hyper
  source 1..57: mol_type = genomic DNA

SEQ ID NO: 101677 - DNA, 105 bp, Homo sapiens; identical to SEQ ID NO: 70049
  misc_feature 1..105: note = chr1:936563-936668
  misc_feature 1..105: note = Hyper
  source 1..105: mol_type = genomic DNA

SEQ ID NO: 101678 - DNA, 365 bp, Homo sapiens; identical to SEQ ID NO: 70055
  misc_feature 1..365: note = chr1:942313-942678
  misc_feature 1..365: note = Hypo
  source 1..365: mol_type = genomic DNA

SEQ ID NO: 101679 - DNA, 30 bp, Homo sapiens; identical to SEQ ID NO: 38692
  misc_feature 1..30: note = chr1:957607-957637
  misc_feature 1..30: note = Hypo
  source 1..30: mol_type = genomic DNA

SEQ ID NO: 101680 - DNA, 90 bp, Homo sapiens; identical to SEQ ID NO: 70075
  misc_feature 1..90: note = chr1:975817-975907
  misc_feature 1..90: note = Hyper
  source 1..90: mol_type = genomic DNA

SEQ ID NO: 101681 - DNA, 30 bp, Homo sapiens; identical to SEQ ID NO: 70076
  misc_feature 1..30: note = chr1:979970-980000
  misc_feature 1..30: note = Hypo
  source 1..30: mol_type = genomic DNA

SEQ ID NO: 101682 - DNA, 34 bp, Homo sapiens; identical to SEQ ID NO: 70079
  misc_feature 1..34: note = chr1:984367-984401
  misc_feature 1..34: note = Hypo
  source 1..34: mol_type = genomic DNA

SEQ ID NO: 101683 - DNA, 70 bp, Homo sapiens; identical to SEQ ID NO: 70080
  misc_feature 1..70: note = chr1:984667-984737
  misc_feature 1..70: note = Hypo
  source 1..70: mol_type = genomic DNA

SEQ ID NO: 101684 - DNA, 43 bp, Homo sapiens; identical to SEQ ID NO: 70085
  misc_feature 1..43: note = chr1:985145-985188
  misc_feature 1..43: note = Hypo
  source 1..43: mol_type = genomic DNA

SEQ ID NO: 101685 - DNA, 404 bp, Homo sapiens; identical to SEQ ID NO: 70090
  misc_feature 1..404: note = chr1:986504-986908
  misc_feature 1..404: note = Hypo
  source 1..404: mol_type = genomic DNA

SEQ ID NO: 101686 - DNA, 42 bp, Homo sapiens
  misc_feature 1..42: note = chr1:1007447-1007489
  misc_feature 1..42: note = Hypo
  source 1..42: mol_type = genomic DNA
gcttgctcaaacccacgtccacgcatacgaaaccgggctcgc

SEQ ID NO: 101687 - DNA, 50 bp, Homo sapiens; identical to SEQ ID NO: 67404
  misc_feature 1..50: note = chr1:1025254-1025304
  misc_feature 1..50: note = Hypo
  source 1..50: mol_type = genomic DNA

SEQ ID NO: 101688 - DNA, 30 bp, Homo sapiens; identical to SEQ ID NO: 38694
  misc_feature 1..30: note = chr1:1045970-1046000
  misc_feature 1..30: note = Hypo
  source 1..30: mol_type = genomic DNA

SEQ ID NO: 101689 - DNA, 297 bp, Homo sapiens; identical to SEQ ID NO: 67410
  misc_feature 1..297: note = chr1:1049888-1050185
  misc_feature 1..297: note = Hypo
  source 1..297: mol_type = genomic DNA

SEQ ID NO: 101690 - DNA, 33 bp, Homo sapiens; identical to SEQ ID NO: 67412
  misc_feature 1..33: note = chr1:1053775-1053808
  misc_feature 1..33: note = Hypo
  source 1..33: mol_type = genomic DNA

SEQ ID NO: 101691 - DNA, 30 bp, Homo sapiens; identical to SEQ ID NO: 67413
  misc_feature 1..30: note = chr1:1056382-1056412
  misc_feature 1..30: note = Hypo
  source 1..30: mol_type = genomic DNA

SEQ ID NO: 101692 - DNA, 30 bp, Homo sapiens; identical to SEQ ID NO: 67414
  misc_feature 1..30: note = chr1:1058888-1058918
  misc_feature 1..30: note = Hypo
  source 1..30: mol_type = genomic DNA

SEQ ID NO: 101693 - DNA, 37 bp, Homo sapiens; identical to SEQ ID NO: 67416
  misc_feature 1..37: note = chr1:1066357-1066394
  misc_feature 1..37: note = Hypo
  source 1..37: mol_type = genomic DNA

SEQ ID NO: 101694 - DNA, 169 bp, Homo sapiens; identical to SEQ ID NO: 67417
  misc_feature 1..169: note = chr1:1067634-1067803
  misc_feature 1..169: note = Hypo
  source 1..169: mol_type = genomic DNA

SEQ ID NO: 101695 - DNA, 35 bp, Homo sapiens; identical to SEQ ID NO: 67418
  misc_feature 1..35: note = chr1:1068726-1068761
  misc_feature 1..35: note = Hypo
  source 1..35: mol_type = genomic DNA

SEQ ID NO: 101696 - DNA, 462 bp, Homo sapiens; identical to SEQ ID NO: 67425
  misc_feature 1..462: note = chr1:1080476-1080938
  misc_feature 1..462: note = Hypo
  source 1..462: mol_type = genomic DNA

SEQ ID NO: 101697 - DNA, 57 bp, Homo sapiens; identical to SEQ ID NO: 67427
  misc_feature 1..57: note = chr1:1083618-1083675
  misc_feature 1..57: note = Hypo
  source 1..57: mol_type = genomic DNA

SEQ ID NO: 101698 - DNA, 42 bp, Homo sapiens; identical to SEQ ID NO: 67443
  misc_feature 1..42: note = chr1:1094962-1095004
  misc_feature 1..42: note = Hypo
  source 1..42: mol_type = genomic DNA

SEQ ID NO: 101699 - DNA, 30 bp, Homo sapiens; identical to SEQ ID NO: 67444
  misc_feature 1..30: note = chr1:1095467-1095497
  misc_feature 1..30: note = Hypo
  source 1..30: mol_type = genomic DNA

SEQ ID NO: 101700 - DNA, 449 bp, Homo sapiens; identical to SEQ ID NO: 67465
  misc_feature 1..449: note = chr1:1102215-1102664
  misc_feature 1..449: note = Hypo
  source 1..449: mol_type = genomic DNA

SEQ ID NO: 101701 - DNA, 378 bp, Homo sapiens; identical to SEQ ID NO: 67525
  misc_feature 1..378: note = chr1:1145504-1145882
  misc_feature 1..378: note = Hypo
  source 1..378: mol_type = genomic DNA

SEQ ID NO: 101702 - DNA, 240 bp, Homo sapiens; identical to SEQ ID NO: 67526
  misc_feature 1..240: note = chr1:1146646-1146886
  misc_feature 1..240: note = Hypo
  source 1..240: mol_type = genomic DNA

SEQ ID NO: 101703 - DNA, 634 bp, Homo sapiens; identical to SEQ ID NO: 67557
  misc_feature 1..634: note = chr1:1168350-1168984
  misc_feature 1..634: note = Hypo
  source 1..634: mol_type = genomic DNA

SEQ ID NO: 101704 - DNA, 30 bp, Homo sapiens; identical to SEQ ID NO: 67560
  misc_feature 1..30: note = chr1:1172140-1172170
  misc_feature 1..30: note = Hypo
  source 1..30: mol_type = genomic DNA

SEQ ID NO: 101705 - DNA, 190 bp, Homo sapiens; identical to SEQ ID NO: 67562
  misc_feature 1..190: note = chr1:1173900-1174090
  misc_feature 1..190: note = Hypo
  source 1..190: mol_type = genomic DNA

SEQ ID NO: 101706 - DNA, 51 bp, Homo sapiens; identical to SEQ ID NO: 67564
  misc_feature 1..51: note = chr1:1174339-1174390
  misc_feature 1..51: note = Hypo
  source 1..51: mol_type = genomic DNA

SEQ ID NO: 101707 - DNA, 30 bp, Homo sapiens; identical to SEQ ID NO: 67569
  misc_feature 1..30: note = chr1:1177998-1178028
  misc_feature 1..30: note = Hypo
  source 1..30: mol_type = genomic DNA

SEQ ID NO: 101708 - DNA, 30 bp, Homo sapiens; identical to SEQ ID NO: 67571
  misc_feature 1..30: note = chr1:1178721-1178751
  misc_feature 1..30: note = Hypo
  source 1..30: mol_type = genomic DNA

SEQ ID NO: 101709 - DNA, 30 bp, Homo sapiens; identical to SEQ ID NO: 67572
  misc_feature 1..30: note = chr1:1179038-1179068
  misc_feature 1..30: note = Hypo
  source 1..30: mol_type = genomic DNA

SEQ ID NO: 101710 - DNA, 186 bp, Homo sapiens; identical to SEQ ID NO: 67583
  misc_feature 1..186: note = chr1:1190209-1190395
  misc_feature 1..186: note = Hypo
  source 1..186: mol_type = genomic DNA

SEQ ID NO: 101711 - DNA, 23 bp, Homo sapiens
  misc_feature 1..23: note = chr1:1218784-1218807
  misc_feature 1..23: note = Hypo
  source 1..23: mol_type = genomic DNA
atggggcttctgggccgggcacg

SEQ ID NO: 101712 - DNA, 30 bp, Homo sapiens; identical to SEQ ID NO: 67632
  misc_feature 1..30: note = chr1:1222237-1222267
  misc_feature 1..30: note = Hypo
  source 1..30: mol_type = genomic DNA

SEQ ID NO: 101713 - DNA, 44 bp, Homo sapiens; identical to SEQ ID NO: 67635
  misc_feature 1..44: note = chr1:1223161-1223205
  misc_feature 1..44: note = Hypo
  source 1..44: mol_type = genomic DNA

SEQ ID NO: 101714 - DNA, 83 bp, Homo sapiens; identical to SEQ ID NO: 67636
  misc_feature 1..83: note = chr1:1223512-1223595
  misc_feature 1..83: note = Hypo
  source 1..83: mol_type = genomic DNA

SEQ ID NO: 101715 - DNA, 30 bp, Homo sapiens; identical to SEQ ID NO: 67638
  misc_feature 1..30: note = chr1:1226147-1226177
  misc_feature 1..30: note = Hypo
  source 1..30: mol_type = genomic DNA

SEQ ID NO: 101716 - DNA, 64 bp, Homo sapiens; identical to SEQ ID NO: 67640
  misc_feature 1..64: note = chr1:1234696-1234760
  misc_feature 1..64: note = Hypo
  source 1..64: mol_type = genomic DNA

SEQ ID NO: 101717 - DNA, 103 bp, Homo sapiens; identical to SEQ ID NO: 38707
  misc_feature 1..103: note = chr1:1235178-1235281
  misc_feature 1..103: note = Hypo
  source 1..103: mol_type = genomic DNA

SEQ ID NO: 101718 - DNA, 177 bp, Homo sapiens; identical to SEQ ID NO: 38708
  misc_feature 1..177: note = chr1:1235901-1236078
  misc_feature 1..177: note = Hypo
  source 1..177: mol_type = genomic DNA

SEQ ID NO: 101719 - DNA, 252 bp, Homo sapiens; identical to SEQ ID NO: 67643
  misc_feature 1..252: note = chr1:1238230-1238482
  misc_feature 1..252: note = Hypo
  source 1..252: mol_type = genomic DNA

SEQ ID NO: 101720 - DNA, 188 bp, Homo sapiens; identical to SEQ ID NO: 67644
  misc_feature 1..188: note = chr1:1239479-1239667
  misc_feature 1..188: note = Hypo
  source 1..188: mol_type = genomic DNA

SEQ ID NO: 101721 - DNA, 345 bp, Homo sapiens; identical to SEQ ID NO: 67645
  misc_feature 1..345: note = chr1:1245007-1245352
  misc_feature 1..345: note = Hypo
  source 1..345: mol_type = genomic DNA

SEQ ID NO: 101722 - DNA, 30 bp, Homo sapiens; identical to SEQ ID NO: 67646
  misc_feature 1..30: note = chr1:1247668-1247698
  misc_feature 1..30: note = Hypo
  source 1..30: mol_type = genomic DNA

SEQ ID NO: 101723 - DNA, 35 bp, Homo sapiens; identical to SEQ ID NO: 67647
  misc_feature 1..35: note = chr1:1253245-1253280
  misc_feature 1..35: note = Hypo
  source 1..35: mol_type = genomic DNA

SEQ ID NO: 101724 - DNA, 35 bp, Homo sapiens; identical to SEQ ID NO: 67648
  misc_feature 1..35: note = chr1:1253520-1253555
  misc_feature 1..35: note = Hypo
  source 1..35: mol_type = genomic DNA

SEQ ID NO: 101725 - DNA, 100 bp, Homo sapiens; identical to SEQ ID NO: 67650
  misc_feature 1..100: note = chr1:1257399-1257499
  misc_feature 1..100: note = Hypo
  source 1..100: mol_type = genomic DNA

SEQ ID NO: 101726 - DNA, 30 bp, Homo sapiens; identical to SEQ ID NO: 67651
  misc_feature 1..30: note = chr1:1264857-1264887
  misc_feature 1..30: note = Hypo
  source 1..30: mol_type = genomic DNA

SEQ ID NO: 101727 - DNA, 30 bp, Homo sapiens; identical to SEQ ID NO: 67653
  misc_feature 1..30: note = chr1:1266025-1266055
  misc_feature 1..30: note = Hypo
  source 1..30: mol_type = genomic DNA

SEQ ID NO: 101728 - DNA, 1138 bp, Homo sapiens; identical to SEQ ID NO: 67654
  misc_feature 1..1138: note = chr1:1267047-1268185
  misc_feature 1..1138: note = Hypo
  source 1..1138: mol_type = genomic DNA

SEQ ID NO: 101729 - DNA, 30 bp, Homo sapiens; identical to SEQ ID NO: 67655
  misc_feature 1..30: note = chr1:1273471-1273501
  misc_feature 1..30: note = Hypo
  source 1..30: mol_type = genomic DNA

SEQ ID NO: 101730 - DNA, 30 bp, Homo sapiens; identical to SEQ ID NO: 67657
  misc_feature 1..30: note = chr1:1280896-1280926
  misc_feature 1..30: note = Hypo
  source 1..30: mol_type = genomic DNA

SEQ ID NO: 101731 - DNA, 82 bp, Homo sapiens; identical to SEQ ID NO: 67658
  misc_feature 1..82: note = chr1:1308761-1308843
  misc_feature 1..82: note = Hypo
  source 1..82: mol_type = genomic DNA

SEQ ID NO: 101732 - DNA, 253 bp, Homo sapiens; identical to SEQ ID NO: 67659
  misc_feature 1..253: note = chr1:1309067-1309320
  misc_feature 1..253: note = Hypo
  source 1..253: mol_type = genomic DNA

SEQ ID NO: 101733 - DNA, 93 bp, Homo sapiens; identical to SEQ ID NO: 67660
  misc_feature 1..93: note = chr1:1341737-1341830
  misc_feature 1..93: note = Hypo
  source 1..93: mol_type = genomic DNA

SEQ ID NO: 101734 - DNA, 30 bp, Homo sapiens; identical to SEQ ID NO: 67661
  misc_feature 1..30: note = chr1:1344048-1344078
  misc_feature 1..30: note = Hypo
  source 1..30: mol_type = genomic DNA

SEQ ID NO: 101735 - DNA, 215 bp, Homo sapiens; identical to SEQ ID NO: 67662
  misc_feature 1..215: note = chr1:1355522-1355737
  misc_feature 1..215: note = Hyper
  source 1..215: mol_type = genomic DNA

SEQ ID NO: 101736 - DNA, 30 bp, Homo sapiens; identical to SEQ ID NO: 67663
  misc_feature 1..30: note = chr1:1356905-1356935
  misc_feature 1..30: note = Hypo
  source 1..30: mol_type = genomic DNA

SEQ ID NO: 101737 - DNA, 46 bp, Homo sapiens; identical to SEQ ID NO: 38715
  misc_feature 1..46: note = chr1:1363856-1363902
  misc_feature 1..46: note = Hypo
  source 1..46: mol_type = genomic DNA

SEQ ID NO: 101738 - DNA, 132 bp, Homo sapiens; identical to SEQ ID NO: 67665
  misc_feature 1..132: note = chr1:1371107-1371239
  misc_feature 1..132: note = Hyper
  source 1..132: mol_type = genomic DNA

SEQ ID NO: 101739 - DNA, 112 bp, Homo sapiens; identical to SEQ ID NO: 67680
  misc_feature 1..112: note = chr1:1471673-1471785
  misc_feature 1..112: note = Hypo
  source 1..112: mol_type = genomic DNA

SEQ ID NO: 101740 - DNA, 1096 bp, Homo sapiens
  misc_feature 1..1096: note = chr1:1475243-1476339
  misc_feature 1..1096: note = Hyper
  source 1..1096: mol_type = genomic DNA
ccggggtcggggcagcgcaagcggggagcgagagcgcaggccggggtgaggggagcgtaggccttggtagggggagcgcagcgggtatggggatcgcaggctggggaggggagcgcaggccggggtggggggagcgcaggcccgggaggggaccgcgggccggggagggggaagcgcaggccggggtggggggagcgtaggccggagagaggagcgtagggagtgtggggatcgcaggttggggaggggagcggaggccggggtgggggagcgcaggccggggaggggagcgcaggccggggaggggagcgcaggccggggaggggagcgcaggccgcacgggcggtaaacaaggcgcgggaggtgggccaggcggcgcgcgcgggcggggagcagggggcgcgcgcgggaagcccctccgctcaccatcacgaccgacgcccccagaatcatgaagatcatggtgttcgcgctcatggacatcgggcggggccgggccgggccggagcgccgccccccggccccggcgcccccccggccccggcccgatgctgagcccccgccgcctccgcagaggtcagcgcttccctggatcgtccgccgccgctcgctgcaaccccggcaccggccggggggaggaggcgcgggggggggggcgccggggagggacgcggggcctttctggggtctctcggcccggcccgccgcgctccgctccgccctcgggtcctccctgcgatgcgctcggctcggctcgactcggctccgctcggctccggccccctccctgcctcctcctccctcctcccccctccctccccgccgccttcctccgcctctcgggagggaccgcgcagaccgcaggccgccccgtgccagcgccgggaggagaccgccatcccccggacgccggccgggacccctccccgggagcctcggcttcgcgtcccgccccagtctggtcagacccagccccggtggcctgtccggtgaccctggacgccagtcctccggtcctggaggggcgccgaggcccttcccgccccactgctccgccctacgtcctggactcccaggtcgccgggtgcgggactgc

SEQ ID NO: 101741 - DNA, 30 bp, Homo sapiens; identical to SEQ ID NO: 38716
  misc_feature 1..30: note = chr1:1483034-1483064
  misc_feature 1..30: note = Hypo
  source 1..30: mol_type = genomic DNA

SEQ ID NO: 101742 - DNA, 40 bp, Homo sapiens; identical to SEQ ID NO: 67690
  misc_feature 1..40: note = chr1:1502515-1502555
  misc_feature 1..40: note = Hypo
  source 1..40: mol_type = genomic DNA

SEQ ID NO: 101743 - DNA, 375 bp, Homo sapiens; identical to SEQ ID NO: 67736
  misc_feature 1..375: note = chr1:1535001-1535376
  misc_feature 1..375: note = Hyper
  source 1..375: mol_type = genomic DNA

SEQ ID NO: 101744 - DNA, 193 bp, Homo sapiens; identical to SEQ ID NO: 67739
  misc_feature 1..193: note = chr1:1535748-1535941
  misc_feature 1..193: note = Hyper
  source 1..193: mol_type = genomic DNA

SEQ ID NO: 101745 - DNA, 30 bp, Homo sapiens; identical to SEQ ID NO: 67787
  misc_feature 1..30: note = chr1:1552463-1552493
  misc_feature 1..30: note = Hypo
  source 1..30: mol_type = genomic DNA

SEQ ID NO: 101746 - DNA, 179 bp, Homo sapiens; identical to SEQ ID NO: 67820
  misc_feature 1..179: note = chr1:1563080-1563259
  misc_feature 1..179: note = Hypo
  source 1..179: mol_type = genomic DNA

SEQ ID NO: 101747 - DNA, 103 bp, Homo sapiens; identical to SEQ ID NO: 38718
  misc_feature 1..103: note = chr1:1563663-1563766
  misc_feature 1..103: note = Hypo
  source 1..103: mol_type = genomic DNA

SEQ ID NO: 101748 - DNA, 307 bp, Homo sapiens
  misc_feature 1..307: note = chr1:1566672-1566979
  misc_feature 1..307: note = Hyper
  source 1..307: mol_type = genomic DNA
tcgcgcctggacgccggccgccccgtcgaacctttgggtctccgagctccccgcccccgcccccaatcaggaccggtccagacctccaggcccggcgcttagctccgtttcccgtccctcccgtctccctctcccctttgctggggcctagccggggatttaggagccacacaccctccacctcacgcgctaccctccacggggcttcccgcagccagggcccgccccttcccggctccccgggagaccctggcaagttccctccctccgccccgcaacctggcaccctccgcggcccttgcctacc

SEQ ID NO: 101749 - DNA, 684 bp, Homo sapiens
  misc_feature 1..684: note = chr1:1567229-1567913
  misc_feature 1..684: note = Hyper
  source 1..684: mol_type = genomic DNA
ctaccctttcctaagcgggagccctggcgctgcccttcccgggctgcctggggccctcttcgctcccccctccgaggaccccgcccagcaggccatgcccaggcctctgcccctggcccacgggacgcgggtccccatgcccccggctggagacagcaggcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcaggtgagcggcgggggggaggccaggtgccgggttgggggggtcctcacgtctgtgggtctggtctatcggggggcccgcaggacgtgtgcggggtgtgcggggtgtttgagggtccggatgtgcgtcccgaggtcggagggttggacgcccctgtgtccag

SEQ ID NO: 101750 - DNA, 161 bp, Homo sapiens; identical to SEQ ID NO: 68008
  misc_feature 1..161: note = chr1:1625727-1625888
  misc_feature 1..161: note = Hypo
  source 1..161: mol_type = genomic DNA

SEQ ID NO: 101751 - DNA, 25 bp, Homo sapiens
  misc_feature 1..25: note = chr1:1671766-1671791
  misc_feature 1..25: note = Hypo
  source 1..25: mol_type = genomic DNA
tctttttttttgagacgggagtctc

SEQ ID NO: 101752 - DNA, 40 bp, Homo sapiens; identical to SEQ ID NO: 68127
  misc_feature 1..40: note = chr1:1767616-1767656
  misc_feature 1..40: note = Hypo
  source 1..40: mol_type = genomic DNA

SEQ ID NO: 101753 - DNA, 160 bp, Homo sapiens; identical to SEQ ID NO: 68232
  misc_feature 1..160: note = chr1:1856211-1856371
  misc_feature 1..160: note = Hypo
  source 1..160: mol_type = genomic DNA

SEQ ID NO: 101754 - DNA, 30 bp, Homo sapiens; identical to SEQ ID NO: 68233
  misc_feature 1..30: note = chr1:1857232-1857262
  misc_feature 1..30: note = Hypo
  source 1..30: mol_type = genomic DNA

SEQ ID NO: 101755 - DNA, 30 bp, Homo sapiens; identical to SEQ ID NO: 68234
  misc_feature 1..30: note = chr1:1857706-1857736
  misc_feature 1..30: note = Hypo
  source 1..30: mol_type = genomic DNA

SEQ ID NO: 101756 - DNA, 67 bp, Homo sapiens; identical to SEQ ID NO: 68235
  misc_feature 1..67: note = chr1:1861815-1861882
  misc_feature 1..67: note = Hypo
  source 1..67: mol_type = genomic DNA

SEQ ID NO: 101757 - DNA, 61 bp, Homo sapiens; identical to SEQ ID NO: 68241
  misc_feature 1..61: note = chr1:1874726-1874787
  misc_feature 1..61: note = Hypo
  source 1..61: mol_type = genomic DNA

SEQ ID NO: 101758 - DNA, 30 bp, Homo sapiens; identical to SEQ ID NO: 68245
  misc_feature 1..30: note = chr1:1888198-1888228
  misc_feature 1..30: note = Hypo
  source 1..30: mol_type = genomic DNA

SEQ ID NO: 101759 - DNA, 30 bp, Homo sapiens; identical to SEQ ID NO: 68279
  misc_feature 1..30: note = chr1:1905791-1905821
  misc_feature 1..30: note = Hypo
  source 1..30: mol_type = genomic DNA

SEQ ID NO: 101760 - DNA, 44 bp, Homo sapiens; identical to SEQ ID NO: 68281
  misc_feature 1..44: note = chr1:1910323-1910367
  misc_feature 1..44: note = Hypo
  source 1..44: mol_type = genomic DNA

SEQ ID NO: 101761 - DNA, 30 bp, Homo sapiens; identical to SEQ ID NO: 68284
  misc_feature 1..30: note = chr1:1914161-1914191
  misc_feature 1..30: note = Hypo
  source 1..30: mol_type = genomic DNA

SEQ ID NO: 101762 - DNA, 558 bp, Homo sapiens; identical to SEQ ID NO: 68285
  misc_feature 1..558: note = chr1:1914559-1915117
  misc_feature 1..558: note = Hypo
  source 1..558: mol_type = genomic DNA

SEQ ID NO: 101763 - DNA, 505 bp, Homo sapiens
  misc_feature 1..505: note = chr1:1935065-1935570
  misc_feature 1..505: note = Hyper
  source 1..505: mol_type = genomic DNA
gttctgcctggggggcgggggtcaaacccttccagctcagccccagggtcaaacgcatccgcccccacacccacctctggctggcctgggtcccaggttctcgggctccggaggcacagacaccccgggctgctcaggcaggcggcggtccttggcgattgccctccgcggcgccggcggcgtggtttggggcgggcagctccatggcaacggaagactccatcgtggccggagggggagcctcgcccgttctgctccccggctggagcgggtggtttggtccgacccaccaccgaccgcgcgggccggggccggggcaaggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagaggaccggggcgggtgcatg

SEQ ID NO: 101764 - DNA, 981 bp, Homo sapiens; identical to SEQ ID NO: 68299
  misc_feature 1..981: note = chr1:1950396-1951377
  misc_feature 1..981: note = Hyper
  source 1..981: mol_type = genomic DNA

SEQ ID NO: 101765 - DNA, 30 bp, Homo sapiens; identical to SEQ ID NO: 68300
  misc_feature 1..30: note = chr1:1953110-1953140
  misc_feature 1..30: note = Hypo
  source 1..30: mol_type = genomic DNA

SEQ ID NO: 101766 - DNA, 30 bp, Homo sapiens; identical to SEQ ID NO: 68302
  misc_feature 1..30: note = chr1:1960572-1960602
  misc_feature 1..30: note = Hypo
  source 1..30: mol_type = genomic DNA

SEQ ID NO: 101767 - DNA, 74 bp, Homo sapiens; identical to SEQ ID NO: 68303
  misc_feature 1..74: note = chr1:1961524-1961598
  misc_feature 1..74: note = Hypo
  source 1..74: mol_type = genomic DNA

SEQ ID NO: 101768 - DNA, 74 bp, Homo sapiens; identical to SEQ ID NO: 68310
  misc_feature 1..74: note = chr1:1974645-1974719
  misc_feature 1..74: note = Hypo
  source 1..74: mol_type = genomic DNA

SEQ ID NO: 101769 - DNA, 116 bp, Homo sapiens; identical to SEQ ID NO: 68331
  misc_feature 1..116: note = chr1:1982311-1982427
  misc_feature 1..116: note = Hyper
  source 1..116: mol_type = genomic DNA

SEQ ID NO: 101770 - DNA, 157 bp, Homo sapiens; identical to SEQ ID NO: 68332
  misc_feature 1..157: note = chr1:1986234-1986391
  misc_feature 1..157: note = Hypo
  source 1..157: mol_type = genomic DNA

SEQ ID NO: 101771 - DNA, 177 bp, Homo sapiens; identical to SEQ ID NO: 38728
  misc_feature 1..177: note = chr1:2013405-2013582
  misc_feature 1..177: note = Hypo
  source 1..177: mol_type = genomic DNA

SEQ ID NO: 101772 - DNA, 30 bp, Homo sapiens; identical to SEQ ID NO: 68360
  misc_feature 1..30: note = chr1:2013995-2014025
  misc_feature 1..30: note = Hypo
  source 1..30: mol_type = genomic DNA

SEQ ID NO: 101773 - DNA, 327 bp, Homo sapiens; identical to SEQ ID NO: 38729
  misc_feature 1..327: note = chr1:2066352-2066679
  misc_feature 1..327: note = Hypo
  source 1..327: mol_type = genomic DNA

SEQ ID NO: 101774 - DNA, 349 bp, Homo sapiens; identical to SEQ ID NO: 68523
  misc_feature 1..349: note = chr1:2125166-2125515
  misc_feature 1..349: note = Hypo
  source 1..349: mol_type = genomic DNA

SEQ ID NO: 101775 - DNA, 30 bp, Homo sapiens; identical to SEQ ID NO: 68527
  misc_feature 1..30: note = chr1:2129896-2129926
  misc_feature 1..30: note = Hypo
  source 1..30: mol_type = genomic DNA

SEQ ID NO: 101776 - DNA, 44 bp, Homo sapiens; identical to SEQ ID NO: 25996
  misc_feature 1..44: note = chr1:2136044-2136088
  misc_feature 1..44: note = Hyper
  source 1..44: mol_type = genomic DNA

SEQ ID NO: 101777 - DNA, 183 bp, Homo sapiens; identical to SEQ ID NO: 68533
  misc_feature 1..183: note = chr1:2136856-2137039
  misc_feature 1..183: note = Hyper
  source 1..183: mol_type = genomic DNA

SEQ ID NO: 101778 - DNA, 88 bp, Homo sapiens; identical to SEQ ID NO: 38731
  misc_feature 1..88: note = chr1:2141596-2141684
  misc_feature 1..88: note = Hypo
  source 1..88: mol_type = genomic DNA

SEQ ID NO: 101779 - DNA, 49 bp, Homo sapiens; identical to SEQ ID NO: 68571
  misc_feature 1..49: note = chr1:2170934-2170983
  misc_feature 1..49: note = Hypo
  source 1..49: mol_type = genomic DNA

SEQ ID NO: 101780 - DNA, 35 bp, Homo sapiens; identical to SEQ ID NO: 68663
  misc_feature 1..35: note = chr1:2253171-2253206
  misc_feature 1..35: note = Hypo
  source 1..35: mol_type = genomic DNA

SEQ ID NO: 101781 - DNA, 370 bp, Homo sapiens; identical to SEQ ID NO: 68673
  misc_feature 1..370: note = chr1:2263053-2263423
  misc_feature 1..370: note = Hypo
  source 1..370: mol_type = genomic DNA

SEQ ID NO: 101782 - DNA, 81 bp, Homo sapiens; identical to SEQ ID NO: 68677
  misc_feature 1..81: note = chr1:2266113-2266194
  misc_feature 1..81: note = Hypo
  source 1..81: mol_type = genomic DNA

SEQ ID NO: 101783 - DNA, 597 bp, Homo sapiens; identical to SEQ ID NO: 68680
  misc_feature 1..597: note = chr1:2267155-2267752
  misc_feature 1..597: note = Hypo
  source 1..597: mol_type = genomic DNA

SEQ ID NO: 101784 - DNA, 30 bp, Homo sapiens; identical to SEQ ID NO: 38735
  misc_feature 1..30: note = chr1:2268713-2268743
  misc_feature 1..30: note = Hypo
  source 1..30: mol_type = genomic DNA

SEQ ID NO: 101785 - DNA, 52 bp, Homo sapiens; identical to SEQ ID NO: 68698
  misc_feature 1..52: note = chr1:2271392-2271444
  misc_feature 1..52: note = Hypo
  source 1..52: mol_type = genomic DNA

SEQ ID NO: 101786 - DNA, 42 bp, Homo sapiens; identical to SEQ ID NO: 68701
  misc_feature 1..42: note = chr1:2273867-2273909
  misc_feature 1..42: note = Hypo
  source 1..42: mol_type = genomic DNA

SEQ ID NO: 101787 - DNA, 54 bp, Homo sapiens; identical to SEQ ID NO: 68702
  misc_feature 1..54: note = chr1:2274776-2274830
  misc_feature 1..54: note = Hypo
  source 1..54: mol_type = genomic DNA

SEQ ID NO: 101788 - DNA, 196 bp, Homo sapiens; identical to SEQ ID NO: 68704
  misc_feature 1..196: note = chr1:2275639-2275835
  misc_feature 1..196: note = Hypo
  source 1..196: mol_type = genomic DNA

SEQ ID NO: 101789 - DNA, 111 bp, Homo sapiens; identical to SEQ ID NO: 38737
  misc_feature 1..111: note = chr1:2276089-2276200
  misc_feature 1..111: note = Hypo
  source 1..111: mol_type = genomic DNA

SEQ ID NO: 101790 - DNA, 154 bp, Homo sapiens; identical to SEQ ID NO: 68808
  misc_feature 1..154: note = chr1:2304327-2304481
  misc_feature 1..154: note = Hypo
  source 1..154: mol_type = genomic DNA

SEQ ID NO: 101791 - DNA, 268 bp, Homo sapiens; identical to SEQ ID NO: 68813
  misc_feature 1..268: note = chr1:2307626-2307894
  misc_feature 1..268: note = Hypo
  source 1..268: mol_type = genomic DNA

SEQ ID NO: 101792 - DNA, 553 bp, Homo sapiens; identical to SEQ ID NO: 38740
  misc_feature 1..553: note = chr1:2308105-2308658
  misc_feature 1..553: note = Hypo
  source 1..553: mol_type = genomic DNA

SEQ ID NO: 101793 - DNA, 48 bp, Homo sapiens; identical to SEQ ID NO: 68816
  misc_feature 1..48: note = chr1:2309850-2309898
  misc_feature 1..48: note = Hypo
  source 1..48: mol_type = genomic DNA

SEQ ID NO: 101794 - DNA, 96 bp, Homo sapiens; identical to SEQ ID NO: 68818
  misc_feature 1..96: note = chr1:2310148-2310244
  misc_feature 1..96: note = Hypo
  source 1..96: mol_type = genomic DNA

SEQ ID NO: 101795 - DNA, 413 bp, Homo sapiens; identical to SEQ ID NO: 68834
  misc_feature 1..413: note = chr1:2316053-2316466
  misc_feature 1..413: note = Hypo
  source 1..413: mol_type = genomic DNA

SEQ ID NO: 101796 - DNA, 30 bp, Homo sapiens; identical to SEQ ID NO: 68840
  misc_feature 1..30: note = chr1:2330625-2330655
  misc_feature 1..30: note = Hypo
  source 1..30: mol_type = genomic DNA

SEQ ID NO: 101797 - DNA, 33 bp, Homo sapiens; identical to SEQ ID NO: 38743
  misc_feature 1..33: note = chr1:2331363-2331396
  misc_feature 1..33: note = Hypo
  source 1..33: mol_type = genomic DNA

SEQ ID NO: 101798 - DNA, 30 bp, Homo sapiens; identical to SEQ ID NO: 38744
  misc_feature 1..30: note = chr1:2336335-2336365
  misc_feature 1..30: note = Hypo
  source 1..30: mol_type = genomic DNA

SEQ ID NO: 101799 - DNA, 174 bp, Homo sapiens; identical to SEQ ID NO: 38745
  misc_feature 1..174: note = chr1:2338063-2338237
  misc_feature 1..174: note = Hypo
  source 1..174: mol_type = genomic DNA

SEQ ID NO: 101800 - DNA, 79 bp, Homo sapiens; identical to SEQ ID NO: 68868
  misc_feature 1..79: note = chr1:2351881-2351960
  misc_feature 1..79: note = Hypo
  source 1..79: mol_type = genomic DNA

SEQ ID NO: 101801 - DNA, 30 bp, Homo sapiens; identical to SEQ ID NO: 68881
  misc_feature 1..30: note = chr1:2358761-2358791
  misc_feature 1..30: note = Hypo
  source 1..30: mol_type = genomic DNA

SEQ ID NO: 101802 - DNA, 348 bp, Homo sapiens; identical to SEQ ID NO: 14181
  misc_feature 1..348: note = chr1:2359972-2360320
  misc_feature 1..348: note = Hypo
  source 1..348: mol_type = genomic DNA

SEQ ID NO: 101803 - DNA, 807 bp, Homo sapiens
  misc_feature 1..807: note = chr1:2374834-2375641
  misc_feature 1..807: note = Hyper
  source 1..807: mol_type = genomic DNA
ttggcttcttccagcgcctgggcaaacgcccagcctggagatgggaagcgctctcggccccgcccccttcccggtcccgccggctggggccacggggagccggagggaggcggagggggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggtgcggggtgagggatct

SEQ ID NO: 101804 - DNA, 146 bp, Homo sapiens; identical to SEQ ID NO: 68928
  misc_feature 1..146: note = chr1:2382686-2382832
  misc_feature 1..146: note = Hypo
  source 1..146: mol_type = genomic DNA

SEQ ID NO: 101805 - DNA, 195 bp, Homo sapiens; identical to SEQ ID NO: 38748
  misc_feature 1..195: note = chr1:2396998-2397193
  misc_feature 1..195: note = Hypo
  source 1..195: mol_type = genomic DNA

SEQ ID NO: 101806 - DNA, 383 bp, Homo sapiens; identical to SEQ ID NO: 68982
  misc_feature 1..383: note = chr1:2428099-2428482
  misc_feature 1..383: note = Hypo
  source 1..383: mol_type = genomic DNA

SEQ ID NO: 101807 - DNA, 90 bp, Homo sapiens; identical to SEQ ID NO: 68986
  misc_feature 1..90: note = chr1:2430433-2430523
  misc_feature 1..90: note = Hypo
  source 1..90: mol_type = genomic DNA

SEQ ID NO: 101808 - DNA, 30 bp, Homo sapiens; identical to SEQ ID NO: 68994
  misc_feature 1..30: note = chr1:2434250-2434280
  misc_feature 1..30: note = Hypo
  source 1..30: mol_type = genomic DNA

SEQ ID NO: 101809 - DNA, 66 bp, Homo sapiens; identical to SEQ ID NO: 68995
  misc_feature 1..66: note = chr1:2435884-2435950
  misc_feature 1..66: note = Hypo
  source 1..66: mol_type = genomic DNA

SEQ ID NO: 101810 - DNA, 33 bp, Homo sapiens; identical to SEQ ID NO: 68997
  misc_feature 1..33: note = chr1:2437266-2437299
  misc_feature 1..33: note = Hypo
  source 1..33: mol_type = genomic DNA

SEQ ID NO: 101811 - DNA, 92 bp, Homo sapiens; identical to SEQ ID NO: 69050
  misc_feature 1..92: note = chr1:2460806-2460898
  misc_feature 1..92: note = Hyper
  source 1..92: mol_type = genomic DNA

SEQ ID NO: 101812 - DNA, 677 bp, Homo sapiens
  misc_feature 1..677: note = chr1:2461311-2461988
  misc_feature 1..677: note = Hyper
  source 1..677: mol_type = genomic DNA
ccatctccaggatgtcggccttctccagcttggagttgggctggtgccgcgcgaactcctgctccagcagcagcttcagctgctcgatgctgctgttgatgcggtcgcggcgcatcttctccaccaccggcttccgcagctgcgggaggagggggtgtcaggctggcccggcacggcgcagggacccccgaggaccggaggccgcggggacagcgcgccgggcgagtctggtacttactcggtttttctctttggggctgagcagctccacggccacagtgctgggggccatgcctggcgcggaacaggcgacgaggcgacgcggggaggccgggcgagacgaggcgagcgggcgcgggcaaggccaagcgcgtcccgggctggcgcggacaccggccccgcgcgccgacgccctatataggcgcgggcggcggcctggcgcctggagtccgggcgccgcggccgttcccacactccgcggccaatggccgggcgggccgcacaaaggcgccggcccattagcgcacgctaaattgcctgtgaattggcgcgggcacaatgggcgctccccaaggagcaggtgggccgcgcggcacaatgtccgggctgtgggaacgcgctcgccctcattagcatcccggggcctgatgccgggagccccgcgcctcaatatgctg

SEQ ID NO: 101813 - DNA, 31 bp, Homo sapiens; identical to SEQ ID NO: 69063
  misc_feature 1..31: note = chr1:2468551-2468582
  misc_feature 1..31: note = Hypo
  source 1..31: mol_type = genomic DNA

SEQ ID NO: 101814 - DNA, 150 bp, Homo sapiens; identical to SEQ ID NO: 69064
  misc_feature 1..150: note = chr1:2468642-2468792
  misc_feature 1..150: note = Hypo
  source 1..150: mol_type = genomic DNA

SEQ ID NO: 101815 - DNA, 403 bp, Homo sapiens; identical to SEQ ID NO: 69074
  misc_feature 1..403: note = chr1:2472147-2472550
  misc_feature 1..403: note = Hyper
  source 1..403: mol_type = genomic DNA

SEQ ID NO: 101816 - DNA, 33 bp, Homo sapiens; identical to SEQ ID NO: 69118
  misc_feature 1..33: note = chr1:2483840-2483873
  misc_feature 1..33: note = Hypo
  source 1..33: mol_type = genomic DNA

SEQ ID NO: 101817 - DNA, 40 bp, Homo sapiens; identical to SEQ ID NO: 69125
  misc_feature 1..40: note = chr1:2500708-2500748
  misc_feature 1..40: note = Hypo
  source 1..40: mol_type = genomic DNA

SEQ ID NO: 101818 - DNA, 30 bp, Homo sapiens; identical to SEQ ID NO: 14185
  misc_feature 1..30: note = chr1:2507045-2507075
  misc_feature 1..30: note = Hypo
  source 1..30: mol_type = genomic DNA

SEQ ID NO: 101819 - DNA, 304 bp, Homo sapiens; identical to SEQ ID NO: 69127
  misc_feature 1..304: note = chr1:2519610-2519914
  misc_feature 1..304: note = Hypo
  source 1..304: mol_type = genomic DNA

SEQ ID NO: 101820 - DNA, 30 bp, Homo sapiens; identical to SEQ ID NO: 69128
  misc_feature 1..30: note = chr1:2520957-2520987
  misc_feature 1..30: note = Hypo
  source 1..30: mol_type = genomic DNA

SEQ ID NO: 101821 - DNA, 231 bp, Homo sapiens; identical to SEQ ID NO: 69135
  misc_feature 1..231: note = chr1:2527304-2527535
  misc_feature 1..231: note = Hypo
  source 1..231: mol_type = genomic DNA

SEQ ID NO: 101822 - DNA, 30 bp, Homo sapiens; identical to SEQ ID NO: 69136
  misc_feature 1..30: note = chr1:2527977-2528007
  misc_feature 1..30: note = Hypo
  source 1..30: mol_type = genomic DNA

SEQ ID NO: 101823 - DNA, 66 bp, Homo sapiens; identical to SEQ ID NO: 14186
  misc_feature 1..66: note = chr1:2537084-2537150
  misc_feature 1..66: note = Hypo
  source 1..66: mol_type = genomic DNA

SEQ ID NO: 101824 - DNA, 141 bp, Homo sapiens; identical to SEQ ID NO: 69139
  misc_feature 1..141: note = chr1:2537758-2537899
  misc_feature 1..141: note = Hypo
  source 1..141: mol_type = genomic DNA

SEQ ID NO: 101825 - DNA, 164 bp, Homo sapiens; identical to SEQ ID NO: 69140
  misc_feature 1..164: note = chr1:2538565-2538729
  misc_feature 1..164: note = Hypo
  source 1..164: mol_type = genomic DNA

SEQ ID NO: 101826 - DNA, 64 bp, Homo sapiens; identical to SEQ ID NO: 69141
  misc_feature 1..64: note = chr1:2541226-2541290
  misc_feature 1..64: note = Hypo
  source 1..64: mol_type = genomic DNA

SEQ ID NO: 101827 - DNA, 612 bp, Homo sapiens; identical to SEQ ID NO: 69146
  misc_feature 1..612: note = chr1:2560341-2560953
  misc_feature 1..612: note = Hyper
  source 1..612: mol_type = genomic DNA

SEQ ID NO: 101828 - DNA, 156 bp, Homo sapiens; identical to SEQ ID NO: 69147
  misc_feature 1..156: note = chr1:2571507-2571663
  misc_feature 1..156: note = Hypo
  source 1..156: mol_type = genomic DNA

SEQ ID NO: 101829 - DNA, 101 bp, Homo sapiens; identical to SEQ ID NO: 69170
  misc_feature 1..101: note = chr1:2702371-2702472
  misc_feature 1..101: note = Hypo
  source 1..101: mol_type = genomic DNA

SEQ ID NO: 101830 - DNA, 30 bp, Homo sapiens; identical to SEQ ID NO: 69171
  misc_feature 1..30: note = chr1:2702696-2702726
  misc_feature 1..30: note = Hypo
  source 1..30: mol_type = genomic DNA

SEQ ID NO: 101831 - DNA, 375 bp, Homo sapiens
  misc_feature 1..375: note = chr1:2706094-2706469
  misc_feature 1..375: note = Hyper
  source 1..375: mol_type = genomic DNA
tctgcggcctccctccggccctgcgctctggacggcccggcgcgtggagatcgctgcagcatcccacgggcctcctcccgcagcaccaccagcagcagcccccgctggttccagggcacgtaggccttggcggccagcagcgcctcctcgggccgcagcctgcaggcggtgacatagtccagcgtgcccaggaacgcgctgcccgccagcacccgcagcagtccccggccgcacagcgcgcgcacacagccccccgggtgcggcgccccctgctccactaccgtctggaagtcctccatggcgcgccgcgagtccccggcgtgcagcgcgcagaagccgcgcagagccaggagaggtgcgcggtcccctgcacgg

SEQ ID NO: 101832 - DNA, 159 bp, Homo sapiens; identical to SEQ ID NO: 69173
  misc_feature 1..159: note = chr1:2708372-2708531
  misc_feature 1..159: note = Hypo
  source 1..159: mol_type = genomic DNA

SEQ ID NO: 101833 - DNA, 503 bp, Homo sapiens; identical to SEQ ID NO: 38760
  misc_feature 1..503: note = chr1:2716736-2717239
  misc_feature 1..503: note = Hypo
  source 1..503: mol_type = genomic DNA

SEQ ID NO: 101834 - DNA, 39 bp, Homo sapiens; identical to SEQ ID NO: 69178
  misc_feature 1..39: note = chr1:2719879-2719918
  misc_feature 1..39: note = Hypo
  source 1..39: mol_type = genomic DNA

SEQ ID NO: 101835 - DNA, 75 bp, Homo sapiens; identical to SEQ ID NO: 69179
  misc_feature 1..75: note = chr1:2725182-2725257
  misc_feature 1..75: note = Hypo
  source 1..75: mol_type = genomic DNA

SEQ ID NO: 101836 - DNA, 462 bp, Homo sapiens; identical to SEQ ID NO: 69180
  misc_feature 1..462: note = chr1:2725529-2725991
  misc_feature 1..462: note = Hypo
  source 1..462: mol_type = genomic DNA

SEQ ID NO: 101837 - DNA, 119 bp, Homo sapiens; identical to SEQ ID NO: 69181
  misc_feature 1..119: note = chr1:2726839-2726958
  misc_feature 1..119: note = Hypo
  source 1..119: mol_type = genomic DNA

SEQ ID NO: 101838 - DNA, 35 bp, Homo sapiens; identical to SEQ ID NO: 69183
  misc_feature 1..35: note = chr1:2733564-2733599
  misc_feature 1..35: note = Hypo
  source 1..35: mol_type = genomic DNA

SEQ ID NO: 101839 - DNA, 95 bp, Homo sapiens; identical to SEQ ID NO: 69184
  misc_feature 1..95: note = chr1:2733659-2733754
  misc_feature 1..95: note = Hypo
  source 1..95: mol_type = genomic DNA

SEQ ID NO: 101840 - DNA, 30 bp, Homo sapiens; identical to SEQ ID NO: 38765
  misc_feature 1..30: note = chr1:2770901-2770931
  misc_feature 1..30: note = Hypo
  source 1..30: mol_type = genomic DNA

SEQ ID NO: 101841 - DNA, 30 bp, Homo sapiens; identical to SEQ ID NO: 69195
  misc_feature 1..30: note = chr1:2775401-2775431
  misc_feature 1..30: note = Hypo
  source 1..30: mol_type = genomic DNA

SEQ ID NO: 101842 - DNA, 30 bp, Homo sapiens
  misc_feature 1..30: note = chr1:2777228-2777258
  misc_feature 1..30: note = Hypo
  source 1..30: mol_type = genomic DNA
aagggctcttgccatcggcaaccatttgtt

SEQ ID NO: 101843 - DNA, 89 bp, Homo sapiens; identical to SEQ ID NO: 69203
  misc_feature 1..89: note = chr1:2823329-2823418
  misc_feature 1..89: note = Hypo
  source 1..89: mol_type = genomic DNA

SEQ ID NO: 101844 - DNA, 52 bp, Homo sapiens; identical to SEQ ID NO: 69204
  misc_feature 1..52: note = chr1:2826173-2826225
  misc_feature 1..52: note = Hypo
  source 1..52: mol_type = genomic DNA

SEQ ID NO: 101845 - DNA, 468 bp, Homo sapiens
  misc_feature 1..468: note = chr1:2827790-2828258
  misc_feature 1..468: note = Hypo
  source 1..468: mol_type = genomic DNA
gtctgggcgccaggacgctggaggcgtgggatgatggcgattcgtctcccatcttcaaggccaacacagataggcggtccactgtcccagtgggacctgacgtggcccagagtggacggtggcccctacccaggcgcgcgcgtggccccagatcccgcgctgagtccctgcaccgcggccgccgcggcgctgctgtccccgagaggcagccctgtctctgctggcccgttaactgtgctggcagagctgttaccgtgacagtagattaatatctctttagtcagccaaaatgaacatggcatgctggtgacagtccaattttctgctaacagattgtggcctatcgaaacccggcgctcagctgatttttatttctgccagagataattcagcgcgggaggagcggccgccaccatcccatccaccagcgccgttcaatatatcccgcgccggcgtttctcacccact

SEQ ID NO: 101846 - DNA, 48 bp, Homo sapiens; identical to SEQ ID NO: 69207
  misc_feature 1..48: note = chr1:2830003-2830051
  misc_feature 1..48: note = Hypo
  source 1..48: mol_type = genomic DNA

SEQ ID NO: 101847 - DNA, 71 bp, Homo sapiens; identical to SEQ ID NO: 69208
  misc_feature 1..71: note = chr1:2831835-2831906
  misc_feature 1..71: note = Hypo
  source 1..71: mol_type = genomic DNA

SEQ ID NO: 101848 - DNA, 161 bp, Homo sapiens; identical to SEQ ID NO: 38769
  misc_feature 1..161: note = chr1:2833818-2833979
  misc_feature 1..161: note = Hypo
  source 1..161: mol_type = genomic DNA

SEQ ID NO: 101849 - DNA, 30 bp, Homo sapiens; identical to SEQ ID NO: 38770
  misc_feature 1..30: note = chr1:2836432-2836462
  misc_feature 1..30: note = Hypo
  source 1..30: mol_type = genomic DNA

SEQ ID NO: 101850 - DNA, 227 bp, Homo sapiens; identical to SEQ ID NO: 69211
  misc_feature 1..227: note = chr1:2840699-2840926
  misc_feature 1..227: note = Hypo
  source 1..227: mol_type = genomic DNA

SEQ ID NO: 101851 - DNA, 30 bp, Homo sapiens; identical to SEQ ID NO: 38772
  misc_feature 1..30: note = chr1:2846793-2846823
  misc_feature 1..30: note = Hypo
  source 1..30: mol_type = genomic DNA

SEQ ID NO: 101852 - DNA, 30 bp, Homo sapiens; identical to SEQ ID NO: 69213
  misc_feature 1..30: note = chr1:2850995-2851025
  misc_feature 1..30: note = Hypo
  source 1..30: mol_type = genomic DNA

SEQ ID NO: 101853 - DNA, 129 bp, Homo sapiens; identical to SEQ ID NO: 69214
  misc_feature 1..129: note = chr1:2859680-2859809
  misc_feature 1..129: note = Hypo
  source 1..129: mol_type = genomic DNA

SEQ ID NO: 101854 - DNA, 153 bp, Homo sapiens; identical to SEQ ID NO: 69215
  misc_feature 1..153: note = chr1:2866038-2866191
  misc_feature 1..153: note = Hypo
  source 1..153: mol_type = genomic DNA

SEQ ID NO: 101855 - DNA, 171 bp, Homo sapiens; identical to SEQ ID NO: 69218
  misc_feature 1..171: note = chr1:2888921-2889092
  misc_feature 1..171: note = Hypo
  source 1..171: mol_type = genomic DNA

SEQ ID NO: 101856 - DNA, 41 bp, Homo sapiens; identical to SEQ ID NO: 69221
  misc_feature 1..41: note = chr1:2896547-2896588
  misc_feature 1..41: note = Hypo
  source 1..41: mol_type = genomic DNA

SEQ ID NO: 101857 - DNA, 448 bp, Homo sapiens; identical to SEQ ID NO: 69226
  misc_feature 1..448: note = chr1:2918274-2918722
  misc_feature 1..448: note = Hypo
  source 1..448: mol_type = genomic DNA

SEQ ID NO: 101858 - DNA, 129 bp, Homo sapiens; identical to SEQ ID NO: 69227
  misc_feature 1..129: note = chr1:2919035-2919164
  misc_feature 1..129: note = Hypo
  source 1..129: mol_type = genomic DNA

SEQ ID NO: 101859 - DNA, 30 bp, Homo sapiens; identical to SEQ ID NO: 38775
  misc_feature 1..30: note = chr1:2939161-2939191
  misc_feature 1..30: note = Hypo
  source 1..30: mol_type = genomic DNA

SEQ ID NO: 101860 - DNA, 829 bp, Homo sapiens
  misc_feature 1..829: note = chr1:2984623-2985452
  misc_feature 1..829: note = Hyper
  source 1..829: mol_type = genomic DNA
gaggaagcgtctggtcggctcccgtccgagctgctccacctgcgccgctggcctttccgcccgctacgcacctgggccccgagaggccagaggggagtgtccccagtggcccgggtccccgaaggtggcccagctcgggcgctcgcgcagccgggtactcaccttgggggcgcggcggcaggagagcgcgggcggagaggtgcgggcgccctgggacgaccagccgaggacgcctggtgtttggacggctgcccccgcgctgtccccccgtgcgaggcgtgttggcctccgtggcctcgcgagggaccgagggcggcgggtccgagtgccgcccgccggcctgggcagtggcggagcgcggagctggcggcgcctccgctgttgtttttgagccgcgaagcccgaagcagcagccgttgggtgggggcgaaggggaggaggcgggggccgggaggcgcgaggggggcggtggggcccggagggggcttcggaggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacgcaggggcagggtggggggatagtcacctcgcctccggggccacctgggt

SEQ ID NO: 101861 - DNA, 43 bp, Homo sapiens; identical to SEQ ID NO: 69243
  misc_feature 1..43: note = chr1:2986039-2986082
  misc_feature 1..43: note = Hyper
  source 1..43: mol_type = genomic DNA

SEQ ID NO: 101862 - DNA, 1236 bp, Homo sapiens
  misc_feature 1..1236: note = chr1:2986346-2987582
  misc_feature 1..1236: note = Hyper
  source 1..1236: mol_type = genomic DNA
gagcaccgcctttggcgtccgccagccgggcgcagaggagggagaccccgagccggggaggggcggaggagggggcgcgggccggcgcccacccggctccgcgggcgcaggggcaggggtggcgacggcgggacagccgcagccacttggggagcaaaatggagacttttgcccgggctgggaactgtggtcgtgaagtttatccccggctgtgccccgcgtggtggagggcgctcctctgggacgccggcagcctgcgcgggccgccggggcgacagtgcctccgacaggagggacccacccggccacctcccgacccgccgctgccgccctcgggcccgcgtggacccctctgtacccgcttgcctggcacagccgggcccggcggggacagagctgccccggccaggctgcccggtcctcggtcttactttctctttcgctccgtctcggccgagccccgggctccgcgcgccccgcctgccgccagccggtccttgccgcgggccgggtgctccagccacccgcgccctcgcccgccacagcgcctccgagcagcccgcgcgcaccccgcagccccggtcgccggcgccatccgcggtgaggcgggcgggcaggtgaggacaggcggagccgcggcccggccagcgcggctcccgcagccccgccgaagccccggctgcagcgaagcggccagcgccgcgcggagcggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcccggggccgagcccccaaacgtgagccgggtgcgcgcgggactcgcggcggttttccgaagctccgctccctcggctcggggcccgcccggctcgtcccaacagctgccccgcggccgtaggccccgcgctctgtgcaccagggaaaagcagctcccgagtttgtgccggacgctcctgcgccccgccatcggccgttcccggcccctgggtgaggcgcccccttcccgccgcgctccgctgccgggtgccctcggcctcggcctcccgtgacctctgacccctcttggtgcgaacaagaccgggcgtttcgccgccgacgcgaaggggctgtctgtgcgcggcgttgcgggccctccgcgcg

SEQ ID NO: 101863 - DNA, 42 bp, Homo sapiens
  misc_feature 1..42: note = chr1:2990316-2990358
  misc_feature 1..42: note = Hyper
  source 1..42: mol_type = genomic DNA
cgcccgcgtccacaccgcgcagcctggcgccccgaccctggc

SEQ ID NO: 101864 - DNA, 43 bp, Homo sapiens; identical to SEQ ID NO: 69246
  misc_feature 1..43: note = chr1:2999363-2999406
  misc_feature 1..43: note = Hypo
  source 1..43: mol_type = genomic DNA

SEQ ID NO: 101865 - DNA, 41 bp, Homo sapiens; identical to SEQ ID NO: 69247
  misc_feature 1..41: note = chr1:2999823-2999864
  misc_feature 1..41: note = Hypo
  source 1..41: mol_type = genomic DNA

SEQ ID NO: 101866 - DNA, 30 bp, Homo sapiens; identical to SEQ ID NO: 69248
  misc_feature 1..30: note = chr1:3008545-3008575
  misc_feature 1..30: note = Hypo
  source 1..30: mol_type = genomic DNA

SEQ ID NO: 101867 - DNA, 69 bp, Homo sapiens; identical to SEQ ID NO: 69249
  misc_feature 1..69: note = chr1:3015467-3015536
  misc_feature 1..69: note = Hypo
  source 1..69: mol_type = genomic DNA

SEQ ID NO: 101868 - DNA, 83 bp, Homo sapiens; identical to SEQ ID NO: 69250
  misc_feature 1..83: note = chr1:3032896-3032979
  misc_feature 1..83: note = Hypo
  source 1..83: mol_type = genomic DNA

SEQ ID NO: 101869 - DNA, 141 bp, Homo sapiens; identical to SEQ ID NO: 38777
  misc_feature 1..141: note = chr1:3035035-3035176
  misc_feature 1..141: note = Hypo
  source 1..141: mol_type = genomic DNA

SEQ ID NO: 101870 - DNA, 153 bp, Homo sapiens; identical to SEQ ID NO: 69253
  misc_feature 1..153: note = chr1:3051442-3051595
  misc_feature 1..153: note = Hypo
  source 1..153: mol_type = genomic DNA

SEQ ID NO: 101871 - DNA, 30 bp, Homo sapiens; identical to SEQ ID NO: 69254
  misc_feature 1..30: note = chr1:3052897-3052927
  misc_feature 1..30: note = Hypo
  source 1..30: mol_type = genomic DNA

SEQ ID NO: 101872 - DNA, 30 bp, Homo sapiens; identical to SEQ ID NO: 38778
  misc_feature 1..30: note = chr1:3063272-3063302
  misc_feature 1..30: note = Hypo
  source 1..30: mol_type = genomic DNA

SEQ ID NO: 101873 - DNA, 30 bp, Homo sapiens; identical to SEQ ID NO: 38779
  misc_feature 1..30: note = chr1:3070343-3070373
  misc_feature 1..30: note = Hypo
  source 1..30: mol_type = genomic DNA

SEQ ID NO: 101874 - DNA, 155 bp, Homo sapiens; identical to SEQ ID NO: 69259
  misc_feature 1..155: note = chr1:3078686-3078841
  misc_feature 1..155: note = Hypo
  source 1..155: mol_type = genomic DNA

SEQ ID NO: 101875 - DNA, 34 bp, Homo sapiens; identical to SEQ ID NO: 69260
  misc_feature 1..34: note = chr1:3080320-3080354
  misc_feature 1..34: note = Hypo
  source 1..34: mol_type = genomic DNA

SEQ ID NO: 101876 - DNA, 122 bp, Homo sapiens; identical to SEQ ID NO: 69263
  misc_feature 1..122: note = chr1:3087601-3087723
  misc_feature 1..122: note = Hyper
  source 1..122: mol_type = genomic DNA

SEQ ID NO: 101877 - DNA, 54 bp, Homo sapiens; identical to SEQ ID NO: 69264
  misc_feature 1..54: note = chr1:3089947-3090001
  misc_feature 1..54: note = Hypo
  source 1..54: mol_type = genomic DNA

SEQ ID NO: 101878 - DNA, 241 bp, Homo sapiens; identical to SEQ ID NO: 69265
  misc_feature 1..241: note = chr1:3102576-3102817
  misc_feature 1..241: note = Hypo
  source 1..241: mol_type = genomic DNA

SEQ ID NO: 101879 - DNA, 226 bp, Homo sapiens; identical to SEQ ID NO: 69266
  misc_feature 1..226: note = chr1:3111237-3111463
  misc_feature 1..226: note = Hypo
  source 1..226: mol_type = genomic DNA

SEQ ID NO: 101880 - DNA, 32 bp, Homo sapiens; identical to SEQ ID NO: 69270
  misc_feature 1..32: note = chr1:3128445-3128477
  misc_feature 1..32: note = Hypo
  source 1..32: mol_type = genomic DNA

SEQ ID NO: 101881 - DNA, 157 bp, Homo sapiens; identical to SEQ ID NO: 69271
  misc_feature 1..157: note = chr1:3129210-3129367
  misc_feature 1..157: note = Hypo
  source 1..157: mol_type = genomic DNA

SEQ ID NO: 101882 - DNA, 35 bp, Homo sapiens; identical to SEQ ID NO: 69273
  misc_feature 1..35: note = chr1:3147215-3147250
  misc_feature 1..35: note = Hypo
  source 1..35: mol_type = genomic DNA

SEQ ID NO: 101883 - DNA, 30 bp, Homo sapiens; identical to SEQ ID NO: 69275
  misc_feature 1..30: note = chr1:3149618-3149648
  misc_feature 1..30: note = Hypo
  source 1..30: mol_type = genomic DNA

SEQ ID NO: 101884 - DNA, 50 bp, Homo sapiens
  misc_feature 1..50: note = chr1:3155276-3155326
  misc_feature 1..50: note = Hypo
  source 1..50: mol_type = genomic DNA
ggagagagtcctggccggggttcaggtgcaagtcccgggtggaagggcct

SEQ ID NO: 101885 - DNA, 30 bp, Homo sapiens; identical to SEQ ID NO: 38784
  misc_feature 1..30: note = chr1:3179577-3179607
  misc_feature 1..30: note = Hypo
  source 1..30: mol_type = genomic DNA

SEQ ID NO: 101886 - DNA, 30 bp, Homo sapiens; identical to SEQ ID NO: 69279
  misc_feature 1..30: note = chr1:3182769-3182799
  misc_feature 1..30: note = Hypo
  source 1..30: mol_type = genomic DNA

SEQ ID NO: 101887 - DNA, 90 bp, Homo sapiens; identical to SEQ ID NO: 69280
  misc_feature 1..90: note = chr1:3183016-3183106
  misc_feature 1..90: note = Hypo
  source 1..90: mol_type = genomic DNA

SEQ ID NO: 101888 - DNA, 18 bp, Homo sapiens
  misc_feature 1..18: note = chr1:3183533-3183551
  misc_feature 1..18: note = Hypo
  source 1..18: mol_type = genomic DNA
gcccggccacgtgcattt

SEQ ID NO: 101889 - DNA, 72 bp, Homo sapiens; identical to SEQ ID NO: 69283
  misc_feature 1..72: note = chr1:3184625-3184697
  misc_feature 1..72: note = Hypo
  source 1..72: mol_type = genomic DNA

SEQ ID NO: 101890 - DNA, 112 bp, Homo sapiens; identical to SEQ ID NO: 69287
  misc_feature 1..112: note = chr1:3213652-3213764
  misc_feature 1..112: note = Hypo
  source 1..112: mol_type = genomic DNA

SEQ ID NO: 101891 - DNA, 178 bp, Homo sapiens; identical to SEQ ID NO: 69288
  misc_feature 1..178: note = chr1:3217150-3217328
  misc_feature 1..178: note = Hypo
  source 1..178: mol_type = genomic DNA

SEQ ID NO: 101892 - DNA, 30 bp, Homo sapiens; identical to SEQ ID NO: 69292
  misc_feature 1..30: note = chr1:3222385-3222415
  misc_feature 1..30: note = Hypo
  source 1..30: mol_type = genomic DNA

SEQ ID NO: 101893 - DNA, 30 bp, Homo sapiens; identical to SEQ ID NO: 69298
  misc_feature 1..30: note = chr1:3263565-3263595
  misc_feature 1..30: note = Hypo
  source 1..30: mol_type = genomic DNA

SEQ ID NO: 101894 - DNA, 164 bp, Homo sapiens; identical to SEQ ID NO: 69302
  misc_feature 1..164: note = chr1:3276914-3277078
  misc_feature 1..164: note = Hypo
  source 1..164: mol_type = genomic DNA

SEQ ID NO: 101895 - DNA, 82 bp, Homo sapiens; identical to SEQ ID NO: 69308
  misc_feature 1..82: note = chr1:3294711-3294793
  misc_feature 1..82: note = Hypo
  source 1..82: mol_type = genomic DNA

SEQ ID NO: 101896 - DNA, 66 bp, Homo sapiens; identical to SEQ ID NO: 69309
  misc_feature 1..66: note = chr1:3297673-3297739
  misc_feature 1..66: note = Hypo
  source 1..66: mol_type = genomic DNA

SEQ ID NO: 101897 - DNA, 771 bp, Homo sapiens
  misc_feature 1..771: note = chr1:3310120-3310891
  misc_feature 1..771: note = Hyper
  source 1..771: mol_type = genomic DNA
cgagccaggagccggcgcaggctgggtccgcagacgcccggttcccaccgcggccggcccggtctttgtcccgggaagtcgcctgaccccgccggccaggaacagtggcgttctcggcgcgtctggctgataaggcctttgtgacaccggggacaggctgtaaaaacgcagccagcttttgtctgcacctccgcgccgctggcaagggcggggccggcgagtgtggaaaagtttgcgcggattcccgttcacctctgacccccgaagcagttggaggcaggtcggggacccccgcccccgccccgccccgcctcgggccctgcgatcagcagtaatagcgattaattccgactgtggctccaagtcccatggccaaggcgccctcctcctgcaggtccagggccagggagggggagcccgcggcccggcgcgctagaccctcccgcggcggcggcggctccagggcagtgtccgcgccggaggggagggtcccccggcaagtctgctgccctcggagccggggtggggtcccaggagacaccgggggccctcggattgggggaagaggtgggggaaggggtttccttccgcagcgccgcggatcagaggagggaggcctggcgccctcggagctgcggtggggggcatcccaggagatctggctcggtgtgtagagaagggagtccgggcggcgtcctgggagtgtctgtggcctgcagagaggggatggggttggggtgtggatcccgggaggctcggaggcgctcggag

SEQ ID NO: 101898 - DNA, 262 bp, Homo sapiens; identical to SEQ ID NO: 69312
  misc_feature 1..262: note = chr1:3321998-3322260
  misc_feature 1..262: note = Hypo
  source 1..262: mol_type = genomic DNA

SEQ ID NO: 101899 - DNA, 560 bp, Homo sapiens; identical to SEQ ID NO: 69314
  misc_feature 1..560: note = chr1:3325238-3325798
  misc_feature 1..560: note = Hypo
  source 1..560: mol_type = genomic DNA

SEQ ID NO: 101900 - DNA, 155 bp, Homo sapiens; identical to SEQ ID NO: 69315
  misc_feature 1..155: note = chr1:3327868-3328023
  misc_feature 1..155: note = Hypo
  source 1..155: mol_type = genomic DNA

SEQ ID NO: 101901 - DNA, 50 bp, Homo sapiens; identical to SEQ ID NO: 69316
  misc_feature 1..50: note = chr1:3328269-3328319
  misc_feature 1..50: note = Hypo
  source 1..50: mol_type = genomic DNA

SEQ ID NO: 101902 - DNA, 92 bp, Homo sapiens; identical to SEQ ID NO: 69317
  misc_feature 1..92: note = chr1:3328533-3328625
  misc_feature 1..92: note = Hypo
  source 1..92: mol_type = genomic DNA

SEQ ID NO: 101903 - DNA, 30 bp, Homo sapiens; identical to SEQ ID NO: 69318
  misc_feature 1..30: note = chr1:3329300-3329330
  misc_feature 1..30: note = Hypo
  source 1..30: mol_type = genomic DNA

SEQ ID NO: 101904 - DNA, 30 bp, Homo sapiens; identical to SEQ ID NO: 69319
  misc_feature 1..30: note = chr1:3330244-3330274
  misc_feature 1..30: note = Hypo
  source 1..30: mol_type = genomic DNA

SEQ ID NO: 101905 - DNA, 79 bp, Homo sapiens; identical to SEQ ID NO: 69324
  misc_feature 1..79: note = chr1:3335837-3335916
  misc_feature 1..79: note = Hypo
  source 1..79: mol_type = genomic DNA

SEQ ID NO: 101906 - DNA, 180 bp, Homo sapiens; identical to SEQ ID NO: 69327
  misc_feature 1..180: note = chr1:3342141-3342321
  misc_feature 1..180: note = Hypo
  source 1..180: mol_type = genomic DNA

SEQ ID NO: 101907 - DNA, 93 bp, Homo sapiens; identical to SEQ ID NO: 69331
  misc_feature 1..93: note = chr1:3347130-3347223
  misc_feature 1..93: note = Hypo
  source 1..93: mol_type = genomic DNA

SEQ ID NO: 101908 - DNA, 69 bp, Homo sapiens; identical to SEQ ID NO: 69333
  misc_feature 1..69: note = chr1:3350089-3350158
  misc_feature 1..69: note = Hypo
  source 1..69: mol_type = genomic DNA

SEQ ID NO: 101909 - DNA, 55 bp, Homo sapiens; identical to SEQ ID NO: 69334
  misc_feature 1..55: note = chr1:3350407-3350462
  misc_feature 1..55: note = Hypo
  source 1..55: mol_type = genomic DNA

SEQ ID NO: 101910 - DNA, 33 bp, Homo sapiens; identical to SEQ ID NO: 38794
  misc_feature 1..33: note = chr1:3372809-3372842
  misc_feature 1..33: note = Hypo
  source 1..33: mol_type = genomic DNA

SEQ ID NO: 101911 - DNA, 45 bp, Homo sapiens; identical to SEQ ID NO: 69343
  misc_feature 1..45: note = chr1:3402666-3402711
  misc_feature 1..45: note = Hypo
  source 1..45: mol_type = genomic DNA

SEQ ID NO: 101912 - DNA, 206 bp, Homo sapiens; identical to SEQ ID NO: 69344
  misc_feature 1..206: note = chr1:3408498-3408704
  misc_feature 1..206: note = Hypo
  source 1..206: mol_type = genomic DNA

SEQ ID NO: 101913 - DNA, 272 bp, Homo sapiens; identical to SEQ ID NO: 69347
  misc_feature 1..272: note = chr1:3411032-3411304
  misc_feature 1..272: note = Hypo
  source 1..272: mol_type = genomic DNA

SEQ ID NO: 101914 - DNA, 30 bp, Homo sapiens; identical to SEQ ID NO: 69350
  misc_feature 1..30: note = chr1:3416275-3416305
  misc_feature 1..30: note = Hypo
  source 1..30: mol_type = genomic DNA

SEQ ID NO: 101915 - DNA, 36 bp, Homo sapiens; identical to SEQ ID NO: 69351
  misc_feature 1..36: note = chr1:3417132-3417168
  misc_feature 1..36: note = Hypo
  source 1..36: mol_type = genomic DNA

SEQ ID NO: 101916 - DNA, 30 bp, Homo sapiens; identical to SEQ ID NO: 69353
  misc_feature 1..30: note = chr1:3418316-3418346
  misc_feature 1..30: note = Hypo
  source 1..30: mol_type = genomic DNA

SEQ ID NO: 101917 - DNA, 103 bp, Homo sapiens; identical to SEQ ID NO: 69354
  misc_feature 1..103: note = chr1:3426374-3426477
  misc_feature 1..103: note = Hypo
  source 1..103: mol_type = genomic DNA

SEQ ID NO: 101918 - DNA, 30 bp, Homo sapiens; identical to SEQ ID NO: 69355
  misc_feature 1..30: note = chr1:3431090-3431120
  misc_feature 1..30: note = Hypo
  source 1..30: mol_type = genomic DNA

SEQ ID NO: 101919 - DNA, 30 bp, Homo sapiens; identical to SEQ ID NO: 69356
  misc_feature 1..30: note = chr1:3431513-3431543
  misc_feature 1..30: note = Hypo
  source 1..30: mol_type = genomic DNA

SEQ ID NO: 101920 - DNA, 30 bp, Homo sapiens; identical to SEQ ID NO: 69357
  misc_feature 1..30: note = chr1:3450321-3450351
  misc_feature 1..30: note = Hypo
  source 1..30: mol_type = genomic DNA

SEQ ID NO: 101921 - DNA, 285 bp, Homo sapiens; identical to SEQ ID NO: 69363
  misc_feature 1..285: note = chr1:3463596-3463881
  misc_feature 1..285: note = Hypo
  source 1..285: mol_type = genomic DNA

SEQ ID NO: 101922 - DNA, 675 bp, Homo sapiens; identical to SEQ ID NO: 69366
  misc_feature 1..675: note = chr1:3466869-3467544
  misc_feature 1..675: note = Hypo
  source 1..675: mol_type = genomic DNA

SEQ ID NO: 101923 - DNA, 30 bp, Homo sapiens; identical to SEQ ID NO: 38801
  misc_feature 1..30: note = chr1:3470143-3470173
  misc_feature 1..30: note = Hypo
  source 1..30: mol_type = genomic DNA

SEQ ID NO: 101924 - DNA, 34 bp, Homo sapiens; identical to SEQ ID NO: 69369
  misc_feature 1..34: note = chr1:3511274-3511308
  misc_feature 1..34: note = Hypo
  source 1..34: mol_type = genomic DNA

SEQ ID NO: 101925 - DNA, 30 bp, Homo sapiens; identical to SEQ ID NO: 69372
  misc_feature 1..30: note = chr1:3527351-3527381
  misc_feature 1..30: note = Hyper
  source 1..30: mol_type = genomic DNA

SEQ ID NO: 101926 - DNA, 61 bp, Homo sapiens; identical to SEQ ID NO: 69373
  misc_feature 1..61: note = chr1:3527713-3527774
  misc_feature 1..61: note = Hyper
  source 1..61: mol_type = genomic DNA

SEQ ID NO: 101927 - DNA, 50 bp, Homo sapiens
  misc_feature 1..50: note = chr1:3528381-3528431
  misc_feature 1..50: note = Hyper
  source 1..50: mol_type = genomic DNA
cctgctcgtctcatgcggaaagtccaagtcctaaccgactccagtgacca

SEQ ID NO: 101928 - DNA, 30 bp, Homo sapiens; identical to SEQ ID NO: 69382
  misc_feature 1..30: note = chr1:3564809-3564839
  misc_feature 1..30: note = Hypo
  source 1..30: mol_type = genomic DNA

SEQ ID NO: 101929 - DNA, 1355 bp, Homo sapiens
  misc_feature 1..1355: note = chr1:3567103-3568458
  misc_feature 1..1355: note = Hyper
  source 1..1355: mol_type = genomic DNA
taatacggtgtctgtcgcacatatattatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcaccgggcgaagaatcgtgcgggtctgggacctgggggcccagagggagcgagctcctgcgcgggcgctcggtccgcaggtttcgcaggctcaggggcgtgcctcgttctcacccccactccggaccccggtcctcttccctagacagcggccccctccacccctggctcccgcaggccgctagtagtccgcgccaggccccgccggcgcctctagggccccccagatcgcgcagaccctgacatccccgcctggccctgggttctgggagctgagagccggccagggtcctgctcgtacctccgggcgcccagcctcgggtctgctccccgcggacgccccaacctccccggccgaatggatggtggtgcgcgcgcgtcctactccggcggtgccggccttttctgttgccaaaactagacccaaacctctgcatgggattcgtctttgggtccccaccccgtgcgcccagcaaacagtgggtgagccatgaagatgtgcgagtcagccggaccctccccgtcaggcgcggacccgctgcggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 101930 - DNA, 79 bp, Homo sapiens; identical to SEQ ID NO: 69388
  misc_feature 1..79: note = chr1:3597274-3597353
  misc_feature 1..79: note = Hypo
  source 1..79: mol_type = genomic DNA

SEQ ID NO: 101931 - DNA, 30 bp, Homo sapiens; identical to SEQ ID NO: 69389
  misc_feature 1..30: note = chr1:3597733-3597763
  misc_feature 1..30: note = Hypo
  source 1..30: mol_type = genomic DNA

SEQ ID NO: 101932 - DNA, 132 bp, Homo sapiens; identical to SEQ ID NO: 69390
  misc_feature 1..132: note = chr1:3601814-3601946
  misc_feature 1..132: note = Hypo
  source 1..132: mol_type = genomic DNA

SEQ ID NO: 101933 - DNA, 30 bp, Homo sapiens; identical to SEQ ID NO: 69391
  misc_feature 1..30: note = chr1:3602547-3602577
  misc_feature 1..30: note = Hypo
  source 1..30: mol_type = genomic DNA

SEQ ID NO: 101934 - DNA, 485 bp, Homo sapiens
  misc_feature 1..485: note = chr1:3607081-3607566
  misc_feature 1..485: note = Hypo
  source 1..485: mol_type = genomic DNA
gtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggtaggtgtgacgcgccattcataggatctcttcggggactttgcgggggattttgctg

SEQ ID NO: 101935 - DNA, 66 bp, Homo sapiens; identical to SEQ ID NO: 69395
  misc_feature 1..66: note = chr1:3614470-3614536
  misc_feature 1..66: note = Hypo
  source 1..66: mol_type = genomic DNA

SEQ ID NO: 101936 - DNA, 75 bp, Homo sapiens; identical to SEQ ID NO: 69400
  misc_feature 1..75: note = chr1:3644699-3644774
  misc_feature 1..75: note = Hypo
  source 1..75: mol_type = genomic DNA

SEQ ID NO: 101937 - DNA, 42 bp, Homo sapiens
  misc_feature 1..42: note = chr1:3659628-3659670
  misc_feature 1..42: note = Hypo
  source 1..42: mol_type = genomic DNA
tctctttagggaagccggagaggccgccgggaacaggcagtg

SEQ ID NO: 101938 - DNA, 30 bp, Homo sapiens; identical to SEQ ID NO: 38806
  misc_feature 1..30: note = chr1:3661766-3661796
  misc_feature 1..30: note = Hypo
  source 1..30: mol_type = genomic DNA

SEQ ID NO: 101939 - DNA, 30 bp, Homo sapiens; identical to SEQ ID NO: 69406
  misc_feature 1..30: note = chr1:3662534-3662564
  misc_feature 1..30: note = Hypo
  source 1..30: mol_type = genomic DNA

SEQ ID NO: 101940 - DNA, 98 bp, Homo sapiens; identical to SEQ ID NO: 69407
  misc_feature 1..98: note = chr1:3663195-3663293
  misc_feature 1..98: note = Hyper
  source 1..98: mol_type = genomic DNA

SEQ ID NO: 101941 - DNA, 467 bp, Homo sapiens
  misc_feature 1..467: note = chr1:3663516-3663983
  misc_feature 1..467: note = Hyper
  source 1..467: mol_type = genomic DNA
ggagtgggtccgtccgagctggagtggtctccgaggggcggcggatgctcggagggggcggatcccttagggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggcaggggtgg

SEQ ID NO: 101942 - DNA, 32 bp, Homo sapiens; identical to SEQ ID NO: 69409
  misc_feature 1..32: note = chr1:3664709-3664741
  misc_feature 1..32: note = Hypo
  source 1..32: mol_type = genomic DNA

SEQ ID NO: 101943 - DNA, 30 bp, Homo sapiens; identical to SEQ ID NO: 69411
  misc_feature 1..30: note = chr1:3673312-3673342
  misc_feature 1..30: note = Hypo
  source 1..30: mol_type = genomic DNA

SEQ ID NO: 101944 - DNA, 114 bp, Homo sapiens; identical to SEQ ID NO: 69414
  misc_feature 1..114: note = chr1:3678034-3678148
  misc_feature 1..114: note = Hypo
  source 1..114: mol_type = genomic DNA

SEQ ID NO: 101945 - DNA, 68 bp, Homo sapiens; identical to SEQ ID NO: 38808
  misc_feature 1..68: note = chr1:3680032-3680100
  misc_feature 1..68: note = Hypo
  source 1..68: mol_type = genomic DNA

SEQ ID NO: 101946 - DNA, 55 bp, Homo sapiens; identical to SEQ ID NO: 69417
  misc_feature 1..55: note = chr1:3680304-3680359
  misc_feature 1..55: note = Hypo
  source 1..55: mol_type = genomic DNA

SEQ ID NO: 101947 - DNA, 680 bp, Homo sapiens; identical to SEQ ID NO: 69418
  misc_feature 1..680: note = chr1:3683703-3684383
  misc_feature 1..680: note = Hypo
  source 1..680: mol_type = genomic DNA

SEQ ID NO: 101948 - DNA, 30 bp, Homo sapiens; identical to SEQ ID NO: 69419
  misc_feature 1..30: note = chr1:3693714-3693744
  misc_feature 1..30: note = Hypo
  source 1..30: mol_type = genomic DNA

SEQ ID NO: 101949 - DNA, 30 bp, Homo sapiens; identical to SEQ ID NO: 69421
  misc_feature 1..30: note = chr1:3701022-3701052
  misc_feature 1..30: note = Hypo
  source 1..30: mol_type = genomic DNA

SEQ ID NO: 101950 - DNA, 35 bp, Homo sapiens; identical to SEQ ID NO: 69422
  misc_feature 1..35: note = chr1:3706065-3706100
  misc_feature 1..35: note = Hypo
  source 1..35: mol_type = genomic DNA

SEQ ID NO: 101951 - DNA, 30 bp, Homo sapiens; identical to SEQ ID NO: 69423
  misc_feature 1..30: note = chr1:3714226-3714256
  misc_feature 1..30: note = Hypo
  source 1..30: mol_type = genomic DNA

SEQ ID NO: 101952 - DNA, 192 bp, Homo sapiens; identical to SEQ ID NO: 69435
  misc_feature 1..192: note = chr1:3786388-3786580
  misc_feature 1..192: note = Hypo
  source 1..192: mol_type = genomic DNA

SEQ ID NO: 101953 - DNA, 37 bp, Homo sapiens; identical to SEQ ID NO: 69483
  misc_feature 1..37: note = chr1:4066154-4066191
  misc_feature 1..37: note = Hypo
  source 1..37: mol_type = genomic DNA

SEQ ID NO: 101954 - DNA, 193 bp, Homo sapiens; identical to SEQ ID NO: 38813
  misc_feature 1..193: note = chr1:4082814-4083007
  misc_feature 1..193: note = Hypo
  source 1..193: mol_type = genomic DNA

SEQ ID NO: 101955 - DNA, 151 bp, Homo sapiens; identical to SEQ ID NO: 14198
  misc_feature 1..151: note = chr1:4111083-4111234
  misc_feature 1..151: note = Hypo
  source 1..151: mol_type = genomic DNA

SEQ ID NO: 101956 - DNA, 30 bp, Homo sapiens; identical to SEQ ID NO: 69491
  misc_feature 1..30: note = chr1:4111541-4111571
  misc_feature 1..30: note = Hypo
  source 1..30: mol_type = genomic DNA

SEQ ID NO: 101957 - DNA, 30 bp, Homo sapiens; identical to SEQ ID NO: 69504
  misc_feature 1..30: note = chr1:4182092-4182122
  misc_feature 1..30: note = Hypo
  source 1..30: mol_type = genomic DNA

SEQ ID NO: 101958 - DNA, 191 bp, Homo sapiens; identical to SEQ ID NO: 69511
  misc_feature 1..191: note = chr1:4212772-4212963
  misc_feature 1..191: note = Hypo
  source 1..191: mol_type = genomic DNA

SEQ ID NO: 101959 - DNA, 82 bp, Homo sapiens; identical to SEQ ID NO: 69515
  misc_feature 1..82: note = chr1:4279385-4279467
  misc_feature 1..82: note = Hypo
  source 1..82: mol_type = genomic DNA

SEQ ID NO: 101960 - DNA, 99 bp, Homo sapiens; identical to SEQ ID NO: 69518
  misc_feature 1..99: note = chr1:4285363-4285462
  misc_feature 1..99: note = Hypo
  source 1..99: mol_type = genomic DNA

SEQ ID NO: 101961 - DNA, 177 bp, Homo sapiens; identical to SEQ ID NO: 69533
  misc_feature 1..177: note = chr1:4385832-4386009
  misc_feature 1..177: note = Hypo
  source 1..177: mol_type = genomic DNA

SEQ ID NO: 101962 - DNA, 152 bp, Homo sapiens; identical to SEQ ID NO: 38817
  misc_feature 1..152: note = chr1:4402113-4402265
  misc_feature 1..152: note = Hypo
  source 1..152: mol_type = genomic DNA

SEQ ID NO: 101963 - DNA, 214 bp, Homo sapiens; identical to SEQ ID NO: 69542
  misc_feature 1..214: note = chr1:4426176-4426390
  misc_feature 1..214: note = Hypo
  source 1..214: mol_type = genomic DNA

SEQ ID NO: 101964 - DNA, 71 bp, Homo sapiens; identical to SEQ ID NO: 69554
  misc_feature 1..71: note = chr1:4486495-4486566
  misc_feature 1..71: note = Hypo
  source 1..71: mol_type = genomic DNA

SEQ ID NO: 101965 - DNA, 75 bp, Homo sapiens; identical to SEQ ID NO: 69579
  misc_feature 1..75: note = chr1:4542688-4542763
  misc_feature 1..75: note = Hypo
  source 1..75: mol_type = genomic DNA

SEQ ID NO: 101966 - DNA, 68 bp, Homo sapiens; identical to SEQ ID NO: 38821
  misc_feature 1..68: note = chr1:4652230-4652298
  misc_feature 1..68: note = Hypo
  source 1..68: mol_type = genomic DNA

SEQ ID NO: 101967 - DNA, 94 bp, Homo sapiens; identical to SEQ ID NO: 69586
  misc_feature 1..94: note = chr1:4659147-4659241
  misc_feature 1..94: note = Hypo
  source 1..94: mol_type = genomic DNA

SEQ ID NO: 101968 - DNA, 93 bp, Homo sapiens; identical to SEQ ID NO: 69587
  misc_feature 1..93: note = chr1:4659541-4659634
  misc_feature 1..93: note = Hypo
  source 1..93: mol_type = genomic DNA

SEQ ID NO: 101969 - DNA, 44 bp, Homo sapiens; identical to SEQ ID NO: 69592
  misc_feature 1..44: note = chr1:4673712-4673756
  misc_feature 1..44: note = Hypo
  source 1..44: mol_type = genomic DNA

SEQ ID NO: 101970 - DNA, 124 bp, Homo sapiens; identical to SEQ ID NO: 38823
  misc_feature 1..124: note = chr1:4677050-4677174
  misc_feature 1..124: note = Hypo
  source 1..124: mol_type = genomic DNA

SEQ ID NO: 101971 - DNA, 30 bp, Homo sapiens; identical to SEQ ID NO: 69595
  misc_feature 1..30: note = chr1:4691300-4691330
  misc_feature 1..30: note = Hypo
  source 1..30: mol_type = genomic DNA

SEQ ID NO: 101972 - DNA, 101 bp, Homo sapiens; identical to SEQ ID NO: 69608
  misc_feature 1..101: note = chr1:4696797-4696898
  misc_feature 1..101: note = Hypo
  source 1..101: mol_type = genomic DNA

SEQ ID NO: 101973 - DNA, 23 bp, Homo sapiens
  misc_feature 1..23: note = chr1:4711648-4711671
  misc_feature 1..23: note = Hypo
  source 1..23: mol_type = genomic DNA
taataataagctgggcgcggtgg

SEQ ID NO: 101974 - DNA, 355 bp, Homo sapiens; identical to SEQ ID NO: 69615
  misc_feature 1..355: note = chr1:4712671-4713026
  misc_feature 1..355: note = Hyper
  source 1..355: mol_type = genomic DNA

SEQ ID NO: 101975 - DNA, 2720 bp, Homo sapiens
  misc_feature 1..2720: note = chr1:4713944-4716664
  misc_feature 1..2720: note = Hyper
  source 1..2720: mol_type = genomic DNA
ttccagtgactcctccggagcaagggcctggccaggcagcagctgcgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacgaaaaggccagtagttgttagcccgctgcttgagccgcccccactcagggatgaagctgcggggggagtgaggcgaagggagggaggatctagtgcgtgtcctgattttg

SEQ ID NO: 101976 - DNA, 235 bp, Homo sapiens; identical to SEQ ID NO: 38825
  misc_feature 1..235: note = chr1:4726593-4726828
  misc_feature 1..235: note = Hypo
  source 1..235: mol_type = genomic DNA

SEQ ID NO: 101977 - DNA, 120 bp, Homo sapiens; identical to SEQ ID NO: 69631
  misc_feature 1..120: note = chr1:4771547-4771667
  misc_feature 1..120: note = Hyper
  source 1..120: mol_type = genomic DNA

SEQ ID NO: 101978 - DNA, 224 bp, Homo sapiens; identical to SEQ ID NO: 69632
  misc_feature 1..224: note = chr1:4772478-4772702
  misc_feature 1..224: note = Hypo
  source 1..224: mol_type = genomic DNA

SEQ ID NO: 101979 - DNA, 177 bp, Homo sapiens; identical to SEQ ID NO: 69634
  misc_feature 1..177: note = chr1:4782333-4782510
  misc_feature 1..177: note = Hypo
  source 1..177: mol_type = genomic DNA

SEQ ID NO: 101980 - DNA, 30 bp, Homo sapiens; identical to SEQ ID NO: 69689
  misc_feature 1..30: note = chr1:5220720-5220750
  misc_feature 1..30: note = Hypo
  source 1..30: mol_type = genomic DNA

SEQ ID NO: 101981 - DNA, 30 bp, Homo sapiens; identical to SEQ ID NO: 69718
  misc_feature 1..30: note = chr1:5463052-5463082
  misc_feature 1..30: note = Hypo
  source 1..30: mol_type = genomic DNA

SEQ ID NO: 101982 - DNA, 30 bp, Homo sapiens; identical to SEQ ID NO: 69733
  misc_feature 1..30: note = chr1:5544893-5544923
  misc_feature 1..30: note = Hypo
  source 1..30: mol_type = genomic DNA

SEQ ID NO: 101983 - DNA, 52 bp, Homo sapiens; identical to SEQ ID NO: 69740
  misc_feature 1..52: note = chr1:5661868-5661920
  misc_feature 1..52: note = Hypo
  source 1..52: mol_type = genomic DNA

SEQ ID NO: 101984 - DNA, 30 bp, Homo sapiens; identical to SEQ ID NO: 69746
  misc_feature 1..30: note = chr1:5777938-5777968
  misc_feature 1..30: note = Hyper
  source 1..30: mol_type = genomic DNA

SEQ ID NO: 101985 - DNA, 30 bp, Homo sapiens; identical to SEQ ID NO: 69751
  misc_feature 1..30: note = chr1:5816415-5816445
  misc_feature 1..30: note = Hypo
  source 1..30: mol_type = genomic DNA

SEQ ID NO: 101986 - DNA, 93 bp, Homo sapiens; identical to SEQ ID NO: 69757
  misc_feature 1..93: note = chr1:5890942-5891035
  misc_feature 1..93: note = Hyper
  source 1..93: mol_type = genomic DNA

SEQ ID NO: 101987 - DNA, 43 bp, Homo sapiens; identical to SEQ ID NO: 38828
  misc_feature 1..43: note = chr1:5893925-5893968
  misc_feature 1..43: note = Hypo
  source 1..43: mol_type = genomic DNA

SEQ ID NO: 101988 - DNA, 49 bp, Homo sapiens; identical to SEQ ID NO: 69759
  misc_feature 1..49: note = chr1:5894998-5895047
  misc_feature 1..49: note = Hypo
  source 1..49: mol_type = genomic DNA

SEQ ID NO: 101989 - DNA, 66 bp, Homo sapiens; identical to SEQ ID NO: 69763
  misc_feature 1..66: note = chr1:6046211-6046277
  misc_feature 1..66: note = Hypo
  source 1..66: mol_type = genomic DNA

SEQ ID NO: 101990 - DNA, 183 bp, Homo sapiens
  misc_feature 1..183: note = chr1:6053472-6053655
  misc_feature 1..183: note = Hyper
  source 1..183: mol_type = genomic DNA
ttacagcacacacaccgccacttctgaccctgagcccctactcctatcttaagcttctccctcctgccaggccttggcacaaagcacttccgcacctccctacctgctgctgctcccaggatgcaaagaccccactgctgcaccgcgtcctgcggcattagcagcagccggggtacctgccca

SEQ ID NO: 101991 - DNA, 188 bp, Homo sapiens; identical to SEQ ID NO: 69767
  misc_feature 1..188: note = chr1:6071300-6071488
  misc_feature 1..188: note = Hypo
  source 1..188: mol_type = genomic DNA

SEQ ID NO: 101992 - DNA, 32 bp, Homo sapiens; identical to SEQ ID NO: 69768
  misc_feature 1..32: note = chr1:6086259-6086291
  misc_feature 1..32: note = Hyper
  source 1..32: mol_type = genomic DNA

SEQ ID NO: 101993 - DNA, 171 bp, Homo sapiens; identical to SEQ ID NO: 69769
  misc_feature 1..171: note = chr1:6131714-6131885
  misc_feature 1..171: note = Hypo
  source 1..171: mol_type = genomic DNA

SEQ ID NO: 101994 - DNA, 30 bp, Homo sapiens; identical to SEQ ID NO: 69771
  misc_feature 1..30: note = chr1:6149015-6149045
  misc_feature 1..30: note = Hypo
  source 1..30: mol_type = genomic DNA

SEQ ID NO: 101995 - DNA, 203 bp, Homo sapiens; identical to SEQ ID NO: 69779
  misc_feature 1..203: note = chr1:6166315-6166518
  misc_feature 1..203: note = Hypo
  source 1..203: mol_type = genomic DNA

SEQ ID NO: 101996 - DNA, 317 bp, Homo sapiens; identical to SEQ ID NO: 69780
  misc_feature 1..317: note = chr1:6171630-6171947
  misc_feature 1..317: note = Hypo
  source 1..317: mol_type = genomic DNA

SEQ ID NO: 101997 - DNA, 269 bp, Homo sapiens; identical to SEQ ID NO: 69781
  misc_feature 1..269: note = chr1:6186398-6186667
  misc_feature 1..269: note = Hypo
  source 1..269: mol_type = genomic DNA

SEQ ID NO: 101998 - DNA, 30 bp, Homo sapiens; identical to SEQ ID NO: 69782
  misc_feature 1..30: note = chr1:6189031-6189061
  misc_feature 1..30: note = Hypo
  source 1..30: mol_type = genomic DNA

SEQ ID NO: 101999 - DNA, 311 bp, Homo sapiens; identical to SEQ ID NO: 69783
  misc_feature 1..311: note = chr1:6208626-6208937
  misc_feature 1..311: note = Hyper
  source 1..311: mol_type = genomic DNA

SEQ ID NO: 102000 - DNA, 30 bp, Homo sapiens; identical to SEQ ID NO: 26021
  misc_feature 1..30: note = chr1:6221982-6222012
  misc_feature 1..30: note = Hyper
  source 1..30: mol_type = genomic DNA

SEQ ID NO: 102001 - DNA, 921 bp, Homo sapiens; identical to SEQ ID NO: 69787
  misc_feature 1..921: note = chr1:6239141-6240062
  misc_feature 1..921: note = Hyper
  source 1..921: mol_type = genomic DNA

SEQ ID NO: 102002 - DNA, 436 bp, Homo sapiens; identical to SEQ ID NO: 69788
  misc_feature 1..436: note = chr1:6240272-6240708
  misc_feature 1..436: note = Hyper
  source 1..436: mol_type = genomic DNA

SEQ ID NO: 102003 - DNA, 333 bp, Homo sapiens; identical to SEQ ID NO: 69789
  misc_feature 1..333: note = chr1:6240931-6241264
  misc_feature 1..333: note = Hyper
  source 1..333: mol_type = genomic DNA

SEQ ID NO: 102004 - DNA, 229 bp, Homo sapiens; identical to SEQ ID NO: 69791
  misc_feature 1..229: note = chr1:6266484-6266713
  misc_feature 1..229: note = Hyper
  source 1..229: mol_type = genomic DNA

SEQ ID NO: 102005 - DNA, 502 bp, Homo sapiens; identical to SEQ ID NO: 69795
  misc_feature 1..502: note = chr1:6280243-6280745
  misc_feature 1..502: note = Hypo
  source 1..502: mol_type = genomic DNA

SEQ ID NO: 102006 - DNA, 49 bp, Homo sapiens; identical to SEQ ID NO: 69796
  misc_feature 1..49: note = chr1:6281776-6281825
  misc_feature 1..49: note = Hypo
  source 1..49: mol_type = genomic DNA

SEQ ID NO: 102007 - DNA, 45 bp, Homo sapiens; identical to SEQ ID NO: 69797
  misc_feature 1..45: note = chr1:6294199-6294244
  misc_feature 1..45: note = Hypo
  source 1..45: mol_type = genomic DNA

SEQ ID NO: 102008 - DNA, 321 bp, Homo sapiens; identical to SEQ ID NO: 69798
  misc_feature 1..321: note = chr1:6301689-6302010
  misc_feature 1..321: note = Hyper
  source 1..321: mol_type = genomic DNA

SEQ ID NO: 102009 - DNA, 548 bp, Homo sapiens; identical to SEQ ID NO: 69799
  misc_feature 1..548: note = chr1:6304118-6304666
  misc_feature 1..548: note = Hyper
  source 1..548: mol_type = genomic DNA

SEQ ID NO: 102010 - DNA, 907 bp, Homo sapiens; identical to SEQ ID NO: 69800
  misc_feature 1..907: note = chr1:6309182-6310089
  misc_feature 1..907: note = Hyper
  source 1..907: mol_type = genomic DNA

SEQ ID NO: 102011 - DNA, 32 bp, Homo sapiens; identical to SEQ ID NO: 69801
  misc_feature 1..32: note = chr1:6332155-6332187
  misc_feature 1..32: note = Hypo
  source 1..32: mol_type = genomic DNA

SEQ ID NO: 102012 - DNA, 113 bp, Homo sapiens
  misc_feature 1..113: note = chr1:6360521-6360634
  misc_feature 1..113: note = Hypo
  source 1..113: mol_type = genomic DNA
ccctctccacaaacacggaatctcaccggaccccacccgatcctgtgatgcacaaggccggccctctccacaaacacagaatctcaccggaccccacccgatcctgatgcgcg

SEQ ID NO: 102013 - DNA, 30 bp, Homo sapiens; identical to SEQ ID NO: 14204
  misc_feature 1..30: note = chr1:6360980-6361010
  misc_feature 1..30: note = Hypo
  source 1..30: mol_type = genomic DNA

SEQ ID NO: 102014 - DNA, 111 bp, Homo sapiens; identical to SEQ ID NO: 38837
  misc_feature 1..111: note = chr1:6391430-6391541
  misc_feature 1..111: note = Hypo
  source 1..111: mol_type = genomic DNA

SEQ ID NO: 102015 - DNA, 29 bp, Homo sapiens
  misc_feature 1..29: note = chr1:6422825-6422854
  misc_feature 1..29: note = Hypo
  source 1..29: mol_type = genomic DNA
ttggctaggcgcggtcgtgcacgcctgta

SEQ ID NO: 102016 - DNA, 274 bp, Homo sapiens; identical to SEQ ID NO: 69828
  misc_feature 1..274: note = chr1:6446079-6446353
  misc_feature 1..274: note = Hypo
  source 1..274: mol_type = genomic DNA

SEQ ID NO: 102017 - DNA, 30 bp, Homo sapiens; identical to SEQ ID NO: 69829
  misc_feature 1..30: note = chr1:6446992-6447022
  misc_feature 1..30: note = Hypo
  source 1..30: mol_type = genomic DNA

SEQ ID NO: 102018 - DNA, 59 bp, Homo sapiens; identical to SEQ ID NO: 69832
  misc_feature 1..59: note = chr1:6479255-6479314
  misc_feature 1..59: note = Hyper
  source 1..59: mol_type = genomic DNA

SEQ ID NO: 102019 - DNA, 735 bp, Homo sapiens; identical to SEQ ID NO: 69833
  misc_feature 1..735: note = chr1:6480216-6480951
  misc_feature 1..735: note = Hyper
  source 1..735: mol_type = genomic DNA
